United States Patent 9,567,581 (SELECTIVE REACTIVATION OF GENES ON THE INACTIVE X CHROMOSOME) - sequence listing, part 18

SEQ ID NO: 2769 - DNA, 1950 bp, artificial
  synthetic oligo
ggcagaaataggataacactgtaattaacaaagaaaataaagatttcccttagaaatatttactaatggcttcttaagtaaatagaaacttctaatttattaactttttaaaggagttacttctgaaaatcactggtttttatttatttaaaaaaacagtttccaagtaaatagatttttaaaccaatgaagaagtaaacttctgaaccccattttgttcactgtggataggtatgtgtgtttttatcagacttggtctaaaaaaaaaaaggaataatttcaatcaaggcaagcgctgacagtaaatgaatacaaaattttgataattggtgttattgccaaatttggcctctaagaaaattaatgcaaattaaattaaacagattttagaattatgaaaaggagaaaatcaaacttatgttaagaatagtatggtgcttggaatgttccaagttgtacacatacaatatcactgtttggtactaatatttgaaaaccaaactgcttatttcgctaagcatcaaaaaaacaagtaagatgaacttcagcagtacaaaattattgtagatgtaacaaaactccatgtgctaccttttgtgacacatcctggacactgcaagagctcagacattcacattttatattattttctagctaagagcatttcataagcattccctgcctgttcctgtgtttttacgagtgactttcatttttgtagaaagaaactaatgccattttctgataaaacttaggaattaaatctgttctaaggaaccaacttgctatacatttaaacttagagatcctgaatactctgggtttccttttgcatgaacacattctacttattcactctcctgctatttttgaaatacaaacagtatcaaactaaatagtagtcctgttttcaaaactttctttgcaacctgtattagggaccaatatctagtagaatgtaggtaccctgccagtaaatttgaaatatttaccaaagatcactcacagtaaatctctccaaaagaaacatgtgcataatcatttgaatatgtgactctgaacagagttttaaaaaggaggcagttagacttatcattcaatatatacctccaatataaccaaagacacatgatcaaaaatattttaaagctacagtattgcacctattttaaaataaacacattgaaaaagatagcataatgatcataactgtgatagttaacatttactggcatttactatatttcaggcactgttatagtgtgtttatttaatgaacattgttttttaacatatgatgatatcaaccccaaagaattaaaactaaatttggaattttgcccttttaagacctgccaaatagtgtgccattggattttttccttcctagaaatttcctttatataaaaactattcagtgatgcagctgacaaacataaggaatcaagtgtggatatgaaaactagatgaccagacactagatcattaaagactgtcattattttatgccaacattttgtttgttgttgctgtcttttcactcgtgttttgttttgttttgacacagaggatgggggaaatcctcctacaataaagctcacgatttcaccttctgtcatctcatcttgtattaccccctaaaaaccaccttttcagaaaatcacactgtagccccctcaggcccttgtactcttctactcttctctggctccccctacctcttcattccttcagtcccattatcctgtactaggtcttactaagcacttccacaatgttgtgtctctctgcttctttctaatgtcagtgctctccagccaaagaccgctagcaacagacctgtagtttaaaaaggtagatttattacttgttgcagcaattggaagagcacacaccatggaaaaccacagggcatcctactaagagggtgttaaaaaggacttgcaggat

SEQ ID NO: 2770 - DNA, 1000 bp, artificial
  synthetic oligo
tacatgtattaactcatttaatcatctgaaaactctgtgaggtaggtgcaattattatcccccttttacagatgatgaggaaactgagccacagggaagttccccaaggtcaaaagttattcataactatcagacagcaggtatattaattcagcttaattcaaggctcatttgttaaccatctagtaaatataatagttgacagggtagacaaaaattgaatacttaagcaaggataaatcgtaatgtaataatgccatgagtgaatcgcctaggcgagtcaggctcctttcagttagtgggaaatggagaaagattatgtagttaaggtcatgaatagcgcaggaacatccgctagggtaagtcaggtttgtgaaaaatgcagaagaaaggcttggttctgaggtgtgtgaaaacagtcattcttttgtgaggactaaaattagttttagaagaggcatctgatgcggtacatgaaacctagggtaacggtgaggaaatacacatgtatgaggcttcttaggagcagggaaagagaaaggtgccatttgaagtcagtaagaaagggtaacagcgcgcttttcctgcccttcccccctctagagaatcagtaaatagcctgattctactcaaattccttccctacccaaattcccttgactacaactcagaccctttggatctgcgctttttagaagtactgtacttcacattctggcaccgtaagcccgaaatgtcctttaggcaaatgttaggagggaaaaatgtattcttgcaattcaaaaccgactcgaatcctgccagaaagctttatgtttgcggactttatcgttcctcgcctgtccgttttttataaaacgacgcgacacacctagccacacagcctcagatcctattctaacatcgatccatcctgttacccttttaagaggcggatcccgcagtgtcctttcctccctcccagccacctctacccccagtcggctgggcggagcttcac

SEQ ID NO: 2771 - DNA, 1600 bp, artificial
  synthetic oligo
gagaatcccagattgccccttttctcattcacaagaaaaatccctgcttggagcacacgcctgcctcactcgagatggcacacatcttggaaggttaccccagagatgctcctccagggcagagttccttggcttggcatctgcgtgtgccccaccccatttttttttaatccacatgactttgaggctctattctcaaaacagcttgccaagagccctttgcttatacatggcctcccaactccttcctccctctaaactttttttcacttttaatgcactctttaattccggtggacttagttattgcaataaataaaaacatctgtcaaatatttcctcacagcgatatcatgcaaattattgacctcattcaccttagtgttcaaaccgctgcgcatcattgccaagatacaaagagatcaagtttgcttccaaagggatttttttaagagtttaagaaaaaaaaaaatgcacataaattgtttagattccaaaataggaagctggacaagagattttctgtggttcattacagcagtttaataaacagataggggcgacagtgaaggaaaggagcggtgcacggagtgaagaaaacgcgtggcttctggaaattttatattcttcctatataaccaaaaagagcttaatctaggcatgaattttggatttagagaaggaatcgtatcactgactgtgtgaccttggataagtcgcctcacccgacagtgctttcctttattaatgtgcaaagcggggacgaatgtccacttcgcaagactgctgtgaggattacgtgagatcgcctgagtctatagtgagagctcattaaatgttagttgttgctactgctacttcctggaatgaaccgatattccaaaattccagaaactttgttttctacagtttaatgccttcggctgtaaaatgataaaaagaagcaacacctttacacctgggactcacttatttgaaccaaaaaaatgctttaaacttcagataggcaaaacacacttaactgatggctgggacccgctttgaaagcacccccacccattctcaccccagtgtattgtgggaagggtagtcccatgttccagtcgcttgagcacagaaaagcgcgtaggaaactacaactcccaagaggtaaagaagcgggactatttcccagtctggcggtagcgctgtgggagggaattggcaatctctctgcctacgtgggagagaagggagggttgggggaagtgtggaaaacctgaacctgagctgctgtcgcctgaggaagatttggtgggaggagaagcagaggggaagagacgggttgagagtgaggtgaggagggcatctaggtcactgctcccggggggcacaaagttcgcgatgtggctgaagcctgaggaagtgcttctgaaaaatgcgctgaagctgtggctgatggaaaggtccaacgactacttcgtgctgcagcggcgtcggggctacggggaggaaggcggaggggggctcacaggtaagctgtggccaccctacctgcctctgggctgtgttcgctgttacttaaaaggtggtgaggacaacagttactcgtcgctaccag

SEQ ID NO: 2772 - DNA, 1150 bp, artificial
  synthetic oligo
tcagtggtcatttgcatttgaacagattcttgcatcgctgttgaatgaaccagcattggtgaggttttttgagaaacccatagatgtaaaagccaagctggaaaatgcaagaatttctcagttaaggtctagaaccaagatgtaaatccctaggaattgcctatcatagacaagtttactaacattcctgtagctgtcagtttgattcctgtgagtagggctcagggatttatcttgttaccaatgtgtctgaaggccaaaatatatatccagaagcacaatgcatcattcctttgttgttgataatgggctttgttagcactttttaaaacaaacaaacaaacaaaacaaaaaagcaaaccacatttgttatctcaaattttgatgatattctcaaatacaaatatacttttttatatttcacaatatatgcaatatcaggggaatatgctaaatgttaccaccagagggcacaagcatatcacttttagtaaggaaattactagcttgtgttgctatttacatatgaattactgattattttgaaaagacggtgttatgcttgggtgttagtgaggctgatatgtcatgtcaatcgataaaccctactttccaaattatctaaaagattaccatttggggcccttgttttcaagttatctaactgaaatattattaatttttttaagttaatctcattcagtcttctagtaataaatgcttttttaagtaccttctacagtcttcctacctgaggggttcagaggctgctgactcacactgctaactctgttactgacaaaagcaaatcaataactctaaattctgggctgatataaagaaaaaaacaatattggatttggatttaatctgggtaaaatcagccttctgagaagggctaagaaacagttcaattaactgtataggtctttcattagaccgagacatcactagaaattctgggcactgctgtttgtggtatttgtctcagagtagcttatgactgttttggttctagctttagattttggattttcaccagtcatgtgttaatttacattagatagtaaagaatggctacactaagactgaattatcttattagtctggcaagcatataaagtatacttgtatgtaatgattgccaagg

SEQ ID NO: 2773 - DNA, 3150 bp, artificial
  synthetic oligo
cactgcttcctcctgcttctctcttccctggccttaacttcaccacccagacccactgtccagcttcccagtctctctgggtccccactgaggctgccctttttggggaaggaagagtggccttttttcttggccctcaaaactcctctgaaggggtctggagcccgctgggagaccaagagcttctcttgaatctcggctgctgcatgtttagtattcacagcatgtctctaaaaaacgtcctgagatcattcatcaggcactgtgctgtgtgcctagctgctctccttccgggtgtgtgtgtgtggccaggaccctccctccatctgctggtgaacacacatgcacacacaccttaacctttttcccttttcaccaaaccaatcgcattttctaagcagacctttgccagctggcagatcgctcccttactgaggtgggctcctggcgttgggcctgggctcgaagccgctcacactccagtgctggggagaggcgctgagagcaggagcccgagccgaaactcaaggtgcgtgtggatgtttgcgatggtgaccaggaggggagctgcagggagggcatccccagcagaaggcgagcaaacaaggggcgagaagcaaggtcaggggccagggaacggagtctccgaagcaagcgttcctgctgccccttctccgcagttcactccccgcccccctttcccgggttcactttggaaattggcttgccctctcggcagccagcagttcccggcagagtccggccgtaacggtcagattcaagaagtgaggcagcgccaggctgggtggctgggttgctgggttgttcttgggagattctttccccaattgtcaattttttgcttatttttagtagtgacccgagccaggaactgcgcctttaagccgctttcccattcggggaaatcgacgccagcactcgagggtcgggaggcgccggagaggcccctcattctgcactcccctctttcctccccctccccctccccccgccccttctcccctcccctcctcggccgtccggccgcctcgccgccatccgtcacctcgcagcctgccgcactcctggagcgagagagcgacgagcgagccacggcgatggtgccgcccgcggcgcagccatgaagcccgcccgaggagcccgcgcgcgctcctgccatcctgcccgcagcccgccgcctgcgcgccagctccccgcgtcccgggccagctgctgccgccctgccaacctctgcccgccccgccgcccggcgccactgagccccaagcccatgccgggctcgggggcacgggtgccctagtcccgctgccgccgccgccgccgccgccgctgcgccgccgctgccgcgccgctgaggaggcggaggaggaggaggaggaggaggaagaggaggaggaagaggagggggaggaaggtaagaggcgcgctgccttcaggggggcgcgcccgctgtctcagcccaaccgggggtgggtcgcggcgggagcgttccgccccgggccggctggggggcgactggcgcttgggcgcccccgggagccgggggcagggcggggggcgccgaacgtctggccgcccggagtttgggcgggcggggtaacggcccgttgcgtgcccactgccccggcgagtctctggcttggcgggctcgtttggcctccgcgggtgcggggtgaggagtcgagcgcaggggagtgcagcgcgttcattatggagcctttgtgtgcgcgcctgggctgtgggcacagttgggagagctggcgagacgcggggcctggctgctaggaggtggccacttagccggggtgcccggcgaagcccgagcccaggggctgccagaaacagctgtctgaagcatgtgcgtggttcccggggccatgttcacaagcggacacggaggcgcacacacacgcacacacagccgcacaacatacccggcgctcagccacacagtcagccccatgcaaagaccacacacacacacacacacacacacacacacacacacacagagagagagagagagagcgcgagctacacttgccccctcccaccaagatgctaataaagctcaaacacatatacagatacatgcacctccccctagcgctgctaaaacatgcacacacaaacacactcctctactccccagcctagtgctttggaggttggagagtgtgtgtgtgtatgtgagtgtgtgtgtgttttctcagagtggtcttgagaaactacatgacaactgcacattactgcagatccagtacctgctgcttccccccaatacacacccagcaaccccccgtcacacgcagctactgtagacacctccaccagagcccttaagaaccccattctggcaaaaagcgtgcccaactctggtagtcataccctccacgctcgagctgttgggtttcctgcacacacacaccacagccccatacacacacactgaaaccactgcaggggcaaatgtttgacaccttcccccagaagcaggtggcacctccacccttgcagctgcaactaaagagccccagatgacagcaaacgccgaattctgctagacctgcccctccccttggcatcttggtccaggtgcaaaaccctggagtccaccgggtggtcttagcatcctgcagctcttacggagggcggggcagtctctggactcctgccttcggaggaactgctataagcgcaaggctcccttgggggcgcccttctcgaagtggagggtgggggattctatgctgactcagagcgaagcaccaagtgagttttcccagctggagaccggggtaaatggcgaactccacctgggcctagaggacccgggatagtgtgccagttcagccacagaggccctcagcttggaggccctgcccctccctcgccttccttgcccatgaagctcactgcaggagaagcagggggaacccagctgccagcttcttgggagctaagagaggcttttcgggaagcctttgctgtttccgctgagcaaagagatcttgctctacccggggagacctcaacaagacttggccgtgcccaagcaaacatgccagcgtctacccaatttcatggcttgtttttttgtttgtttgtttttgtatttcatgtgaaagg

SEQ ID NO: 2774 - DNA, 1250 bp, artificial
  synthetic oligo
gaaaccacccgagtggagcaggggcggaggcggcccctctgagtgctaggaccccactctccccgccgttacgcttcggaagtgtccgggacttctagctgcctctcccacccctgcccctcagcgcctctgcttccatggggccgggataccctagctggcctgccctccggtagggcgggttggagcctcagcgttcgcgaagctccgcggggtggagaagcaagaccacccttcgaggtggtgcaccaatcacagaaatgttagcaatcgggaatatgcaggagcatacctatcactttcctttcttaagctctgtaaaactcaggggagaggggcctgagatcctaaaggcgagtttatcctaactcagtcccttctcagagaacacccagatcttccttctgttcctccatccccagtcactcattttacttagagtactgatgatcctagtagctactattataactatgtgcccgacattgtgctaagctctttacctagtccatgtacagtaagagcagtagctggcattcactcagtgctttctgtgtgccaggcacagttctaagtgcttaatatgcattgccttgtttaatcttcacaacatccttatagggtagatactatccccattttacggatgaggaaattgaagcacagagaggtccacaagcccaaggtcccacagccagtgagatgcagacctgggatctcaaaacagttttacttcagccctctcactgttaactactagaaatatgatgagaatttggctttaatgaaatagtaaaatcgagtttgctgtccctacagcaaagtgtatttattctgtagatctaaagtcatggcccaggtgcaaagagttttgaatcaattttcaaatcatccccattatttctcctgtagagaaaggcaaaccgagtgcgctataacaagacagcagaatgtattagtaggtgcctagtaataatgataacagtaattgctaatagcagttactgattgagcacttactttgcaccagcacttcatgtatatttaatcttcacataggtgctttgaagtaggcaccccatgaaccccattttgtagatgaaggaactgaggctcaagaggttaaccaatttgccacagatttgggattccagcccagatcactaactccagagctcaagttggaactaccctttagaagatctgtgcatgagacagagatttgtcttccctacagtcccctcctcccc

SEQ ID NO: 2775 - DNA, 3550 bp, artificial
  synthetic oligo
ttctatttgcttggatatatatctagaagtaagattgtttaatcatatagtagttctatttttaattttttgaggaacctccatactattttccatagcagctacaccagtttacattcccttgcatagtggctgtacctttttacaatagtgtgcaagggttccaatctctccacaaccttaacacttattattttctgttctaattttattttttgtagagacacgttctattcatgttacccaggctgatctctaactgctggtctcaagtgactctcttgcctcagcatcccctcctgagtagctgggattacaagtgtgaaccacaccttgccgtattttcctgtgtgtttgttttgtgtgtgtgtgtgtgtgtgtgtgtgtgtgtgtgtgaccatcctaatggatgtgaagtgatatttcattggggtttgatttgcatttccctaacaattagtgatgtggatcatctttgcatatgcctgttggccacttgtatatcttcgttggagaaatgtctattcaagtcttttgtccacttttaagagttttttttttaattgagctatagaagttctttatacattctggatattagcacattatccgatatatggtttgcaaatattttctatcattttgtaggttgctttttcactctgttgattgtgtcctttcctgtgcagatgtttgaaagttttatggtcccatttacctatttttgcttttgttgcctgtgctttaagtgtgactcactaacttttacttctcttaggggccagactttcatcaggagagcctggttgtgacttttgtcttggtttccacctcagtgctctctagcacattgtttaacaggagtgttgactgattactattggttccctgaagggatataccaagagatacctcaatttttctggacttgttcctatgcacaatgatgggaggcgtgtgtgtgtgtgtgctggggtgagtcttcccattttctcatttctttccccttcttctccctttttgccccaagttagaaacagagtctcttatggggcttcctgctctttccctctcccatccaccttttgagtcgggtggtggtctctgagccaatgacaggtcagcaaacaggctgattccagaccaatgggaggatgctggattccaaatggaccaattagcttattagggacctggaatagctggatagctagcatctgcctcattgtccatgtggtaacgaccctcttgttttactggtcaacaatttgaaggtacaagaaaaatcctacttttttttttcttttgatggttttaatccacctccacaacttctgcccgaggccaataaaacacagccattctttttttgtaaaaagaaagagaggttcggtttccttcaattgtctgcccttttctatctcctccactatttttgttttactctgtagttaactttgcatagagcagcttcatagggaggatctctgcggtggacccggctctctcttcttattacccgttgcaaaggcctctttcttgttctaacctgggggtttgtggggttgggggacagggggattggggagtgggagaagagtttagccatagccttccttctgcatttcacacacatttagctatctctgtcgctctgtcacacacacacacacgcacatacacaccatacacacacacacgcacacccgtccgggtccctctcggtgtgtcttccttcaagatgacagggcgctggagaaaaggctgctggaatcagctggtaggtacagtagtaacccgagccccacccaccggctgcctttgcttgctcaggtttctccggtcactcctgccaggggagaagacatgtaaacgtgcctccagaggaagggctgggggagctgggagtggcgggggcggcggaaggtgagcctgggaaggtggccgagcaccccttcttcttgggcccttcccagtgctcccttggggtgtcagccccagccccgtttgcccccactccgcctcccttttggaagggattgccttttttttcctctgcggcggcggaaatgacagtgtggtgctgccgtggtgtcatggtgctgcccctggactgaggggcgaaaactcttaagtttagctcgggaggcccagctgcggtagcatcgcggccgccgtgctgtcccctgcggggcgcgcgggctggcggatcccggctgctgcgcggcgtcggcgacggtagcggcagcggcggcgaaggcgggcggcggcctacagtggtagcggcggcggcggcgaccggggcccgggagctcgcgccggagcccgagccaacccgctgcggaggcagacgagagcccagcgccctcgagcgagcggaggagatggctggcacctgggaacgctatgggtaaaacgcgccccctcgccgcggccctggaggtcgagcgtcgtagccctcgcagggctagtctccggctccggccgcttttcaggtgccgccggggcccggcgttggccgagggctctccggctcggcgaggcagggtgatggggcccgcgaggctcgaaacggcgacgggggccccagctcagctccggctctcagtcatgctgttggggcccgggttcctgccactgccctcctgggacggagtttgcactccggggtgcggggcgggggcggccgaggcctctgcgcagcctggccgggcccggcgcgggcagtcgagcgaatcccccggcgcctgggcgcgagtctgggaaagggcacggccgccttcccacgctcccgcagccggcagcctcctcggcccaggcgtcgccccttggccggccgtctgccgggcggtgctgtcgcagcagccggcgtggctgcggacgccctgccggcggggaggcccggtgaaacttaatcccttttctgccagggagcgatcctcgagtctccgtctggatggttccttatttctggcctagctgtgaaatcagctctgtgggggagagggaaaacttacatatgtccacaggacagactgcgacgcaaccagggagagtggggattttccattcctgccttgtaagaattaagtaaataacggcggagtagatttacagaaacattactggtgatgataaggtttaggttacttagcacttcgtgtgttgcacattatttttcagaggtgtttcttcttagagcaggaaattgaaatcctgcagtcgttgtactctttactttctctcttccacggtcccctacccgttttcaggatcactcaccttcctatgtcacaacgcttacttgcctacccaaatcccccagcagagccccttggaccccagcctttccccatcaacgtgtgcactcccagcctcccagccatgcagcatcttacttctcaaccactttgcctttttgaggatttctgagtgtggggcggatagatggtgatggttgtgtgtctctgaggatgagcccttataaaggaatatattggaaactaaatagagaagtactgtgtgtgggttgatccctctgattctcaag

SEQ ID NO: 2776 - DNA, 1050 bp, artificial
  synthetic oligo
aaatgaagataagcaaggtgagttggaaagtatagaaatttacatcattgtctgtatataagatagatatataaggtgtataagatagatgtatagatataaaataaatatctaagataagagatataagatagatatgtagatatgatagatatataaatgtataagatatgtaagatagaataaaccgtgcaagtaagtaagatgaatgaggagattcagattcccagcttcccacaggacttctcccctgacatgttttcataagcagctaaaactctatgtcccggactgacctcattagtaccccttcctccttgtcaccccttcacctaaaacctgttcttcctgctgtggtcttggaggcctcttcccctctctaaagtcatctctcatccctctcccaccccactttagaactgtgtgaaagttacttttgaattcctggtgcctagtcccatgccaggcccacagaaggcatgggtgcttgctgagtgaaggatgaataaatatttcagtgctgagtagcgtgcaccccccaaatggacttcccctactgatgatgcacacaggcaaatttaaacctttcaactatttgtgtcacccacagatgaacaaatgcaaaaaaaaaaaaaaaaaagaaaataatcatgagagaaaagagaaatacagcattaaatattttaaaaagaataataggttatctcagagtatttaaggattctattttcctttaaaactgtgcttttaaagcataaactatattcctggtcatttagtatttgcttatatttggctgttttaataaaggcatattttaagacacaatgcggaaattcatggttataaatctgaggaggaggcagacagaggagtcactatttgaatcttaatggcctcttgactagaagggccctgcacctgaagtgctctactcccacctggtggtgcaagcagaaaactgccaacatacattttaataattttttttgtgtgtgtggagacccagtctcactttgttgctcaggatggagtgcagtggcgtgatct

SEQ ID NO: 2777 - DNA, 1250 bp, artificial
  synthetic oligo
gtcatttgaaaccaaacatcatcagatttccagagacctttgcaagccagatgtgagctgtctgttgtctgattgtcttggctaactccttctctctctctcatgtctctgcctaaatgtctcttcctcagagaggcctaaactgtttccccagtctacatcagatccccttgttataatctctaatcgtatatgttaacttctttcatagtacttatcataattttaaattattcatatttgctcatctgttcaacaaatatttattatacatttactgcctctgtagatacaacagtgaatgaaatagacaaaattccctacccttaagtagcttacattataggaggagagacagataaacaaaagtaatgttatagagtaaataaaggcacaaacataaatttccatgccaaacatattttgcaacaagttttatgctggtcaatatatattctacagtgtatggttatgacgaattatgtttctttttctttttctacttgccttttttaaaagttttgtttttaattggcacataataattgtgcatatttatggggtacagtgtgatgtttcaatcatgtatacattatttaatgatcaaattagggtacttagcatatccatccccttcaacacttgtcatttctttttggtaagagcattcaaaatccttttttctagctattttgaaatatacaatacactattgttaactgtagtcaccctactatgcaatagaagacaagaatttttcctcctatctaactataagtttatacccattgaccaaccaatgtccttctccccttctccctactctccctagactctggtaatcactattttaccctctacttctacaagatcaacttatttagattccatatatgagtgagttcatgtgttatttacccttctgtgcttggcttatttcacttaacataatgtcctctaggttcatccatgttgtcacaaataacagaatttcattcttttttatggctgaataatattctgttgtgtacatataccacattttaaaaattcatttaacctttgatgaacaattagattgattctatatgtcgggtattgtaaatagtgctgcaacaaacatggaagtacagatatatctcttcaacatactgatttcatttcccttacatatacacccagtagtaagattgtgataaacaagtcctccatcaaagaaaagctcaggacctgatagtgtcactgctgag

SEQ ID NO: 2778 - DNA, 1000 bp, artificial
  synthetic oligo
agagatatacggtagtacaggtgttaggtaaatgctctgaggagttacggagcaagtaagagtgcagagcaggtctctttcctatcctccatccacatctcacaaagttctacctctctctttcctcttccccttccctgtgctctggctacagtggcttagtgcttgacatagtccttcccacaatggggttgacaacaatgcctggcacatagtagtcactaaataaatattagttgaagggacgaaaaaacagtgagaaacagaaagacaaaagaagaggagacttcagaaaaatactaacttaacttcctaagagaagaacaatatgtccatctgtagagacaggaggaaggcaagacagaggatgaaaaaaacaggagaagcagaaggagtgaatatgcacgtcctgttaagccaacatcacaagtataactgtgacctaaacatcagctacatgaggacaagacaggagatggaattggatgggtaggcagggccagatcagatactccatgggtgtagggagcttccacaaatgttagagtggcatgatcaatttgtgttttagaataagctctttgctttcagagaggatggatatcaggaaagccaatgaggaggcagtgaaagtctgaaactggaacagttaggtctgctgtagggagtccggataagagatgataaaaaacttaaattaaagagatagcacagtagagtgggctttaactctgccatttgttgggtttgtgaccttagataaatcagttaatctctctgggatgagaatatttgtccctcacagggttgtcttgagcagctaacaaaataatatatgataaagtgctttgtaaacttgaaagacttgaaaacatatgttactattatggtggtgaaattgggataaagagatgagggggacaactgagaaatatggccattgtccccagggatgtccaatcttttggctttcctgggccacattggaagaaaaagcatt

SEQ ID NO: 2779 - DNA, 1500 bp, artificial
  synthetic oligo
tgaactgtgattctcgaccttcctttagatttttcacctaaccctacctgacagaaagttatttttctgattcagtagtaataacaaaattctccgtctgcttatagtactaaacaaatacttatagtactcaacaaggcatatattgtttcataaaagtagaatagctttgggcaacaggcaaaatgataatttccaatttttgagcatctcctttcaactggcactgttagccttacttcatttatttctcacagcatccctaagaggtagggaaaattcttattctcactttagagatacagaaaaaaaaaataaagtacaggaagtttatgtgctctggccaaagtcacacagctgatacatggtggagccatgatgcaaattcaggtagcatagttcctgggcctgacgctgaataactttgctatactgcttcaggatgcaaagaagttattgaagtgtattacgctgtatatttacagtatacgttattttgttgacatatatgtgtgtgtatttatggcattataaatgagtttgcttttcttcagttttgagtggagaagtgacccagctttctgccacattcagcccagaaaacgtgacccgaataaacctcagtgctgccctctagtagtcagctcccacactgaaagtaaagccaaggttgtaatgacaccacgcggccgcaagatgtcaatattttaacattattatcaaactcctctaagatcaattttttttagaaattaatacgggttgcctgattgttgtaaaactatgttagaaaattcagaacagtaaaaaacagaaaaaaatttttgcttttattgaatcctgtatttttccaaagttatactcaaaccaggtatacaattttgtaaacttatttttttaatttgacatggaaacatacctatgttctcactaagggcacaggatttggagtcaagctgacctgccttcaaaccccatcaccatattccctagctgtgtgacctgaggttaattacttaatttccctaaagccctaggtttcctcaaatgaaagaaattatgataaacagaactatttcccagcactgttgtggggattaaaaagaatgatgtacattaagtgtcgcacacggtgggtgctcaaaacatggcatttctttagaccatgctaatcccatggcactcttgtttttagaagctccactctacattttatcacatatactttgacatgtacacaccccatatcccatgtcaaataagtatatattttgctaaaaatttgagacgattttaaaattttgcctttgaaatttattatcagttatgcttcttagcagagattatatatactaaagaattcttaccaactgatacaatctaaccaaccatttttccaatgtgtcaaaattgttctgaacacaaaatgaaataatctataaaaatgatgagttacattttttgacatttacttagacatttatagactttaattttgca

SEQ ID NO: 2780 - DNA, 1500 bp, artificial
  synthetic oligo
tagattatcccttccctctattgtgtaacagacaaaaggaaaggggtgcctatccatctaggcttgttgtgagagccactccttctcagtgttctttactttctgaaaggccctgtgactggaagtcatcctcttttagttttagccccagcctctctatctcagttgctgagacttttctgctcctacctcactccaggcagcaagggtttcatttctaccatactgaaagtggcatgaggccacatgggcccttgagctcactggaagatagtctgggagttctgctgggcactgctgcttcttggcttatgcgtggatgctctaaatcaggcattccggcagatcttaagatctggtgtgagatagccccaaggactggtcaacccaggaacatattacaggatggagtctacttatagtccagagatttgcctcctatgccttgatttctatcagttctccatacttgcctaaatattctttgagactgcttttaccctgtgcggccacttggggtctcacgatgtcccaaaacacttccttttaatttgctgtaaaagcactattttcctcacgaggctttaaggaaagtctgaagttccaatatccaggagacttgtgccatttctcaggtctgtcccctgtggcacaggaaacagcctcttaatattaagtctcagaaatacacacattctgaatagaaccaggcagataggtgttcctgggcctcagaaccctgctactcatcgttcctggcttctgaggtgtgtgatggaagtcctagccaaatctgcatggctgttatttaaacatatttgtactctaaggtcaccataaaaatctgtcaggtagctgggttagactggtctgacatggaaaataccaagtagccatctttcctccctccaaaagaataatccaggaagccacatcctcaagacttggctaactctaagataattgtatctccttagagcagatcctcccgatagcccagttccctaagtggcgaggtgagagatagtagggctgtaatgagagacagtatgctctgttattgctaataaccaatagataccctggtgcagtgagggtttagcttgcagcaccagtggagtgatctcaccaaactgactttttactccaggacctcaatgagagcatctaccaccccgcagaagttgatgggccccagtaccttctatctggccaactttgagctattttgagggctcatctcccatctccctttccagctctttactgccatctgctgttcacttggggggaattatgagcattgagagaaacatctggatttcttcacctttgatcccaagccttggacctaggccttgcagagggagaatggatctgaagcaagctgtcagaagattagttttctgtaaaccaagaaagccgagagtctggggcttctgttccctagaagtcgcttgtaattttgtagaaataaatggcttagcaatttttacccag

SEQ ID NO: 2781 - DNA, 1050 bp, artificial
  synthetic oligo
gcccaactccagagccaagatttatctattgttttttgtcacctcaacaaatatttaccatatgccatgcagcacactaggcagtacctacaaagatgaatagggcatgatctccttggccttccagaggtaacactagttggggctatatgggtgggaatggagtgtcagatgcagaagctaaggaattttctctttacaaacaggtgggtgagaaagtagacacagcactgtgaatttgtggagttttgaaaaatggacagagggctacagactgagagggaatagggccaccaactctagaattaaggtcaactgatagggtagaaacatgccattctcaggggcttaagctgacaaaagaaattgcccactgtagaaatgagattggctgcccacagaaaagtatttactgatagataagggacctccctatgtgtcattaaggagtaatgctctaaaatgtaatcagtggaaaacacaactgtagccttggaaatgctatggctgggaaagtccatataactaagacggggttcatgatattgtgacatgtacaaacaagttatttgaccattatagagagaaaaataaaaataattagaaagagaagttgcttttattactctgtgccctggcctactgacacatttattgactttctgatagggtgatgcatggatgcatcagactgaataaactacatgactccatctcttcagatcatcccacaccatatactatctcttcactcaccagtaataacagtcaccatataacaagtgcctacagagtcaaacactttacataaattatcttatttaatcctcaaggcaactctatgatatcatagaattctattattagttccattttcaaatgacggaactgaggctcagagaggttatgtgacttaagcccataaaacggaatgagtggtatattagttttctgtgactaccataacaaattgccacaaacttggtggcttaaaacagcagatatttatactttcacagttctggaggccagaagttcaaaatcaaggtg

SEQ ID NO: 2782 - DNA, 1150 bp, artificial
  synthetic oligo
gcatctaagttgtctttagtgagaaaccatctatatatacaaagccataacatgtggatgaaaaggacatactgtcaactctcttgtgccagacacccagatgttggcaagtagtacttggaccgaacagcatagtcgttgaacagcatcatcttccccttttttaattcatccagatgttttggcatcacagacacatagccagatttcatccctgattttgtcaaaggcttaaaaaaatgtgaaaaaataatatgcttctcctctgatgaacaattaccaatgaactctgttcaaaagggaaaacataatgtttcatttaaaagaccaataatattgaattaagataaagttcccatgagagtatattttacattctcatgaatcacggatgagtttattatgatccatgcttgtatgaaagactgacaaataaattcatattgatttgacatttaaaatagcatgtctaaaaatgtacagcatcacattaagtatcaagtaattattcaactatcagcttcaaatgtacatgggagaaaatgggtccagaacccaaaatgtagtgaaagatttaaatgctcaaatttctaccacaggttttttttttttttttttttttgagacaaggtctcactctatcacccagtctgtgtgcaatggtgtaatcatggctcactgcagcctcaaactcctgggctcgagtgatcctcccacctcagcctcccaagtagttaggacttacagtcatgtgccgtcatgcctggctaatttattttatttttatttttgtagagacaaggccttgctttgttgtccaggttggtcttgaactcctggcctcaagcagtcctctcacttcggcctcccaaaggactaggattataggcgtgagccactgtgcccagccttctaccacaatttttaaagaagccaataccatacattaatccatttacaagggctcacgcaagagtgccttttgagcctgtgtttgacaggaagtttctattcagatcattgtgcctagagtatatagaggggttacagcaaagtgctgtactttgggttacagtaaagtgactcaattgatgtaccaagatattgatcatttacaccctttaggcctgaaaaatatacttttctttgt

SEQ ID NO: 2783 - DNA, 1550 bp, artificial
  synthetic oligo
cacatactacgtgaagcaataaataaatagtagtaatggggtggtggttgctgttattaataagaataatgaaaataataagcagaattttcagttcatggaatgttgctctcagtcattgattagataaatgtctcccttttcctgagaacattcagggccatcagagtagtaaaatgaggattaaaccactggcagaattcaatgagccccaggaactaataattatcctggggcaaaggactttcccattcaggcttgccagtaccttggctggcttgtgagtactgccgtgggatagaatacaggccaggaatccgcatttctcacatttggccagaaggtggtgctgctgctttatttgagtcaggactgcccaggctcctggctgcggaggctgctggcgtttatagcatttacaaactgagaggctgggttggtttgaaaaggatagaggcagaagggacatttgctccagctccaaagttgttcattgcttcacagcttctttaatctgatagcctcaccttcaatgccatatacctgacaacgcataaaaacaggtctccaccatgaacaatttgtctgtttccaaatcttcttgatactggcttttgacctctaaacttgtttcttgtttacagattttcttgcctcctgggctccctccacactatcctgtggctgtggcagatatgtcaatacccttacattcactgcgattcaacaatacaatgagggaggaaaatgttgagccccaaaacaagcagatggccttctgtagaccaatgacagagaccagagcagacgtacagattctgcattctcatgtacagttgcctatagtctcaacttcagcctcagaccctggagggacatccacacagttgatgacatctccagtctttgacaccatgtctgcacctctaatgggagtaccaaactctggagcattgtccccacccctaatgccagcctcagactctggggcactttccccattgctaatgccagcctcagactctggggcactgtccccattgctaatgccagccttagattctggaacattgtccccattgctgtccacttcagagtatggggtaatgtccccagggatgatgacaattcctgattttggaacgatgtccgcaacgctaatggtagcaccagattctgcagagatatcaccattggcaatgccagctccatcctctggagtggtgtgtacacctataatgagcacttcatcctctgaggcaatgtccacaccattaatgctagccccagattctggagagttatccccaattctaatgcaagatatgaatcctggagtgatgtctacacagccagtgccagctcccagctctgaggcaatgtccccattgcaaattacagatgaagacaccgaagcaatgtccaaagtgctaatgactgctctagcctctggagagatatcttcgctgctaatgtcaggcacggactctgaagcaatatcctcactgataatgtcagctgtagcttctggaggtacatcaccccagcca

SEQ ID NO: 2784 - DNA, 1650 bp, artificial
  synthetic oligo
cccaggagctaaagtaggctgggggtacaagaagatgaaatgaatgaagaatggaaccttaaggcttaaagccaagtaagattaattgtattttataggcaattgttaggggtgaaggagggggaacccattaaaaaactctttcacaggcaattgaaaaggaaggtctttatattcagtgacagaaatagtgaggaaccttgggaagatagttatggggtcccctgaccatatcccataaaacactgtttaaagttatgggccacagacaggcatgttgcaaatttcactttgggaagtattattgccctcttggcaggaaggggccactggtaggggaaagggagagtaaacaggagctgaagtaagaggaccttttttagccttttgaaagacaatgttattctatctaagaagagcctatgttggtgcattgctatcaaaattcacacaaataaaaatttgcatcagtttgttttcatgcacatggataggattctcagttcaaatatttctcattcccacaatggctcatatgtccttttctgccataatcactcacattccacaaaggccattataggttgctctgtcctttttgaagtttggcaaagttttgccaaaggaacacatagaggacagtttggctggttggtgtcccactgatcctaaaaagaagcagttggactgggatagaattagagagggaaggttgttgacccaggataagctgcaagtacgagaagttctctgactcatgatggtgaacacaaaatgaaaagccattctttagcaccaacgtctcagacctgggacatataataatggtaggaaaatgatcatgatgaaaaaacaaaatcctcaagaattttgatcacaggccctattgtagaccagtcagtcccccagaacctaatcttgttgaagtcttttgttttacagacagagaaactgaggccaaggaggagaggcagtttactcatggtgataatgaagattgagtttttggagatggtaggagtgtaggagtagggggaagatgaatagaaggaggaagagaaggagaagaaggagaaagtggaagaaagaatgtccaatcaaactcagtggtctataaccatttgactaaaagctggtgcaaagagaagttctttcagatacaaaagttcattcagctacaatgttcacaaccacatataccacatactccactttggctatacactaaaatcacccggtgagctgtaaaaaatactcatacctgggtcccgctctgaggtatccttatgtaagtggtttgggggaaggcctgggcattaggattttatatactccccaagagactctggtttgaagccaaggttgggaatcactgacataaaggattttctgtttgggggctggagtgggtggtggtggtgtgtgattttgatttaagggtaatggttcttttagagttcctcccctaaacaaatgaaagagacttatgaggggccattctgaccttgtaactcagagcaaaggagaaaaaggttattaacgccctgaagttgtaagtgaaattggagcttatcttaaaaattagctgcaactagcctgcttgagagagcgggtcaaaaccagttagaaatgaccatatagctatgatct

SEQ ID NO: 2785 - DNA, 1400 bp, artificial
  synthetic oligo
aattttaccccaccctgggttccttgggggttcatccaagtgattgattgggaattaccagagttatgaagggttccatatggtcacagaatgggcactggcagagctggaattcttgatatttcttcttacaaagagtactgggtccctgctagggaagtgaaggtctgatgaagcctggtataaatttatgcaggaatggttgtggcggcaactgctaacaaaatcctcagatgtgcaagctgcagatgcccagaggatggtaggagtttggctttgtcactccagatgaggccagggatcaaagagcaagaagaagctgagagttagggttcctgggtgacattacatctggccagaacatgtgcataatgctgtatgtgaactctcttgtatactgcaatggttattagttttccaaatcagaggatgggatatactcatgggagggctggtttgagccatgtgaactggctggggcggggcccacagaactgtctgaagccccttcgtctaccaggagggtggaggtagttaccagatgttctaggtttcgctagtgcccaacacactgtgactcagcagagggtggggcctcgggctctgttggagtccagagcaggatctggcttggttacccttttactagcaggtagtgctgggcttcttgctagacaggcagactaaacacccacttagagccccaggaaattagggcctaaggaaaggtttaacttcaaagaccttatccagaattttgcaatcaggaattctagaaataaattactggaatttcagcaaaatcatttagtttagttttacttttcttttgaattacatgtgagtgggaatgccatagtcttttcagtgcttcaaggcctctgaaggtcctaattgggccttgacaataaatcctgaaaattctgaatagtgactatattactgttacgatacagttctgatattgtttggcagagtcccctcctgaccaccaactcatacaactgcgccatcttgtggtatatgctgtgcagtggagaatgaggtttttttgttttttgttttgttttgtttttgtttttgagatggagtttccctctagttgcgtaggctggagtgcaatggtgccatcttggctcactgcaacctccatctcccgggttcaagtgattctcctgcctcagccttctgagtagctgaaattacaggcatgtgccaccacgcctggctaattatgtatttcttttttagtagagatggggtttctccatgttggtcaggctggtctcgaactcccgacctcaggtgatccgcctcccttggcctcccaaagtgctggaattacaggtgtgagccactgcgccaggccaccagctacagagctggctgttctggcttcc

SEQ ID NO: 2786 - DNA, 1200 bp, artificial
  synthetic oligo
attttatttagtagccagctgtgttgaatccaatagttctcacataagtttagaggctggcaattgaccaattgttttgtgttgaatattgataattgtgtgttaatcccatcaaccatagactagcaaaagagtatacactacttggaaacaggacaagcttaagccttttcactttaacgggggaggagggtggtaatgaattttaccaagaggtcattattttgttattaaacaattcccctgatttgtagttgtcttcctcttatgtgggagtaaaattcataaattcatgctttatttagaaataatttttatgtgataaagttaattccatagttctggacttaaaaaagcacatttactaaatccctactgcctttttattatactagttccatttttattgtgtttttaaaatctctcctattaactgtccttattacttaatggctaagtagggctttagatccttctttcaggataagtttatgttaataagtagctatcacagtattccaagccttaaaacaggttatagtgtgttctacaaattcttcatctaaaacagtgctaagcagctaaaaatttgttgtgcttgaaaaaactacctcctagctacagaatgttttttaaaactcaatacactatttatgtttaggaaagtgctggccagctggaaataagagctctttctctaatttataagtaagttatatcctcttttctttgagagtgggtatgtgcatgcatgtgtgtataagatctcaacggtctcttcaggattggggaaatttgagatttgatgtattgatacctagaatgaagaaagctaagaaaaagtgttaaaatattttaaatggttgaaaagtcaaaagaagaatgtttcatgggatggaaaaattatataaaattcagatttcagtgtctgtaaagctttgttggaacacagttatgctcattcacttacgcattgtctgtggctgctttcatgctaccaaagcaaagttgaataaaccatatagtctgcaaaagctgaaatgcctattttctagccttttgccaaaaaaattgccaacctctgctttaaataaaggagagcaccatcccccaactcacagacatacatacaattgataattggttgtctttaccccttctcctcccaaattaagatacataaaaaaaaatccataggac

SEQ ID NO: 2787 - DNA, 1350 bp, artificial
  synthetic oligo
gcaaccattggcatgagatggaaaagtatctgtttctcagaatctggtaaaaacagaagcatcagagttaggatttgctggatgatctcagctttcaaggccaaggtgtatataatttagattggaagactgaaatggacaacatttacttggggataatgtcacagaacccactggcctttaaaaatgtcaatattgatacatacagatcaattatatatataaaacaatagccaggattagcctaagcagcagggataaaagtaatactaatggctactggaggttgagcactttccatatgccaggcacaagcacaatgctggagtattttatttagtcctcactatagctctatgctataggcataataattactcccattttatatctgaggaactcagtcatagagaagctaagtgtcttggcccaggtcacatagctaggacgtagagagcccagagcttgaccccaggcagtttggtaccaaagcctcccgtactgttaaccactatacagctccacccctaaccagcaaaaggccaacaatttgatttattatatcaataaacaaatgttaaaatcacatcacaacactgaatatacagacatatcttaagtacatattgcaggttttgttggatgttaattaacctaatgttctaccttaaaccagacaaacattacataacattgtttaacgtttggcagcccacaaaactattcttgagttttcatcacatagaggccctgaagttttcaaaagataggagctaaatctatgagaaaaaaaattcatgactaattccataggttatgaaagtttgtaatttgtgagttttagtttgataaaacctggaaaggcatttttgtcacagtttaatgaagcattccatatattttcttcataaaatatgggttctaatgagtgatgggaaccactgattccaaaagtaaggtccaccctgggatggatattagaaacaaacaaacaaacaaaaaaccaaaaaaggtaaaaggctccaaggtaggaagggaatacagagtggccggcctttggagagacagccctccctgaaggcattttgcatgcagttgagatctgacgttttccaggaaattgtgaaaatgatgtgatgaatcaaaaaatgagtcaatcagcagatgtgggttattattgagatgggaaaaatgtaagaagcaaaggtctaatcaacgcgtccctagcattgcacagaggaaggaagccgtactctaccagggtgtccagttagctttgtaggtggccctactgtggagcttgatacaaatagctttctaggacagccataatagttcttggttcacttt

SEQ ID NO: 2788 - DNA, 1100 bp, artificial
  synthetic oligo
cgatgatgatgataatgatgatcatggctatgttaattaatgttagcagttaccatttattgagcatctactaggcgccagacacatgtgcccactccttacatacaatattttatttaatctttataataatcattgtagaatcagtattattattatcttcattttgcacatgaaataactgaggctcaaaaaatgtttaaatacttaagctcaaggtgatggtgctggaattgagcctaggactgaatgactccaaaccctctgctcataatctccataaaagaccatctccattattccactaccttctcttcatctctagtctactgatggtcttttgtcttgaatgtggcattgcctcctcagcaatgttacaaagaatagcaatttacaagccttattcatgggcaccaaacactgcctccatccccaggcagacactgggctctctgccaaagtaatgggtctgatagaaatcttattataatccttctgcatttggacagcaaatgatgaaaaaggaaagtctggaaactttgaagctgactttggagttgccctctacaatttccctgaggaggtcttacttagaatgagtcaccaactttcctgactgcattttactgatccttggagagaaaatgttccctagttctggcattaggcttttacggccttccactttcagtgactccaaagcattgggaagataccttgtgtccttggaatagaaaacaaacaaacaaacaaacactcaccctcaaaaaaaactaaatcctctttaggatgggatgctcaactatcccccccgcctcccattttcctatactcattacttttaagtaatgtcggagttgggaaagcatttaaggatctagtttaaccttctcagcttacaaatgggaaaagtggggccaatagagaaaaaaggacttacccatggtcacacagccacctgttagagccaggactagagcccaggtatcctgggctccagaccaattgtcctttcctgattccttttaccatctatttatgttttatttttatagctagtgtgtaaactctgaaagagtcaatcataattttgaaagaca

SEQ ID NO: 2789 - DNA, 1250 bp, artificial
  synthetic oligo
atgcagactatgtcaccccctccttgattcactgaattcgaatttatgggaattcatattgttaaaaatcctcaatttattctaatgggaactaatgattgaggaatactgttttagtggaaaagtcacaattttggaatcagatcagagacagagtcctgaggtctgccccttacaggctatatgcacataaaaagatcacttaaaacctctgagttttggtttcatttataaaatggaaatgattaagcataaaattcaagtgaaacatctgcactatacctaacaccagagtaggtatcaattctctccctttctaccagaaaagaccctattctctcataagtaatggaaaagacttgaaaccacctaagatttagaacatctctcctttcccctttctctccccacaaccactccatgggtgatttttcctcacccctaggcttcattctattttcagttccccaccacaaaatgaaaccacttggccaagtgttctttgcaagaatggatttatagtttaagtatttcaggttcttctggaaattgtcatgccttggcacatagtaggaactcataaatatttaccaaatggatgcattcttttatttccagcctgagaggcctcaatatttgcatttcagtttaacttcattaccccatttccgtcgcataaccccttagatttaggcaaatccaggagatcaacctaccacattagcaaaccggatccatttttacttgtatagacaggtcataacaaaatcactctctccactcccagaaacaggcacttcatctcctcaggttaccaactcccctggggaaaccaactagcacttaacccttaggtcctcaaatcttgtcaatatgaaataggaatccagccctgattcatcttagcctctgtgcaaacaacggactatgaagaaataaaaaagcaccaggctgccctcgggtagaaaacggcttctctgagctttgagatgaaaggacaggaaacctgagaaaggaaggggagaagggggggctgagcaaggggagagcaaagcagtttcttatccagctgtttgaattgcatttggcccaagttgcatatttaccttctgaccacgaaggctgactgacttgttccctctcttcaggctcagatctcagaaacaacttctccttacagcttgttagacaaggatgggaatactagctgccctttgcagtgatgcctgaaaaccttgctttacctttgg

SEQ ID NO: 2790 - DNA, 1700 bp, artificial
  synthetic oligo
cgcctgcctcggcctcccaaagtgctgggattgcaggcatgagccaccgcgcccggccaaagctatttttttctaacatctgtagtcaagtcatcaggcaaagtcattgctcttctagagtattcctctgccttagatgaaaacccctacaagccatcctaactgtatctcagtagctttcccaggtagccctcaaattttttttaattttaatttttttttttttgtaaactcaactctctgtttccttggaacacagactctggaatcagaactgttttaatttaaaagccttttaaacttccaggcctctgaaagccttgtttttcctgactccaccgtccttatctttccattattcatctgcattccactcactcttaactcccaagagggtcacctatcctaaaaatgttgttatttgccaatcatttcccaccttggtgtaaaagtagcattggatttggaggatacttgactgtagtgttgcaatctacaagctgtgcacacttgggcaagcatcttaacccttctgagtctcaatttccttgtctgttaaaaatgagagaataactgctgtcatgtcttggtacctcactggcttgcaagctttagatcaaacaatggttgtgaaaacaacttagaaactgaaatagatggttattttcaggacacctgtggttagcatggttaccacccacactaacgcttcctccccccattaggcaccaagcattgattccttcttaaacactctagccctgggctatcggtgggtggggaaagcattgttcttcctatcttcttgacatgttgatcttggcttaagacttgttgcccttaggtcttttcaatcagtatctagggggagccactcccttggcttctcaaaagcttcttgtcaggtgctctttagatactatgtagcttctaccttcaggccagctttgtcctgtctagtgaaaagtggttattgtgggggaaggggaaaagggaacatttccaacctcttcctcccttgcaccagaactcccagggtccccagactccaatttttcaggcatagtttctttacatccatcagagtctaccctataagatattttagactgatcccaggcaggtaagttacattttgcagagatttcacttattcccaaagtggtgtcagctggttggtaattacaaaacccaggacttcccccgcctttgtggtcaaaaaacactctcagcgtttgcctctctccttgaccccagcttccagactgctttcgagtctgcactgaaatctcctgagggagttccccagctttaatttggccagatgctcagtgtcctgctcaaattgcactcagcatttttttttttcactttgaatagcttttgcacagactgttagattcactcaaacctgcccccgtcttgagctagttcttcctgctggaagtagttgtcttattgcaggctgaggaaccctgattagtttattgccaggtttagtcttttcctcattcagaatcctctttatatttatcatagagggcttccaccactggctttgcatagttgatctttttgcagtaggtgctcggtaagtattcctcaagttgaaatggaattggaatttaacacaaaaaatcaccatcttctggagcaagactggggaaattactgtccaccagtggctggtttttgcgaaa

SEQ ID NO: 2791 - DNA, 1100 bp, artificial
  synthetic oligo
agtcacacaactgatagttgacctctgaccttttcatgattgaagctgccactgaaattctccttcgaaatcacggatctgatcatatcacttgcctgcacaaaaaccatgattgactttccattgcctattaaagaaggaataaaatcctgatgtctttgcttagtgttcaaggtacacagcaatggggtagcgatctttacagccttttcattgcgactccttattctgtgatacatgcaatgctccagttatactatacttgtcactctgtgatttagctcctttacctgaaataccctttccctcatctccatctaccaaaatcccacttgtcatttaaggctcagttcaatttttactccctccatgaggccttcccagatattaaatacaccttcatctgcactcccatagcagtttgcctatatcttttgtggcacgtaccatattgttccttttattagagatcatttagatatttctttttcctaccagattctgaatctttgaaggcatgagaggatggcagttgcatatggtggctctgggatcaaaaagatcaggctcaaaccttgatcccatcactagctgtgtgactttgggcttaacctctctgaatttcagtttcctgatttacaaaaggcagtatagtagcgttgtaaagtttaaattacctaattcatgtaaagactttagcacagtgcttggcacagagtaactgttcaatacgtattcactattattattaaagataagtggtacagcttgttcatctttctgtcttcagcagttcctcgagcttcatctcttcctgcacccctcttctccttccagggcttagcccagaaccttgcacagactaagtaattgctaaattcttctggagcaaatgctgaaaacatcagacagtttttatataaaacatttaattcagtctgagtaggaacagttcatgtttgtatgagacaccaacaaacgaatgcttatgggatgtccctgcaagatatatcaatggaacatcctgtctgagcaccaaagagcagcccctttcagtattgtctgaacaagctggccttacgaggagtggtgaaagagaa

SEQ ID NO: 2792 - DNA, 1200 bp, artificial
  synthetic oligo
agcatgatgactataataataacaatgtatgtttcaaaattgctgagagagtaaattttgaatgttctcaccacaaaagatcagtatgtaaagtgaagaatatattaatttgcttgatttaaagatttaccatatttgtaattagtattaatatgttggaagtttgagttttgttttgtttctgctgttaggtgagcaaggaagcctagctcttgaaatttgtatttttgttcaactttgtaagaagcatatttattatttaaataaatatttattgatcagatagtaaatgcatcagaaatatttgatttaaaggtgccctatgatgaaagctttggaaagaaaaaatgaacttttgaagctctcattttggtttgtcgggttttctttaaaaacataccaccaatactcaaatatgtctacatgtaacttcagagttttctgaaaaattttccgtgtgtgtggtttaataaagttattttatgtagacatttgaactttttctgcaaaaaattaccttaatatgtaaaaaggataaatccaatttaccccatttagtatctatagaatattttgaagaaatatttttctatttttctttttttatttcttttttttttttttagctcctgctatcactggagaaaaaaatatttttctagttaactagatgtagcaaagtattattggacatttctgggtatgtacgtgtatgtctgattatatccgtgttttatataatatatttcaaatttaagggaaattagaggatataatatttagatcattaatcatggtacaaattatgtctccactctcaaactaatggtcttaagacaaaattccctaaaattataggaactctaaaatcccttgcttaagatatttctgctagttagtgggagagctaagagtagaacttaattttcttgacatctagttccccatttctccctcccatccccaaacttgaacatgaatagttgttttctttaggcacataaacactgaaatagtctactgttactatctctactttgacattagagacttatttacagagaatttttgagttgtctaaggatactgaagattaataacacctcacttatctgttggccacctctgtggtaatgacagttctcaagatacagctgaaaacaagaaataagcatttaaaaagcctctgaacagttcaat

SEQ ID NO: 2793 - DNA, 1050 bp, artificial
  synthetic oligo
acctgtttatatgaagctagtaaggcagtagattataacctttcttgggccacacactcctttgagattctgggaagctgtgaaccctctccccaaaaagatgtacatatagcaccttccatataattttagtagtttcacagattctgtgtagcccatccaagaattgactaaacccccagattaggaactactttaggaagtggatagagtggtaccccaaaaggtattggctgccaaataaatgtagcaggatgcagagttatatacatgttgttggcatcattgtggaggcatctgattcagggcacagccctgacatcggactatgcaaattgattgggacaccattgttatcgtaagagagaggaatttttccattcacgaagcctcaagtgtactgttcttctataggctgaggcatagggagctgccaaggtggaagtcaaaaccttgaggggcaggcctgagagcccagttgatcccagggcttgtatctatgtgaatgaagccgccccacccctggcacccagttgggattttctccagcagcagctgcaaaggctggaagccccttggagaagcagcagagaaataaatgagaaggggatttgatccagggctggggagtggcggcggatggcggatgtggttcaaaatgacaaggggtggtgggggaagaggtcccagttgaactgaaaatgaaagcaagacaggaacgcactgtcacattgagaggatagcattttagctggagaatgtacaggagaaggtgtagacatagttttgtctgtgtcagacaccttgatagcaaacactataggtagaggcttctggaggcaggattgctcttagtctaaggtcttatggtaacatttgcaggggatacgggttagcattacaaaatggggatgcttcaggaagggcgtgggcgagtgcttcttgctattacttcttgtaaccaaagctagtctaggcttttgggtatgttcaacactgcatggcctttggagcacttttatgggaagaggtaagaaaatgttcctgtgg

SEQ ID NO: 2794 - DNA, 3150 bp, artificial
  synthetic oligo
tcgtgagccgcccgcctcggcctcccaaagtgctgggatttcaggcgtgagccaccattcccggccagaagactgcatttctaacaagctcccccaaatgactctgatgtcttgcccccatacttgaatgggtattggttgagagccttgttctccagctctcctctctgttaaatggacatactgctacttctttcacagtaaaagaggagatgtgtgtgaaagcctgtttccgcaatgcacgtgctaatgctcttcccgccccttcccctcttccccgtcttttccctataccaaggtgaagaacttttattattcacttgattttggacccacttcgtgtttaatgcacctggcctaagatgcagagttgagcccagggagaagggacgggttgggggaggaagaaagagtcgcaaattcccaggcagattggctccatcggtctaatcaagctgcacttgacgctccgcgggcctgctgcgcccccgccccctcaggcgaaaactcgcctctgcccaaggctgtgcggggcgtccgcccccgcacttcgctgattggccgcactagcccgctcgtcacgctcttttgtctcagctggcagaggataaaagccgccgcggctgccttaggaacggcgctgcctcgtctctgctacccctggttgggcggccctgcgaagcagctccttcgggcagccccgggtcgcttagcggccaaggaggcttcagttctttgccgcctgcaaggcggagaccagaaggcggaatccacagctggcgacgcgggagcatctgctgtccaccagcggagcacaggtaaagaatgggggtgtgattgcccggcggggagaggggtgggggaagacccaccagtactgggcggctcccagcttggagaatcggtgactgtgaggcaggggtaggagtactctcgtggcccggctgcgctgagggaggaggtggggttcacctggatactgcgggctaggtaggatttgcctggatttgggggtgggaggagaggcgaggagtagcggggggaggaatctcgagctgtttgcttcgaacatcctttgcatctcctcatctctttctgggaggaatatgtgggtgggtgtgtccaactcctattccctttctccgtggcaggccatcaaagccgcatctgaacttgaattctgtgcagctgattgcagagctggtaggccgacggcttcccgggggaaatgtaatgctggagggtggggggctggtctctggcttatagtcaggagggggcagagagaatttttcgcctggcaacagcggaggtggtgggtagcaggatgacgggtgaagctgcttctaacccttcccttctctggccttctccgctgtggcgcaatcttgaaacctcaaggacccggatctgcgaccccctgtggacagaggttgaccgtaccccggagaggagctttctcacggagggcactggttgcagaggctggaagtgaaataaagacgcgctcttgtttcagagttcgtgtaagaatctgagaaataacaagggggacgggcgtggggggcactttgagaagggggtgtggttgagaccagagaccatgaggttaatgagatcttattttatttccacaaatctgcgatcattgtactctatttggagagcccaatatcagctccagacactgctacacctagaatttgaagcaacagttaccgtccctcttggaggactggtgggagggatggatgtggctgcaaaaagcaccttgctagcacgcaggcatcgggtagctctgggaggttgtaagtgtcaatctcctacaggattatttttagggtagtgggcaaatataaaatgtactgcaggatattcaggtaggaagagaatgcagctgcagcccgctcccttattaaccagcccccctttcttttttacagcccctgctgagataggaaggcagagccacctcctctcctctcccacctgcagattaagcttttctaaaaagcctaggcatcttcttatattcagataccctatcgtcgtcagtcatggctagcatcattgcacgtgtcggtaacagccggcggctgaatgcacccttgccgccttgggcccattccatgctgaggtccctggggagaagtctcggtcctataatggccagcatggcagacagaaacatgaagttgttctcggggagggtggtgccagcccaaggggaagaaacctttgaaaactggctgacccaagtcaatggcgtcctgccagattggaatatgtctgaggaggaaaagctcaagcgcttgatgaaaacccttaggggccctgcccgcgaggtcatgcgtgtgcttcaggcgaccaaccctaacctaagtgtggcagatttcttgcgagccatgaaattggtgtttggggagtctgaaagcagtgtgactgcccatggtaaattttttaacaccctacaagctcaaggggagaaagcctccctttatgtgatccgtttagaggtgcagctccagaacgctattcaggcaggcattatagctgagaaagatgcaaaccggactcgcttgcagcagctccttttaggcggtgagctgagtagggacctccgactcagacttaaggattttctcaggatgtatgcaaatgagcaggagcggcttcccaactttctggagttaatcagaatggtaagggaggaagaggattgggatgatgcttttattaaacggaagcgtccaaaaaggtctgagtcaatggtggagagggcagtcagccctgtggcatttcagggctccccaccgatagtgatcggcagtgctgactgcaatgtgatagagatagatgataccctcgacgactccgatgaggatgtgatcctggtggagtctcaggaccctccacttccatcctggggtgcccctcccctcagagacagggccagacctcaggatgaagtgctggtcattgattccccccacaattccagggctcagtttccttccaccagtggtggttctggctataagaataacggtcctggggagatgcgtagagccaggaagcgaaaacacacaatccgctgttcgtattgtggtgaggaaggccactcaaaagaaacctgtgacaacgagagtg

SEQ ID NO: 2795 - DNA, 1000 bp, artificial
  synthetic oligo
aatataaacagaaccaaataccatatttttatctttgtaccactgatgcttagcactgggcttggcagagagtactgggtatctacttaatcaatttttgtgtgaataaaccagatttctaaatcaacttcagttcttctttaatagtttcataggtatatagcccttttatgagatcactcattcattcctgtgtaccactctgtgtagtagttaagaatgaaggttctggagcctgatcacccagtttgtattgttgttttgccagttattggctggatgagattaggcatgatatttaacatctcagtgcctcagctctctcacctggaaaatgaggagaaatataggacgttaaacatagagtttctgaacactcaaaagttaactataagtattattaatcttatcagcaattaagcgacttaatgaacacctacaatgttccaggaattgtgctaacagtggggatgcagagatgaataaggcttggtccctgctctcagaaatcctataagctagtgaaggaaacaagtgtgatcaaatcagtatgtatggagcctagcagaagatgggatcaatttaacaggagggaacagtaacaggaaaaggcagggtagtaagactttatagaggagggaattcctgagctttgcatctgtgggttgacagtcctgggatattaatgtcaagtacatattgaaatcccttttgtggtttatcagagatgagttttataacagatttctcccatcagattttcttttttgtttgtttgtttttgtttcactgaaagcatttacctggaagattttcttaataaggccacttaacaagaggcctccagacggtgatgatctctgtcctcacttggcagcatggtgactgcactgccatgcagctcctccgtctcaccttgccttttgagagatctggctggttttaggagcactgttactggattcaacattgcatctagacttgagaattctttgttcac

SEQ ID NO: 2796 - DNA, 1400 bp, artificial
  synthetic oligo
gcgctggcgccggcgcccccggacgagggtagcactgcaagcggcaccgtggcggcggaagagacgggggccgccgcggctgcggcggccaccgaggtgtgggacggctttaagtgccggaaatgtcatgggtttctatcagaccccgtgtccttgtcgtgtggccacaccttttgtaaactgtgcctggaacgtgggcgggccgccgaccggcgctgtgcgctgtgcggggtcaagctctccgccttgatggtggccactgggcgggcgcgtggagcccggcgggctgggcagcagccgccgccgccgctgcgagtcaacgtggtgctcagcggcctcctcggcaagttgtttccaggcccagcgcgagcgtcgcaactccggcacgagggcaaccgactgtaccgcgagcgccaggtggaggcggcactgctcaagtacaacgaggcagttaagttgggtgagtccaacgcgctgccgggccggggctggggctcggtggctacatgagggagcgggagaacaaaccccgcagcgagaagggatttggaccagggcagaagagggggcgggggacccatggactgtggcggggtgggggaggggtgattctggggctgggtctctgagtttgttctgttttcactgcttatctgtgtttcactgtgtttgtgttgatctcggttgctttttgtcttttcctgctacttctgttagcttttgtgttcctgtctctcagtccccgttcctgtctgtgtctccttgcttctggttctttttctccgtctcttcgtatctttgtcactgtttctttctttttcggtgtcactgtctctgttcctctgactctccttctcccgctgcactcctggtctcctcttacacctgctcgcaccttcccagcgaggagaggaacttcgcgcgctcctcgcacttgcgcccggtcctctgggctgtagccagcaggagatgtccggtcggcgcctgcgtccgccgctcgcgccgccgggtgttgccccttccggggccgcggctccctgtggggtgggtccggcatggaattaggtcaggagagcactggttgcataagggccgcgagcggcccgggtcgggcgcccctcccccgcgcgagcgggcgggattgtgtaaccgctgaggtaactgaagtgggccaccacgctcgcttcggaaaccatcccacgagcatgtgcggggggagggggagcgcttgcgccccgctgccctgtgactcattgtcaccgcttcctatcacacgatcctcggctgaaatagatgcccccccttgcccgccccgccaacccgtagcctgtgccctcgcctccaacccctttaacctggccagcccggcgggaggccggcgcggcaactgcttggggatc

SEQ ID NO: 2797 - DNA, 1900 bp, artificial
  synthetic oligo
gcttttgcaaggggcgtgttaggtttcttgcaacttgcacctgagcatccagagtgctctgcaaatcccagccccaaacttctgcttccacagatctcctggagagcgtggcgcactcaactttctggacattgctgcaaaaacctagcatgcagcctctgacttcatcatttcatcttaattacggtccgattcgcggactttgggtgggaacagaccagagctagagagactcatccattagttactaactacccagaggggagagcagtgctggcagtccaaattgcaaggtgcgctgccttcagcgtgcggcgtcttcgccctggagaagcattacgctggcccgcctgcctccagggccacacggaaacgtgttctgcaaactttctccaagggctcgggggctagattgtgtctcgctccgctgcctctccccctgcctcaatttcgactcctgccagacagctcagcccctccctctggcagtcaccccgcccggagtgggagtggtcaacgaagctgcaaaatggatcgcaagtccccacacacgtccgacccctccccgcgccctgaccacgaacgcatccctgacttaaccgccacactcgggccgtgagcgcctgccagcagggccttccgccacacacacacacacacacaccgcaagcagcggcgaccagggcaggagcccactccccgccacctgcaggcgtcggacccgaagtccacgagccggaactcagagcaggagccgaaggaccccagcgcagaatccgtggaggcgcacggcttcatccaccgcgctcccagatggggtcccagcccagatccggccacgaagacacaggcaaccccggcctgggtttcctgttccatgagctccaggaaggcgacagtcagtgcttgtctggggacccggaccggtgctttggggaactcccccggagggagagagtttggggaactctcccgagaagggaactttcccggagaggggggcgtggaccggacgctgctgcgcctcctctctcaggccgcggttctatgctgccctgtgcccgcgccaaacgccctgatctctctctgtctcctctctcaatctctctttgcctttcctcctttccagatgcgaaggctgtagggactttggtgactgaagctggaggagacgaggagaagaaaatacggtccaaacccgagcagggagctggagcagaagaagaaagtcacttctgtgcgggagctgccgaccccacgatcaaggataaccagaagcgcggcggtggcgaccaggagccctcgcagcagcagcctgaggcttccagcccaggactcctccgcggaggagccacaaccccaatattagcggcgtctcttcagccccagtgcgttcagcaggttgcacctgaaggagctagacagcattttcccacgctctgaatatctcgacgtgttcgctcggtaagcggcttgctctggagcttcccagttcccaggactctggggctcttccctggacgcctttggctctacccatgtctctttaccaggctccagtgccaagagctatttagggggctcaaggccactggctcagggccgctcttgagctgtgggatgcgggcgatagcaactgggcatcaaggtatttttcaagcagtatagatacgaatcaagttaaatatttgcattaaaattattaatcttcgggctggtgctgtggctcatgcctgtaatccgagcgctctgggagggcaagtcaggaggatcacttgagtccaggcgttcagggccaggctgaccaatatactgagacttcatctctacaaaaaattttgtaaaattagctgggcatattagcagcacgcacccgtaatccaaggtgctctggaggatc

SEQ ID NO: 2798 - DNA, 5650 bp, artificial
  synthetic oligo
atctcatgattcttctgaagcagcaggacctttgggccagaatgactcctattcccctgtgtcccccacaaaaagggagggcggtggacagaatttggagcatgtcgaatcaatgcttagctgttgccttcccataaatactgagtagccgcttaggaagcttcccctagagtccggagttgggcatggatgtccctattaacattgatgggtccctattctgtctgaaaaaaagggccaaactagttctaaattcactaaaagtcacccgcaccagctctgcagctcctttccatcactgccctcacacaaactgcagagcgaggctcataacctcatcctggattttgttttcgttttggaaaattctctcttaataaaacttaagtaatcttagaaatcttttgatcccatgacctacaaattaatcatcactgcctgggaaaatgaaaacgtatttcaaataagcacaggtaagaatctggtttaaattgagcgtgctccccatcaccaaacaaatttcataaaacccacctctttagacagtcccatcaaaataattccttagttgttagaaattcctcaagagaatattcactcataaagttcaatttgtgccatttcttcaaggtatatatgtaagtgtatgccattcttctttaaccttttcacccttcttaggtgactggaaccttattcaaaattgttcttgtttgttccaatttttaggcaaatttccagtttgcaaacctgtctccccccgccccccactgtaatgtgcgtatattagcagtgttttcaggctgacacatcgaagtattccagaaaattacaatttcaggtagccactttctacatgtcttcatcagacacttcgaaaaaatagcaggaccaccaggcacttggacttttaagctatctcctccccatcagtctcagtgaaactaaacgtacttaattactcatatagtgtgttgtctgtgtgtgtgacttagtcccttaacccaatgcccgaatatttataaactcactcactgagctaagaacctaacttggtttaaatattttaaatacagttgaagcttctcacatcgtagctctttggtgcattaatttgcatacttctaagtcagactcagtcccaagatacctccacacagaagtagtctctaaaggatactattgttagaaggaaccgaactttgtttattcttaattttgtacaggaaatagaagtagcagtttggtatgtatagttttatttttccattagaaagcatattccctctggtaatgtgtaatttccataagctggggtttccttatcccatttttcaccctctaaagttcagaactcactttgcaaacatagaaaaggcaacaaaaataggccaacttgagaatgtgtaggacaaaggtatcaaaggactgaagcaggtttcagagtggctactctgaccagttgctttcatcaggcttactggcttccacttcgacttcacttacatccatgcatattgtaagctcctttctggggcagaaaaccacaaacgttcagtatttaaactttttcagaattgtggatgaaatgaaatacactgatgaacgtttcataccggtttgaaaatgtctatcctctcaaccgctccagcatatttttctgtgatacctagccccaggcttgcattagggatggctgtccttggtgtgcagaatttaaaagagcactaaaacactcaggattcaagatatctctttctatttaactgtccatctatctatttaattttagagatagggtctagctctgttgaccaggctggaggaggggtgacacaatcatggttcactgaacccacgaacacctgggctcaagcgatcctacggagtagctgagactacaggtgtgtgccaccatgccggtctaattttttaaatttttaattaattaattaattaattttttgagacggagtcttgctctgtcgcccaggctggagtgcagtggcgctatctcagctcactgtaagctccgcctcccaggttcacgccattctcctgcctcagcctcccgagcggctgggactacaggcgcccgccaccacgcccggctaattttttaaaatatttttagtagagacggggtttcaccgtgttagccaggatggtctcgatctcctgaccttgtgatccgcccgcctcggcctcccaaagtgctgggattacaggcttgagccaccgcgcccgccctaattttttaaatttttacgtagcgacagagtatcattatattgctcaggctggtcttgaacgcctggactcaaatgatcctcccgccttggcctcccagagtgctaggattacaggcatgagccaccgaaccagcccgaagattaacaaatgttaaggcattattttaaaaatcaagaccaatgaaaaaaatccacagtaaccaaattgttaaaatgttcaataaaggcaagatccaaccgtgtaggactcactctcctcaccctgatgtccatcgcaattccaacaaaacatttccaaaacaggagtctggccaaagtttcctggcttgattcgtttctataatgcgtgaaaaaataccttaatgcccagtaggcatcgcccccaccccacagctcaagagtgacctactccagtggccttgagccccatatgtagcttttgactctggaggggagggagcgagactggggcagggccaaaggcgtcccgggaagagccctagcgtcctggataattgcgcacctctagagcaagccgcttacctagcaaacacgtcgggatactgagagcatcggaaaatgctgtctagctccttcaggtgcaacccactgaatgcactgggggagaagagatgctgctgatcttctggctgcagctccgaggaagaagagtcctgggcggactcctcaggctgctgctgccagggctcctggtatccaccgccgcccttctggttctcgtcgaacatggggtccgcagctcccgcgcagacgtgactttcttctgcttctgctccctgctcgggttcggactcttcttcttatcctctcctcccacttcaatcaccgaaggccctatagccctatagccttcgcatctggaaaggaggagagggaaaggaagggagggagggagggagggagggagagagagagagagagagagagagagagagagagagagagagagagagagaggcgcacagggcagcctagactcgcggcctgagaaaggtggcacagcagcttcccgcccacgcgcctctctccgggaaagttcctttcctagagttgaacaaatcaccggtccgggtccccagccaggcactgaccgtcgccttcctggagctcatggaacacgaagcccaggcagaggtagccggtgtcttcgtggctagatctgggctgggacgcgatctgagagcgcggtggatgaagccctgcgcctccgcggattctgcgctggggtcctctagctcctggttcgagttccggcgcgtggacttcgggtccaacgcctgcacgtggcggggagccggctgctgccctggtcgcctccgctggcggggtatgtgtgtgtgtgtgtgtgtgtgtgtgtgtgtgtgtgtgtgtggcggacggaaggtcctgctggcacgcgctcacggcaggaaggtggcggtaaagtcaggggcgagctcctggtcagggcgcggggagggggtcgggcgtgcagggaacccgcgctccagtttgcggcttggttgaccactcccaacccgggtggggtgactgccaggaggaaggggccaagctgcctggcgccaacagattggggcaggggaaggggcggaggagctagacccaatagagaaagttaacagaacatgtctctgtccagccctccaggcacgcgggcttgcagaatgcttctccagggcgaaggcgctgcaagctgaaggcagtgcaccttgcggcgtgggttcctggcaccacgctgccctctgactagttggtgactaatgcatgagactctctggttgtgttccgttcgcactcaaagtcctcgaatcggaccgtaattaagatgaaatgatgaggtcggaggctgcatgctaggtttttgcagcaacgtccagaaaattgagcacgcaacgctctccaagggggtctggggaaccctgagtttgggcctgggtttggcagaccgctccggatgctcaaatgcaagctgcaagaaacctaacacgccccttgctaactaattactccacctcagagtacaagcgtagaaccctgttcggtgtttagtgcatctaagaagggttacactgcaagtgaatcttcctttggctctagacgcgactgcggagcatgaaatgtctgctaagctatattctgctccagagcctcaggttgcaggccctctgcagaagcgggagtgtttcgtgtgctgggcgggcgctgtggacttggcttagttcccgccttcccttgctcgtcatcaccttctcttacccaccctcctcgtcctcctcctgctttccctttcctactctttgtctagaattatctttcagacctcttgctccctactgataaatgtcaaataaaaaagaggcagggtagattgggagctctatgtttctcccttcaagaagtgtgcctcagaacgatgaaggctgtgggttacagtgatctatggtcgccccactgcaatcctgccactgcactccagcctgggagaaaaagagagaccctgtaccttaaaaaagaaaatggttcctcgggatgatgctgggcccggtggtgcgtgcctgtaatcctagctactccaggaggctgaggcgggaggatcgctttagcccaggagtttgagaccagcctgagtaacacagcaagacccccatctctcaaaaaataaaaaacaaaaatagcgggacgtggtggcacgcacctgaagtctaagctactcacctagctgaagcgggaaaatcgcttgaacctaagcgttggagactgtagtgagctatttttaccagcggaggctgttcagtttgttggcgttttgaacaaagaattggacaaaactcgcaaggaaacaatgaagcaacaaaagcagagatttatggaaaacgaaagttcactccacagggtgggagcaggcctgagcagccactcaagggccccgatacagaatcttctcgggtccaaataccccctagaagtttcccattggctactaggtgttcaccttaggtaaatgaagtgatgactggcaatcagtctaaatggttgtggaaagcaaccaatcagaggctgaagtgaagtcacaaagttccattcctctgcaaaggtctgattggttccaaaaagcaaccaatcagaggtacttttaatttcccgtctgcccagcagataaggtgggggtttgcaaagggagtagccacaggtgcttttgttacttaggcgtgggaagttagggctttcctttcaatttagttctaggatgtcagcctgaaacggcattaggttcactgcttccagaccctattctcctgcctcactatgatcacaccactgcactccatcctgaactacagactgagaccctagctgtaaaacataaaacaaaataa

SEQ ID NO: 2799 - DNA, 1100 bp, artificial
  synthetic oligo
ccaccctgggcggggtgagtgccagcaggaaaaggctgagcggtctggtgggaacctatttggggcagggggaggggcggaggagcgagacccaatctagctccggagcccttggagaaagtttgcgcaacacgtctctgtccagccatccaggcaggcaggcaggccagaataatgcttccccaggagagagccgaggcaagctgaagtcagtgcacctagcggtgtgggctcccggcaccactctccccactgggtagctggtgactaatggatgagcctctccagttctgttctgttcccacccaaagtccgctaataggaccgtaattaagatgaaatgaagaggtcgaagactgcatgctaggtttctgcagcaacatccagaaagttgagggcgccacactctccaaggggtctgcggaagcgggagtttggggctgcgattttcagggcactatggatgctcagatgcaagctgcaagaaacctaacacgccccttgcaaaagctgcaggtactccacgtcagtgtacaggtatagaaccctgcctggtgtttagtgcatctaagaaggcttacactgcaagtgtcccttccataggctctagatgagactgcggagcgtgcaatgtctgctaactatgcaccgctcccacgccttaggtttcaggctcgctgcagaagcgcgagtgctccatgtgctgggtgggcactgtggacttgggttagttcccaccttcccttgctcctcatccccttctgttacccaccctcctcgtcctcctcatgcttctcctttcctactctttgcctagaacgatcattctgaccttttgctccttaatgataaaatgtcaaataaaaaagagccagggcagattgggagctccacgtttctcccttcaagaaatgtgcctcaaaacgatgaatctgtgttcagtgagctatgatagcgccacttcactcaagccactgcactccagcctgggcgacagagtgagaacctgtacctcaaaaaaaaaaaaaaaattgtgcccccagacgattctgggcccggtggtgcggacctgtaatcctagttactcctgacgcttttgc

SEQ ID NO: 2800 - DNA, 1300 bp, artificial
  synthetic oligo
tgcaggcagaaattttctttacgcctaaagggaatatgacactggagtttggaaagtccaaggcaatggtatgaactccaactgtcccaagggctgaggaatggtggctgtgtgaaccgtgtgccagaaggtcaccagaaccgacctacacaatatatgggggatgcttttcaaggtaccaggtgtatgggccgaggataataccctggacttgctgcaaacagacccccagtggtagcagagcttaaccctcatgctgccccggtatgagtccgtcaatacccagtacccagggaggcaattgatggaataacaaaagcatctgaatcggctttatacacatgggattatagtaaaatgcaagtcctcatggaatactcctctgttacccatgcacaaatcaaatggggaatacaggccagtgcaggatctccgggtggtaaacaaggccactgtcgctatccatgcaacagtacccaacccatacacaatgttgggacagattcctgctgatgccacttggttcacatgtctggacttaaaggatgccttcttttgtttgaagcttgctccccaaagtcagagggggcaatcgcaatatacctggacaaggctgccgtaagggtttaagaatgctaccatttttgaggaggccttggctacagatcttgaggcttttgcgccacctagtgacaattatgtgctattacaacacattgatgatttcctatttgccgcccccacgagggaggaatgactccaaggaacagagaggcttcttcacgtgctgtgtgaagccggttataaagtgtccaaggacaaggcaaaagtctgttttcaggaggttggatatctaggattcatggtatcccaaggccagcgcaggcttaagtgcacgcaaggaggctgtatgtgcactgcccaccccagttacaaggccagggaatttctaggcgtggcaggattctgccgaatctgtattccaaacttctcccttacagcaaggcccttgtatgaggctataaaaggaaaggaaagagagcccctcctatggcaaaagaaacaggaaaaggccttcaaggatataaaggaagctctcatccaggccccggcactagggttgccaaatgtaaaaaagccctttttttgtatgtggatgaatgtcaaggaatggcagttggagtcttaactcagttcttgggctcttggcatcggccggtagcatacttatccaaaagactggacttggtggctttaggttggccccactgcctcagggcattggcagctaccgcaatcc

SEQ ID NO: 2801 - DNA, 2000 bp, artificial
  synthetic oligo
cttgttccccaacccacagagcagtgcgccaagtagcgactctttaagccctgggccaccaaccagcccactccccgaaggcagacgggcccggggcgctgtggcttgatttgcaggtggttaggtggttgtcgtccgcagcgggaatggacgctgcggaaccccagcactcttccactctgccctccctcgcgaagcgcaacagcttggcgtcggggagccagggctgcgttgttggcgccacagctggccaaggtaagcagtgcattcccacctctctgtctctctctctctcgctctcgctgtcgctctctctcgctctcgcgctctctctctctccctctccctctgtatgtgtgtgcgcgtggtgtgtgtgttggagaaagagtgcgcgcgcgcgagctgggagtaagggggagtctggtactgctgggctcgggattcggaccaagtccttggcctcatttgtaccccgttgtaaataactacgcccttaaaaatgaaaaagcaaattcttatactgaatatgcaaaaccattgaggatacggatctttccaccatccaggagataacactttctggggcccctccggtgaacgagttttgttgacactgagtcttctgcgggcagtagggagattatatagggggttcgatcttctccctgccccctccactcgagatgttcccgcaaattcatcggagaagacctgagcagactgatggcaggaactgcgggacagagggattttgcagaatgtaaagtatgttggaaagagagaattcgatttgattgaagtgtatccgaggcgaattttaaaagattaggtgggatcatgattttacaatcccctcccgctctccagggctccaaattaatttctccgcccagtgaaatcacagggcttgggaaggtgcctaacagctgagggggactgggtttgtttttttttgtaactaccaaaaagcagcttcgaggggcagccaagttggtgcccgaaggtagctgtcccccagtttctataaggaaaggagtcgaagggtgcccctccccctccattccgccctgcgaggaaaagcgcgacttcagaagatgcgcgggctcgcgctggatgtttctttctcgcgctctcactcctgcccctgactcccttttcacactcatgcacattccgtgcatttggagcagagtaacaatcaaattcaaagaatgttgatcccgccgctgcagagggcagggctgggctgtcttgagtgattcctcaggaattcccctcccctcatccccccctttcttctcacccccgcccatcccccagagttgcgcaacccgccccccccccccaatcagcgaggtgcaagtcaggcccccacccaactgcatctctaaatttcagggcagcttcaagagagttgggagggggcgaggaccctgcttctaattgtcgttagtcgtgagctcttagaagtgaccaggactttgcaaagagggagtgtcgaatggaaagcgaaggcgcaggttgcagggaagtgttttgatcctcagattgctgggatttaccaccgactgcaagtctgtagacacacgcacacaaacaggcacacacccgcactccggggcagagatactccgacgcaagcttggcgctccgatctccgcacgtcgctcccgctgcagccaggccgctcccctgggactctggtccaccacccagacgctggggcgcgaagaccaccccatccatgccccgtttcccgctctccggcttttggggcagctggggcgttcacagtccagaggccagggcactcaacccctgctgccgccgcccgaaggaagggccgctagacttacccatggaatcgggcagggacatgtcgctggaccgctgctgagtcagggactgatgcatggtgaaaactgcccggttgccccagtccccgaagctgcttcaagcgcccccggctctgggcgccccgcagagcatcctactccgcg

SEQ ID NO: 2802 - DNA, 1050 bp, artificial
  synthetic oligo
ggatggttggaagaaggaaacccacacttcttgactacattcactggatcttagcctcagcaacaggtagttgagggaaggatgaaaaacactcacatcctgcccctccagagaagataatcttccagcttggagctgggggaagatggagccctgtgtccttggctgtaccaatctggagtggaatttcttctcacagagctgggaaagaagggagaggatgagtcttggttcaagtaccaaactctcaatgttctcaccgagttttaatagactttcttgattagatgttccttcattcactgtatgtcttcatactcatttccagagacttttaatggtttggggatttttttcctaatttttcatttcatgggagaaccagtccacagatctcacattcttatgccagaaatggaactcccatacatatatttttcctgaaccatatcaaaacatgttgcagacattaggaaacttcatccctatgaacttctgcatgcatctcccaaattaaggacatcttcttatgtaaccacaatacattatcattcttgagtaaattaacacagttctatagtattatttaatgaatagtccatgttcaagtttctccaagaatcttttataattttttaggtgggtagggtgggaagccagcaaccaaacaagattcacacactgcattttgttgcttgtccttttatatttttttaacttaaaacagacctcctaacttttcttttcatgttattgaaattttagagtcccaactagttttcttttagaagtctacatgggatatgttgcttcttgaatgctgtcagtcttttatttcttgacttaggcagtggttatcctgtgacgttatctttataagttttcattaggctgtacggtaatattttatgcatcaaatctgtatataatcagtactaaaaataaatgaactatcaaaccatgaaaagacatggaggaattttaaatgtgtattactaagtgagagaagccaatttggatggctacgtactgtatgatttcagctgtata

SEQ ID NO: 2803 - DNA, 2200 bp, artificial
  synthetic oligo
aaataaaataaaataataaaataaaaaggatctacagtttgaactgtatcagaaaatccttgagggcaaagattatgtctttcactttgttcacattccccagcacattcaacaacagtagtttgatgggtctttggagctcttgaatgaatgatagaaagaagaagttggataaggattttttttttctgttatcagtcctttcatttttcaaataagaggatcagattaggtggtgtccaagttcctttgtagctctggcatcctaggttgatatgtacttgactataattgcaatgcttaactgtttactttgtactagggaaagtttgggagaaggtagttcttagtacagttcttagcatccgtgtgaacttggtttatccattctcaaaagtgctatgaatcatagaaaattgctggaaggtttcagacactttctgaattttcactatacaacatcattgtttggagtgacaagttttgccacctcaacaatgtggtaagccatggattcacttggcaattagtgagtttttgattatccatctctgtggaaaatggcccaaacccctctcttgaacacagattcttaagagttggaggtaatactgtgtctatgctcatggaaaccagttagaggaagggtagacaaatatgacttctgacaagtttggtttggttttgcctagccacatttacaccacttacaagcctagcaaaattgatcaggtttcaagtaagctaccgctctctgcctaattttggtacagaaaaagaacaacttgctcatctgaccacagacagcagctctggccaagtagcttctttctttctctctctctctcttctttcataataaccagttacttccggtttacaatccagattctgtctctcattatcgatatgatcttgggcaagtgcttttactgttttgagcctcagttttctcttctgtaaaactagtcatattgtttagtggtttaggaatagtggcatattaaaatgcctacagaagtatcaggtttataacatgcatttagtaaatggagatgccactgttattccctcctttttttcttttctcctttccttttttctcttcttgttccctgtctctgtcgtgagaagagaaattatctttaccaattttcatggaaaagacttaagtggctaatggaagtatcagcctctcagcctgcaactctttccccatgtaatttgtgatttcaggtttgaaactagggcactaattgtgggtgcttggtggcaagtaacagttggggaagaaattagtacaatgcccattgctgcttttcagttgttttagtgcagggcatctgaactaagagttgtgtctcatgtaggttgttcctgcaaagttatctctgaatcttctagatttacaaatcatttggtacccagctgttatgctgagtgattcatggttatgggtgccttgtttcaaatgcttgtcagcagtttcttccctgtggttgccttgtgattcagttgttttcagtatgtgtgcatctcttcacattcatttggactctgcctcccccaacttctgtcatggaacaaatgagtcagtgtctaatcgtgctggcttgccatccagttacttcaagtttcctatggtaggtgggcaccagagaagatggtgctgctggctcacagagggggctgactgtcctgctgccaaactgctctgagaagggggaaaagaatggccacatttctcagaatgaatatcaggaagcattcagtatacaggaggccaagagaatgcacattcttgttcagtaggtggcagtgtggtctggcttgaagcagcacagcacattcaggcgtgtattttgcagtgctttatcccgatgtctttgacagctccaatttgagattttattctgagtattttagcaccttttgtcaagtgctcttaaaaaaaaaaaacttcattttgttagaaacttctctcttggtagtgggcggcatgtttgtggcaagtactgtgatttgaagcttttgggagctaggtggctaattactgttagttggacatcttgccaggtaggctgtacttctgtttcctagctgtggtaagaggagttcttttctaatgaatatggtggttatttcactgactttatcagtggggaatacttcttcagcctgtagatcttaatagtttctc

SEQ ID NO: 2804 - DNA, 1000 bp, artificial
  synthetic oligo
tccttgtagccatcagtgtgctgtaactggttaacaccagcttaacagagccaattttacacatttattggcaactctgcatttggtgatgtcatatttatttcttgaaatcagtctagattagagtgtttacaccacaaaaaaatagcagatgctacaaatcaaggatttgctttttggagagctattttagaagcacacaccacttctcatagttgacttgttttaacctacttaactatactactgggtttgttaggggttgtcaagaattccttctatgttgcattgaatttttggcattcttcagtgctttatgtagaaaacatacttttactatatttgtacttaggcagttctggagttatgaaattcctcaagtctcaagcaagttgttatttcaatttcaatgtcaaaatatttgcctcacttactttggacctatgatttcatcttcatttttcaattggtatttgcaatgtttgttttactatgataaacgttttgaaaatggaagttaatgttcagagcttctttggataaggaaattggctgagctaggtgtatttgtaattattttcttctgtagtttgcttattttttgcagatacaaatacacagcagccatcttctggaaagcataggcaaaatacttacatctgacacctggctgtgaattacaatcaggtacaaaatcagcttttgttcatgtgccttactcctacttaattttgctaaaagtttttattttaaagttgctcttgtgtcatgatttttattgtcaaacctcagctcaacatggattcattatggctgagttatgaagtgcccttacagctttcagaatggaaatcctggtcttgtgtgcctttagtagagccaagctctaaggtgtggcgggattatagttcataaaaaggttagggtgacattagaagctgaaggaattgttgagaatctcttcatattttagagtttcttgcacagagaattcattttc

SEQ ID NO: 2805 - DNA, 1700 bp, artificial
  synthetic oligo
ccgacctcccttctgccccagatggtccagagccccatggccggcggagaccgggagaagaaggatgcggaggctctgccacctcgggcaggagtcccagagcggactcaaccggccgctaacagccaggagccgccatccgccgcctgcagcctcggggcgaagttcgcctgtagtccttggggtagaaggttgggggtggcgggcgggagcgagaaggaatggggtgggagccaggagaaacgcacctacctattccaagcgcaagtttcggcggcgtccccaggtgctgttcccccgccccctcgccaggtgctcggctccgccgggcgctgccagtgcccgggacttagggcgtctcggccgactcctgcgggaaacgactgtaaatccacattactgttcgagctgccgctcgggcccccgcattgctctcctccggctgctggcagcggtgctctaaaccggcggccgccggaggcaggaaccgaacctagctactattgcaccagcggacgaccgctgccagaagggtgcttgcgcccagggtcctatgtgtgtgcgagagagtgtgaatacgtgtgtgtgtgtgagtgaaagagagtgttcgtgtgtgagagagcagaaggggtgagctcagcccccggggcactcggaggtgaactccgggctgagccgaagctcgccgcgctcccgggtgctgggcgtctgctcggctgatggctgggctgatgttgccgtggccgccgccgccgcgctctaaggctggtcgcggtggtgcaaaaaatgtttctccgctactcgagaccaaaaaacctgccctgtctactgagcatgcccggtttgacagcttcacagccgaggtttttttttttttctccttttccccaagactccaggttttagccgcagctgagatgggaggtggagggaggtggggggaggaggagagggagaggaggaggaggagaaagaggagaagggcttaaggagcaagtatcgggcagaggaagggaagtcgcaatgagaaagatcagggtgttatagggtggagaggggaaggagaaagctggatatggaagcagaggaaggaaatatggatcaacaaaatttagatttcctactacagtggatagatgcctggccaggtgactcactcgatgttttttttttttttttttttttaattactttctcctgagggtgaggggtggggtggggggttcggatgagtatttgtcaaccccaggatcagcctgggacagtgttacctagtcatgacatacacaaacatcgcgtgcacacacacgcgcgcgcacacgagcgcacacacaggagcacaatcactgcttctatgttcaaagcctcaggactgacttagaatgcgaagtcttttgccagtataactttggcaaaaaaaaaaaaaaaagggcggggggagagaaattgtttggtttccttttcttattctcctctcccccgccttccagaaaagccaaaagcccgtgaatgcggtgcataagcgacccacaagctctcgtgcgtctgtcggtgagagtgcaccgccgactgcgtcctgctgacagtgtgaccccagagcgccaaggccggccggccacatgcagcctactggcggcgcatcagatcagcagtaacgacgtccacctgaaggtggttgggggaagaggggagcgctaagg

SEQ ID NO: 2806 - DNA, 1200 bp, artificial
  synthetic oligo
tggagaatactaaatagagtcccaatatacaaactgtggaaggtgaaaagaatgttaatatgactatctattaatagaagtatgtatagtaaaattatctgatatcattgaatatatagagatgtcgtaattctcatttataatgaagcgatatgctcctaagcaacaagaaagtcaaatcaaagaaattttatttttatttacaaagtaagaaaatcaatttgttcaaaatatgagttttttaggcatgtattgtgctatgcattttattgaggggtgcaaagtaaaaaaatattgaaaggtgcttctaatacaagaatatattaataaatcactaatgacagtaaagtgtcacggaaatatgagttcggaagttcatactttattcacaattggatataaagagatctttacaaaagacaaaaataaaaatgctagtcattataaaatgttgcaacatttgtaattatagatggtatataaaaaagtttaaaaatgatttggcatcctacttttatattcctatatatctatgctgattatcaatactccaaaaatttttaagggtctgaaatgagactagatatttctagttacaaataatattgttacaaataatattaagatggctattttagaatattttcctttctgaaattgtttagaagttaaatagttacttgttgttatgtaatttgatctataaaatagagtagatagcaagaagtagtttgtctcatccactatttaaaacagattttgtctaaagtataataaaaaaacagattttgtcacagtatactctaatattaagcttaaaattagtttcatgtgttcaaagtttctatgatgctttgatctatcaattgccactgaaagtgacatagactctacttacaacaaatcttttttattaatgtattcctaagaaatttcaagcaaagttcaattgtaagaaatgtataccctgtagaatacaaaatcaacattcaaaaatcagtagtgtttgtatgcactaacagtgaactatccagaaatcaagaaaataattccatttacaatagttaagaaaaaagggtaagtgtaaatttaaccaaggacgtgaaagacatatacactaaaaactataaacatcaacgaaatatattgaagaagacacaaacatataggaagatatcccatgttcatggattgaaaagt

SEQ ID NO: 2807 - DNA, 1000 bp, artificial
  synthetic oligo
gaaaaaggttgctgacttctgattttaacatactaatatagaggcacatatattattatgttacaacctttaaaaattattctaactatatttcaaaataattggtctccttttaattctatggatttcattttatttatttaaaaacattattctgaacagacttccataagcctcaccagactaacaaaaaggtccatggacttaaaaaatgcgaggacctctcgactagcttgagaatcaatctcaaattttattagtgagcatatagacttagtttgtggacacctctttgcccccgaactaaaggcaaatagacttaactacttacctggattttcctttgctcttcattttacttggatgccttgttaccctaatcttgttttattatgtgttattttgtcaaataattcatttactcaacaattattaactgaatgtatactatgcacgaggcactggagatatggcagtaaacaaaacagatcaatccctgcccacagagagcttgcttacattctagctaggggagatatacactaaaagaagtaagtaaaaccataatatttaagatgataagggtatagatgaacataaagcagaaaaggttaatgcactttgaaatgggaaacgggaaaggcttcatagagaagctgcttttgtgcaaagacttgaaggaggtgggggagtgagcagtcatgggaactggggatggacatactaggcagaaggagcagctagtgccaagactctgagggaagagcatgcctggcatcctccagcaagcaggccaatgtgattggaatagaaataagccagggatagtgagtagtagaagatcaaggtataatgaagccaggaactctcaaccctttctggttctcagaatcacctgaggaactatgaaaaactgcagacacctgggccacactacatattatcactcctggagatatggcttcattttatttgggagtgaggaccagacattttttaa

SEQ ID NO: 2808 - DNA, 1750 bp, artificial
  synthetic oligo
gtggcgagtcgcggcaacactgccgggaccgaggccggcacctggacccggacccggaccgcgcgcttgggccggctcggcgggcgcaggcagcgggccaggccagcacccaggcaagggcggggtgggtggccgtacaccggaccgaatcggggactccggtggcgtgggcgcgggccgaaccccgaccgggccgagttgggtggcgaagtaggacgtggattcgggggcggggcgcggcgggagggggaaaccaggcctggccagactggcctgggcgtgggggcggggggcgagttcggggcacttgctgggctctggaccgagcggtagggcggggcggcgctaggggctgggccggacccgcagggagagggcgaggggagggagagccgggggtggagtaggggcgtggagttgtgagcggggtctggcctcggccgggggcgaaggtagatcggcggggccgcgagcggagggagggaggcccgcggcggcgcggcggcagcgaaggccagcttccgcggagtttgtgcccgggcttcccgggctctggccgcctcacgcgcacaaatggggctaggggactgagtggtaagcaactccgagtgttagacggtgatcgggcggcgattccgggaaaagcgaggaaagacacagtctgcgattgtgccgcaccccccacccacctcttagcatctggattctgctctcgtagtgggggccgcggaccctccccgccacagtccttttactctccagcactcccaccgccttcccccttcttcagccatctgactctcctaggggtatgtgtttttgggggtggacggcgacgggggtgggggatactttccttcccgtggcggcaacctagttcgtatcttattcctacaaggtagcgtcgcttcgagtcgcatggacattggggtttagataatttaccccccacccaagcgatttaatggcttttaagcaaaaggcgaatacctggatttccatgggagggatgaggtttgaagattgggattcacccctagctcacttccactaccaacccctctttcttgtgagccacttccacgggtattcaaatctgggggggaggggggacgggagtattaatatgcttctctatttctacacagggtcggcgtggcgaaggacggctagccttggagggaaagtagccaccagtccaactcgggtcgcccccaccattatttcggtgagggggcaacgctaagaaggggatactggtgggtaggggcccagtataagggagggggctgggtagtcgtccccagaaggactccgtgtcttggcggggagagagagaggcgagccccggcttcaggggaggggttccggggagggagatgggggggtggcgacgacggtgggggggggagcgggaagaagggggagtcacgccctgcctgcaaggggagcctccctcaggcccctgggagaaggggactgaatgcgtctgttctccgctgcccggcagaggagatctggggtctcgagatttgcacactggatcggcaccagtggcctgagaaagtcaggtcggggcataaggtggagaacgttggaagaaagagagagaaccctttggccgcggctcactgaccctctcccttcctcaacctcccccttcgaggggcgtcgaggtggggggggacgtggggctcctgcagccccgcagattgagcgcctccgcctctcccaggagtctagctttttg

SEQ ID NO: 2809 - DNA, 1150 bp, artificial
  synthetic oligo
gaagggcaatgaccatatggttagctatagaaatgaaggtactgaaagggttcaaataaaaaaccttgctattatttatatataagtagggaatatattatatatatagtatatatcagtaggtatgaaaaactcaatagaagtaggtaggcagtgactcagcaaaatactcattcaatatatgaaagctgattcaaatggcaatggttttgtagtttcacttgactgctttgttttatggttgtgtaagaactctgagaatgtttcaaacattttaagttcaggggtgtctgtgaaatgtttttcttataacaagaattggtatagtacgcaaatccaagaaaactggattatatcttggttccttagacaatttgactggcatctcaacgattcaaactttcaaagtaggttttgggaacaaattacatacaattcagaaagaaaatagaggctcttcatattttctttgtccaagtttttatactatgcaaattatctttttttctgaaagcctgaacacatgaagtccaggtacattttgagaagacatttaataactttattattttatccttattcattttcaacttttgtctctgttaattttcatacttcatctatttgtagaaaatagctggtttacactaagatttaaaactcactagcataatactttgcaaagtttgcctatattttaaaacattttatgtcagctttgggatggggcactataataaaatatacttctacaaagaagttttactttatactcagggtatagactttataggcatacgcttttattataattcatatgtaaaagatataatatggggaaaagactaatgtacaattactggccttttgaagccaatctgtatagtaaatattttatgtaagtttcataagatattctataatcactaattcctaaagtaacctcaagaagtatgtattattaatcaatttgctttttatacgagtaaaacttatccaccagggaaaatgtaagtaagtgcattgatgggaacactggacataggggctgacaacctgagtgggaatttctggtctaccacttcctggctgccaaatctgtaagtataatcaacctctgtaagccttagtttttctatctgtaaaacga

SEQ ID NO: 2810 - DNA, 1000 bp, artificial
  synthetic oligo
ccgtaaatatttgctaagtaaatgcatggatgaatgaatcagatatggtccttgcagagaggatgacatgtacatgagcacactatgaggtggacagtggttaagtcacatgatgaaggtacagataaagggttctgagggctcgaagaaacggagaggtcattcagagatggagagggagtgaggggaatccaggagggcttgatggagaaggtagcatttgagttagaccttgaaggaagggtaggttttagacttgtgaatgtatggggaggcacagggagttcagtctggctgaagtagtgtatttgaagagtagtagaagtggaaaatacaattagaatgaagtctggagcaaaatcgtaaaaggccctgaatgccagggtaaggagatttgtctttaggtgtggtatgaagtggagcggatatgaaggttatagaattgtcagtaaaactttgagtcatcaatcaatgatagtttctgatttaacttttggttctttactcaattaattgtctcttacctaactccaagttctttaggagcttgatgatatggttcctaaccataatagacaagaagcaaacaagaagaaagaggagagattggatatgaaaacagatatacttccagggagaaagggaaaatagctcgatggcttcttggcttgaaggatgaagatggaaccctcaacttcaggcttaatacctctgtgactgtgcaatctaataactaaagttatcagtggcagcatggatccataatgcagaggagaagtcaggacaggtctggaaccttttaacaacatgggaaaggatgtaaagtatctcagaaatgtttacaattttttttaatttaaaatgatttttaaaagattggtactggaaggggaacgtttcaactatctggtaagctcacttatattaaatactataaacaaggcatgattgtaatactggttttaccaagtgctgcatgcactgctctgtgtgtgtgtgt

SEQ ID NO: 2811 - DNA, 1050 bp, artificial
  synthetic oligo
actttgcttctcctttaccttctgccatgattgtgagggctccccagccatgtggaactgtgagtccattaaatgtctttcctttataaattacccagtctcggctatgtctttattagcagcatgaaaatgagctaatatgctgctcattatgctaccaaggatcaaaccattgggagggctttgaactattcctctgctctctgggcctcagtttcctcatattacatttaaagagatctctgaagttctttcagctctgataatctaaggtaactagacatagaaaggctatccctagcagtgattttaaatgacactggtttgtcttaaaaagcagtttgtaaggcttgaagtgttttaggccaagcaatcaccaaggacattagagccatgagttcttaggcaaccttcttcctctacctttcctccctttgtcctctactctcagaaagatgtcagctgtctctgtccctttctcaatggctccaaggatattcccactcctttagacagccctgcagttccagaaatctcttcctctcatgcattttccaatctcttagggttcccctactaaatgtgcatgtacactagggctcataaggagttatttgctcattgacaatacatgaccaagatatattgttaagtgaaaataagaacaggctattaaacaggatatctagtatgatactattccccctacccaaacctcacaagtaaaccaatcagccactctttctggacatggcttaagtctagactagctacgggtctcttttgcttgcctctcaaagttaacaaagcagaattttggaagtacctcacaagtacttactaatgagctctctgttttatctttctttgagctaatctgaggtattaacatttgcagaaactctctttttcaaaagatgttgaaactctacttcaatttgaattccttacatagttaagaccataggattcagaacagcaaaaagctttagagtctaaatgttccatattagaaagataagatttaacagtaagcatggaaaggtctag

SEQ ID NO: 2812 - DNA, 1150 bp, artificial
  synthetic oligo
gctaagaagacagtgcgacccggaggggacccggccggacaccgccgccagcttcgctgggagggacgcagggcacccgccgaacgctgcctccccagcgctccgagaggggctttcacaaatacccccatacaccccccatcccaccccaccggcgccaaaatccggtgaactttctcacaggctaagccgtctctatttgcataaccatctccaaactgagattcaggtttcctgtaatcagtcctttcaaaggtctgtaattgaaagtgcaattaacccttaaaatgaggtaagaaaaaagaaagaggggaaaaatactcctctggtctgataccttccggaaagtaggagagttcccaaaagtcagggtttggaggggtggagagtgggggtagtcgtttgctttttaaaggcgacttctgaagcggttgcggctactaaaactcctaatccttgtcagcggtgcaagagaggcggggagagagttttaaaagaacatcaatgaaacatcaattcaagttccacgttttgcgacccccagaatctagcaagctccgggacgtttccctccaccacaccccactggcgacccccacccccacccggcctctcctcacccatacaacaaagcggggcgtcctataaggagttcaacccggaaaaggagaagtagccggtgacacgcactttgagggccacagtcctcaggggcttcccgggacggcgaataatgcaggggggagaggaggagcggaggcggggagcggagcgcgacagtcgcactgggcaacccggcggcgcccctccgctcgcagtgctgggaaggggggagcgctgcgcccgcggggaacgtcctgcgcccgggctgcctggctctctcgctcgctcgctcctgccctctcgactgcccatttctccctctagtgtacctgcgtccggcgcagggggcggcggggcgggggaagggagttgcagcctcccttcccgaagtgtcggtctctgcgcccacctcccgggtgtgcccacctaccgttgatctcgtggaggggggcatcgttcttgttgaagcctttggacacgtaaagacgtcgcacttccgagcaacttttcgacttgagctcggcagccagcagcgcggcgctgagca

SEQ ID NO: 2813 - DNA, 1350 bp, artificial
  synthetic oligo
cggggggcaaggaaggagggaaggggtgcaaaatgaagccggacccctccctttccaccattgttaccagggtgattgtggcagcccaaagcccagaagaggacaagggcgccatgtgattctcaacctggtgcactggtgcacagtagtagctcaggcaaacattacaaaagactggcctctcccgcccctggcccgcgaaagagtccaacctgaactgccagcgcccctcaggagtcagcggtggatgcaacgaaaaccacaatcatttctccaacgcgagtcactcgcacaggtgggcttcctcccctttttcatgcaacagaccttgcagcctaccctggcacgtctgcgtgatactttctggaaactacgcagcccgaagtttactacccaaccagatccctcctgtgagattgcaccgactgcaatgcaactttcgacctttaatggtaacgactagcagtggaaagaagaggagggggagggaagagaacttagacccgactttaagaagcgttgtattaaagcaagataagaacagtacctttgagctggagcaaaacctggagtaaaaaaaagggtttttgcgaaagtggcgcgaagataatatcatgtgatccgaccccagggcgtctccttccccttttgccaaactcccctcccctcgaaaaaaggggggttgggggagctacatccgctcctcacaaactattagcataattaattgtgtcctacagctgcagccagagctcccgggtcaatgagtaaacatatcctcatcctcttcaacatcagaacaaaaaaacccattaccctgattttggaaaatgttcccaaataaatctcattatcttcaaaagtctttatttggtattcggagtctatgtgtcttggttggagagacagaagaaggttggaaaagatgaaatcatcctattaaagggaacaagtagaagtaactccccaagagtgacatatttaagtaaaggttttcaaatggaaataccgtgttgagggacttcactagcttaaaattttccaaaagttttagcagttcattaaacaagacatcctcccagtcttcctattcgccaccccccatctcccacccctcctcccagtcctccttccctttaaagctagaacaatacccggaataaggtattttgagattgctttaccaggatattttcttgttcttaattttttttaagggtttgcaacatatagaatgtctggatcaagttcccaactggcgaaaataatttattccatctcagtacctgtctagcacaaggtaaaactaactaagtacaagatataggttatgagaaactaggacatttt

SEQ ID NO: 2814 - DNA, 1450 bp, artificial
  synthetic oligo
acaaattttttatgcttaaagtaaaccataaatcaaaaaaataaaatctaggatgcaataaaacaaaacaacttcttgacataagtatggtatgtaaatctgttttgattggaaatcaatttgttatattgccagaattcctgttttagaatacatctctgctgatctgtctgtattcttagactgcatatctgggatgaactctgggcagaattcacatgggcttcctttgaaataaacaagacttttcaaattcttagtcgatctgcagaacctgtagccaggcactgaaccattttgatagatgcagtaatcgttgcaagtgtatatttcaaggagttctggctgggtcctagtttatgcttgtggcagaagcagtgagtaactgggaggaagttggtgagtaagcttcaaggaagaagtcatttttagtactctggatcttcctgattttaaagcactacaaaatggtgcattttcattcttgtcaagtgataacagatatattctgatgagcctgaaatgaatatatattgtatcatttttataatatctagcaaggtttgtattttcctagaacttgaactaaatttcagttcataaaatttataaaatacttagttgttgtaaaatatttttggaatgttcacataggtgacacacaaatgtcccattttcattctttctatagtaaatatgttctgatatgtgaaggtttagcagatgcatcagcatttaatcctagaggatctggcataatcttttcccccaagaatagaaattttttctgcttatgaaagtagtacatgtttctttaaaaacaaatcaatattgacttctgcctgctgtatagcactatgcctccacctggccatgaccaggggcatgtcctggtccacctacctgaaaatgtttgcaaccagcctcctggccatgtgcacaggggctgaagttgtcccacaggtattacgggccaacctgacaatacatgaagttccaccaaagtctgagaactcagaactgagctttggggactgaaagacagcacaaacctcaaatttctcagcactggaaacctcaaaatataactgaattccataaataagattttaagtcttaaatatgtatttttaaatgtattaaaagtcaagctgcttgtatttaagcacctaatacaatgcttaggttgtaaaaggagatgctcaataggtactaactgatatattgagatttaattatggtttgaccaatatttattggaaaccgccaaagcttaaatcatcagcttcttgaatgtgatttgaaaggtaatttagtattgaatagcatgtgagctagagtatttcattctttctggtttatttcttcaaatagactttgaatataatggtgaatgggtattataaattaactaataaaaatgacattgaaaatgaaaaaatatatatat

SEQ ID NO: 2815 - DNA, 2300 bp, artificial
  synthetic oligo
tgtccccattaaaaaaaaacaaaaaacgaaacaaaaaaacaacctttattggaaatggactcagatgactgaaagaaaataaccaaaacctcaccggtagcttcagctgattcttacactatcgttgcgacatatacatctatctttaaaagcattagatgtcctaactcactgctagtgtttttattcttaaacaccccagctgagttattttaaagagctccaaacaatgacagagaactttctgtagatgaaataccagtttacatattaaactggttactcaaacttatttataatttatacctatcaatgtcatctatcaaaacataaatcaaaaagtttaaatacttgatgtcaagtcgctccttcctgtttcaagcagctccacagaaactttcatgtcctgaaatggccggcactgcgcatactccttaatgattaactcattagataccactttttcctttttaaaatggacacatattagcaacaagtcacatgcatgccctctttttgtttgaatacaatattcaattaagcattaaaaaaaaaacccactctgaaatcctcaatcacaaacctaaaagttaaaacaacaaaatcagcactaactgtaatggttttgaaagttaaatacatttcagcacaagtaatagacatttaaattatccaactgtaagtatcttgttacacttacaaattaagtcggtttttcaaaaccagtacaatgaatgttaagtgtcctatttattagttaataaaatgtgcagagtatttaataagattaagtatcgaatttataacatccagactgagatccagtggtaacaaatacactatgtcatggtaaaaaaaaaaagtcattagtaacaataaccccattccctaaattgcgacaatcaagtatctctacattccatcttgttttggcaatgatatttacaaacaacttttacactgactttgggattaatggagaaaaatgtcgttgactgcccttaaaaagaaaaaaaaaacatgtttagcaaatgtacaattatcatgtaaaactccacaactttctcccaacattttgttccacacaaatatacgagccatcatgtcagaagttaaagtcatgcctaatttaacatttccttagttgactacttagaaaaacaaaagttcattcgaaacagcatcggtgtcaaaggcgaaggtcccttccagattgctcttggaatcaaattcatttatacctttcaccctaacccctttcatctctcccagtgatagtacaacgagttacacccctaaaaagccacctcgatcccctagtttacatatttccccttagactgaaatttacttacgaaaagagattacaaaggggcgtcttgtcacttcaggagagggtcattcactgatacaatagacaaagaatcgatactttcgagttgccatagccccacccccttctgaactgcaatgtgtttggctaaatgatttaagagccaaagaatacgcctcttcctctgttcatactctacaacgttttgtcttttaattttgcatatgccttcgtcccccacaccccaaacacacgatgtaccttctctcggcgcattctagccaaacttccacaatgtcaagtccctacggggaaaactaaacaacctttaaagttttaattcgggagagacaatgtgaaattaatcacacatttctttccaagacataactaacttcttgcaaataagaggaaaagttcatttacattctgtcaaaaccagtcgctcccgaccctagcgaggctgacagtcggtcactgccccttactcagttttctctccccgcccctccatgttagttgttgttttttttttcccagtccgtttcctgagaatttcccggccgcactcatttgttaaacactttaaatgtcagatttgcccccatcccgcccgcaaaacgtgctttacaacccccccaaacgccacagcacttttttcagaattatcaccagatgtttttctgcctgccgtaacccacgttacagtcgggaaagacgccagccaccaagtccctttttaaaaaatcgcatgtcacctctggctccactcgaaaatggcgccgaaatcgaagaacttcttaaatttcattgcaagctttttgcaaaggtttctgggatttgcctgcgaagctgtttcgccgcgtccgagagcgagcgaacgtgcaagccagcgagggagacagggaggaaggaagggctggggaggcggagagacagaccgagcgagcgacacacggacagcgac

SEQ ID NO: 2816 - DNA, 1050 bp, artificial
  synthetic oligo
tcaacttgcctaaatatttgcaaaatgccataatgaaaattttggaagagttcccttataaaatagtgcctgaatgctaagaaaatgaacgcggcttcttttcctttccctgtcccgggtgggacaaatctgcgagcaagcagggctcaaggccagcggggtctggacgggaagagcaatgggtagagccggcctgcagctgccatagccctgggcaggccaggaggggccatcggagcctcggggcagataggctgccgggcgcaaaactatgcggaggagcagccgagcgcgttggccccgggggcggtgcggggtggggacttcctggcggctctcagcaacccctggtccgaccagactcggtgggctcggctgcaccacggatgagcaaagaaaccggcgggccgcgggaactgagccgcgcgcctgcagccgtcgccacggcggcccgcggccttcccccgcattccccgagggaggccgtagttgtcgcggcctgcagacagcgcgcagggtagcccagaaccgcgtgcgggcgctgggggaaaaaaaattaggtgccgaaagaaagcagcaacgcacgcgcgcgcacacacacacgaaatcagtttacaaaaataaaaccgcggaatctgccgtgctcggcgcccgagtttgagctacttaactctcgcatgcattttactgtcatatttctgtagagctgatggaaaatctgaaatgtttttgcaagggcgatctcgcagacccaaggcgttgcaagcgttgcgcagcctttcgctggcgtctgcggctcttttccggggcgcgaggagggaaaagagtagtgtctttcagggtctgcaaagctgttttgaaaagttaaccaaaaaggttttaaatagcaagattttcttttcaggaaaagtttttaaaacggctgatactcgtccagttttggtgggcgctaaaaagtcttattactaagctacaagtttccctgttaagattttcaaaacccctcgtggacagggctgaaagtttgccgggctgtgagacgtgactgaa

SEQ ID NO: 2817 - DNA, 1700 bp, artificial
  synthetic oligo
ttctgttgagttttgttttatatattttagtactcagaaattaagtgcatacatgattataattgttatatcttcctgatggattgatatttttatcattataaaatgatcctgtatatcttagtaacaggggtttttttgtttgttttaatgcctattttgactggctctcttgtggttgctacttgtatgatatatctttttccatccctttacattcaatcggtttgtatctttgaatctaaagtatacctcttataaacagtatatagttggatcttttcaatccagtcagaccttctctgctttctgattaagtcatttaatgtatttacatttaatttcatttgtgatatggttggatttatatctgccattttgctttctgttttctatatgcctcaagtcttttttgttcttctatccctcttttactgctttctttttcattaagtaaatatttctcatgtaatattttacttactttaataattttactacttttatttctttagtggttgctctaggatttaccatgtacatcttatcattggtttcaaagttatactaacttaatgccagtgagatatagaaatgtttctcctatgtagctctgttctcttttccccctttttgtgatattactattatacatgttacatcaaaaatgttttaaacccaagaatacattgttataattattgctttatataattttaagactcttaagaagctgaaagaagaaaggaaaatacatatatattataacttttgttatattagcattgtttatcatttctggttttcttcatttgttcctgtggatttgaattaccaactggagtcatttcttcagtcccatacactttgctcttacccacctcatttctgctgttattgggaaatatattacatttctatatgttgtatgcccagcaatacactatatacatatttttatacagttgccttttacatcttttaacaaaagaaagaagcaatactgtcttttctcattacgtaattatttttacttgtgctgctttgtcatgtggattcaaattaccattcatttagattataagtcagtattttgtacctaagcctttgctattctctcctattccaagtttcaattgaaactccatcttttacttcacagcagctttcttttgatctattaccttgaattttatttgacctgtttcatattaccctgtaatttcactcttagctttgaaatccaaatgaaaacaaaatagtgaatttaaacagcacttttatttgaaattcagctttagtttcttaatcttaaaaaggaaatttttttttcatgaaaaactaaaacaaggtattttagcccacttcctctgccttgaatataatgttctggaatttaaattttacgtcagattaacattagtcaaactaaattcctaatgtcattttaataatactaatatttaaacatcagcctacatttagatatcaaattagtaatttacagcccacatttcattgaagaccagtaaacttgatcagagataaaggaggagaataaggggctcagaaaagaggatgtaagcaacaccagctgtcaatgaggagaggggtggtcagacaaggcgagagtgagtggttggaaacttcacctggttgtccttagattgacactttgaaatactattttgtagtcattt

SEQ ID NO: 2818 - DNA, 1200 bp, artificial
  synthetic oligo
tggtagtggaaagaggccacacgtgataaaattgtatagaacacacacataccagacgtgcacgcgcgtacacacacacacagtagaagtaaaactgaagaaatcaaaataagattggtagattgtattaatgtcaatattctagttatcttatagtgtagtcttgcattgggggaaattgggcaagggggaccccagatctctctgtattatttcttacaaatgcatgtgaatctacaatcatcccaaaagacaaaagtttagttaaaagaaatataagtcagaccgtgtcacgccttggggttaagccactcattcaatgccctcccattgattttggaatgaagtggcctgcccatggactgcacctgcccatggactagtatgcaatccacgatctggtccctgccaacctgtccagccttactttctggtactctccccagctttcctggcgccaatcatgatcaccaccttttagttccaaagcatcaagatttggtccctccttctgacttgttttctggaaagctttttcctggctctttcatatctttcagggttcagcttaaatgtcacctcctcctttcctaatcacactatttgtacttttcctgcacaggctttatccaaatttgattattttctcacttctttattgtctgtctcccccactagattacaagctcccagggcagggtgcgtactgtctgcagacaacgctgttatcaccagagcccggcactgagcttggcacatggcgagggctcagtaaactgaatgctgagtgaatgagacgccacgcgccgctttgccatcggtgctttctgagtgacgttaaaacgctctggatggtggcactgggattatggatggggcttatttagctccctccggcttgctactaaggggaggggtcgtcggtgggcctttcggcgccgctgcaagccaccgggttccgaagtcggaggccgaaacggcgtgggccccgaagcggggccgcttttcagggagtgcgcaggttagcgaggaccccggtgaggcgagacgccaccctcacttggctgtctttgttgctcccacctccccagccccagccgcctgcagtgattcgtgactcccgcaggcctctaaggaccgctgcgcgagggagggggcccgaggcgcccccggcccgccctcctcccggtcttcggatcc

SEQ ID NO: 2819 - DNA, 1050 bp, artificial
  synthetic oligo
aaaatgcttatttaacatttttaagggcaaatataatctttatgcaacaggaaattggtcagataggccatgatttgtgcaaaccacctcacgataagtacatagtctaagactatcatatagattctgtaaccatatatggtttttgaaattctaggctaccattcccatatttaattttcagaaaaggaaaatatttttttcagccaagtctagatttttgagtgaaactaagaaaaattgtgtaagatttaaattgataaaattcctcctgtataataccagtgcattggaggtaatttaatatatattaaatgaatcgaccgctaaaacaaaataattattttttttcctggaagtgttaaactggaaatgtttaaggggaaatagatttttagtcacaaagaccgacaaaaatgcatttatttacactattgtattataatgttagtatggtattcattctgtgcccccaaatagcaattgaaaaaatagcatatttttataataaaatttaagcataatgtttttttctctgaggagtagaatgcagaaagtggtaaaaaatcttttacagagagaagcatgttgataggaagtgggctttaagtttctctctggacagaaggtgtaaatggcgtatcttttacctggctttttgagaatctgttgccctctaggacatgaaagacatttcaggaattaacagaagtcggatcaaattctcttgctagatgttcttaaagattttgctgatacgcatttgaaaatttgtaaatcacgttttcatgtaagaaattaaccctcacctctaaagtttgagcattaaaaaagtttgttgaaggcatggaaggtaatctcctgtgactgaaccctgttttcccactctccacctcctagttcccttcttccccatgcctctcctttctcccccgtccggtgccagcaacattggcttttataaccttatgggagttgaaccaaatattcctgcttgctcgaacttgaggccttatctttttggctgctttccccagcttttgcctactg

SEQ ID NO: 2820 - DNA, 3750 bp, artificial
  synthetic oligo
tgcaggaccccctaccccgggtttccgcacggctccatccccagtgcgggcagcttctatggctcctttccggactctccagatctgtctgcctgtctctctccagggctctgatttcctctcatctgtttctcctgctggcgcgtgcgtgcgtgcgctttctctgcttgtctctcacactgtctctggctccggggagttttggtcgctagcgctagcgcatgcgcgtgcgctctctgtttctgtctgtttacgaccgtcagtttctgtctcttctccagtgtctctcgctagcgcactttttttctttatctctcgggttgtgtgtctgtatgtgtctcaccgtttcctgattctttctcatccttgtctctcacttatgtctgtctctgtttctccgtctctcgatagcacgtgcacgctgtctctttcctgttactctcatttatctcttccactctgtttgtcactcagtctctctgtgtgtgtctctttcgctagcgcactttctctgcagggcttgcgctctcgctccctatctttctcacagtcttgcccgtctctccctcagtctctttctgatccattctgtctctctgtgtctctgcctgtcactgtgtcgctcgctagttcatgtgtgtctccgtctttccctagtgctctcttgtctctccatttctctctcagtctatttccccagcagttcatctttgtgggtccctagcgcacctgttcaatgtcgttcgctgtgtctctgcccgtctccgtgtctctccaactctcttgtttctgcgtctccctcgggttctctgggtgtctccttctgtctctcactggcacgtgtgcgcttgctctgtctttctcggaccctcttgtctctgtgtctctccgtgtggtttctgtctctccctgcctaagttctctctgcattactctgcctctctctccattgatctctaacactctactgcttgtctcacctgtctctcaagctatctctttagtgtgtgcactctctcgttggtttctctgtccttcactttcctgtcaccccaggactctggctaaacacttgctttgtatctttgagtgtgtgcgcatctctatttctctacatctttttcccatggcccctcaccttggtttttctctggctggatctctgtctctttggatctctgtctccctgtggactttattttgccgtggaaaccacctgccgccccggccaccgcgggctttggttaaaaaacccttagtttatcagcagtgcaatggagactggaaaatgcagagaggatgcctattgagctcccctaccctcaccctccacagccccatccccattcccaatttggcatcctctttgctttctccggatctgcttggtgtcggtgacagccgaggggagtgggaaaggagctggggagaaaggcaaaagaggcaggggtgcagggtggtggagagagtcagaaaggcagggcgagagagactgagaggcagagagacaaaaaggaaatgagagacagcgaaagaatgagatacatacagagagacagagagaatgtgagcaacagagagggagaaagaaagaaaaaagaagaaatgggagcgtgagagtgagagagaatgagagagcaagacagactgggagagacgcagacagaaaaagcaaaaaataataagaaaagagaacaagcagaggaagagggaaaggatgaggaaaaaacgagagaatggagaggaagggggaaaagaacgcacgagaaaaagtgagagagaaaacgcgagggcgggaggatggctagggaaaggcgagaaggggccgcaccgcgggccaccgcgcctggtagctcagcagccgtcgggacgcttcagagggggcgtcgtgggctcccaggctcggggccctgccgggtgctgggggccacggagcccggagtagggccgggctgcttacctgttgctgctgcagacgtggcgtcgcgggcgccgcgtgcaggtccttcggggctcctcgcgctcgtcccggccgcctctcggggctcgggcggctgcgagctggcacggggcagcgggcgctgcgggcgcggcaggagcggggcacagcgtctgtgcccgcacgtccggccagcgcgccgcgctgcaagctctgagaggcagcgggggcgcgcggcgtcttaaggcagcgcggtgccctcaccttgcggtgccgccctcccctcggcccccgcctgcgcccgtgacgcacgaggccgccgcagcccagggagcggggctggcaggtggggggccgtgcaccagaccccactcagattttctcactccgggttcccacccctggggccccgagtccaccgagagctcacagactggggattgtcaccggggctgattttcgtgcaaaccccgtgccttcctagccccctgatttcgggccagctcccaggcacagaccctgcactatccttccgattcttccaaataggagggcccgggactcccctcgacttctgaaaaccctccaaagtatgaatagcccctgagcccgagaaaggaatcgtgactttaatgtcaacgattttccacgaatttctctagctcccaggaagagctaagcggcagtgctttccctgtgggatttggaagcatttcatttaagacaagccacataattacccactatattctttgattgaagtatgtctgtctgtaagtcagtcagcatctctccctctctccctctttctccccctctctctgccaggtactgtgttaaactgtttacacagagaataccgctgaatctttaccccagccttgtgagataagtaccgctattatcttcattttatagagacagaagcagaagccaagaaagattaccctacttgcctaagttcaagtaaatattgcacacgttctattagccaagacattctggtctctcctaaacacatactgggtatttgttgtatatcaggactgaggaggccccctcttccctgcccccagaaggtagggaaggtgacccagaccagggatcatttgcattagatttccaagggattaggaggtgttttctaggcagggcacaaggggaaatgtgttctgtaaaaagaagatgcatggggtaaaactagggctgcaagagagacttgagttccaaaggctgggaaaacaggctgcagcatggtgagtgccaggaggttagctggttaaactgggtagagacaaatcctgaggggtcttgaatgccagtctgcagacttcggactttaccctgagatccctggaggtcgtcggagagtcgttttattatgaaagacttcaagcatacacaaacgtaatgagaataataaaataatcctccatgttcctattacccagccttcacaagggtaaataatttgccattcttgttcattggtgggttttaggtagggcgatattctaaaatcagggctggtgttggatggagaaagctgaagggaggctgtggcaggagacaaagagggtcttgacaggtccaacagagcggggcaagcagagacctacagagaggcaaattgacagggaataagggcaaggaggtgttggggagggtctagaatgagcacagggtttggagttggttgatgggctggatggagatacctcctccccttctcgtcacctgcctctgagacagggagatgagacaggtgtataatcgggcctcaagaatgctctttggatctggagtcctgc

SEQ ID NO: 2821 - DNA, 1850 bp, artificial
  synthetic oligo
tacctgtcagcagacctcactgtttgaagtaaacaagctcaaaaaccagaaaaaaagcaaacaaggctatcttttttacttggtggaaagtggtagatgttctaagtagagacgcagcataattcaatttcacaactctctgagagctgctatgtgcccaatgctgacatggtttctgctcctgtggttctcatcagcccactggggagacagacacacaggagagaatcagagaacaggagatggaagcaagcaagttgctataaggtggttcatacatcaaatgctggggggaggtcagaggtagaagaagctgatgtgggctgagaacttctgggaggagctaagaccctagcatcagcagttcgtaccagtgtgcttggtaacacctcggggccaactggacacttttcgttcctctgtgcacagaaagcagatcttgcaaatcctggcgaaagcccatgcccgagtccgaaagaaaaggctttgggtgtctggggccgctgcagctcctggtgtgtgcaatcaattcctaactcaagtgcagaaggcttccttccctcaaccagcctgagatacagcattcaaagcacaccagagaaaggttggggggcggggggacgtttccaaggtgaacaccgattagagccagctttattttcatgaactcatatgcatatttttagctcccatatttcctgctggtttgaagaagtgtataagcaaccatgtggacagctgtgcttcccatcagtgaggcagtgctgggaagtaaaaagaacatgggttccgtgtgaacttgagaggttctacaacccctctgagccttaatttccccttctgtaagtggggaaagtggggctaacaagagtaactcatgggaactatctagtggggctaactagagtacctcattgttttaaggatcaaatgattggtgtgaaagtgctcacagcagcggatggcaagtagtaggtactattgtgatgatgatggtgcagttccgtggcgtcccatacaggtagccccctgcggtgtatgggacctcagtatcttccaggcgggcatacctccggacatcgccagctctgggtgattgtgaggtgccgcacgatggggtctgacggcaattgctcatcctcagcagtttaaaaatgacatttggttgagttgccgtaggtgttatggatgcttccccctccttcatttgcgttttgctgagttgtcgtcagatattatgtggtcggatgttcccgagaagtgcaagcccctccccgtgggccgcccaggggtggcccgcgggcggtgcgggcgactagcggaggttggagtgggcttgtagactcgctcttactcccaccctctgggaggcccctaaccccgccctttccctgctcgcggcgaaggcaaactgcgcgcacggcgccctctagtgcccaggagctgtcactgcgcgggtgcccgcggccccagctctccccgccccaccaagggtgtttgtgaagatccctcggcacggccgcataccccaatcttcattcctgggtgtcctgaccatcccccacagacccataagacgcagatccgagaccgcttcttgtttgtttatttatttatttagctaaaagtttactaaaaccggggggctctgtcggttcttgactttgcggcacctgcccccgaaggcgccgtctcctccagagaacagcgcctgcgataggattcagcaggggtcacccacacccctaactcaactcgaggtgcgagtccccatctcgcagcgccctcgcgactgtcatctgctgccttcgctaccatttttgtttggagaagcactgagaggagaaagg

SEQ ID NO: 2822 - DNA, 3150 bp, artificial
  synthetic oligo
gcactctcataatggtaccttctacttaaaagcctagacgctctcaaattcgttatcacacttaatcctcgccaccagtcttccagaaagaccaggccggagccgtgtttcccattttgccgatgaataaaaataaggctcagaggctaagggacagtggctgtgtatgcttgctgggcactaaatgggacgcgggaatctaggtttttgcagctctggcccgcgcagttcttcacccagtgcccccaggagtagctcgcctctgacacacacacacacacacacacacacacacacacacacacacgcagtccagcccagcacacttgcccagttttacaacactccggcatgtcttcttttttcggtgacctgagaaccctctaattaaattttctgcccccctcttccacgaatcacgcccctggaaggctcatccccaattcagagaggaagaaagatttatgagcctctcctcaaggtttcccccaagacaaccttgaccatgaaactagaatcttgaacacttgacctaaatttccaagggcatctgtttccgtctgtaattgtcaccaggcttcatttgaaattcgatcctgtgtcactaatggtattaacaggagctgaggtccaaccttccaacgggagactgttgcatatgattttacatccaaacgaaagtaaatcagtttctataaacctgcagcaaccccctccctgagtacaataaaactgttgtcgcaatcaataaatctctggtttggggcaatgaaaattagataactgttctctctctctttctgtctcttctccccacccccccacccccattaagacaaagccactattcaaagaacggggcgtcttgttaaccatttctgaagtccctcgctgtacccggcgcctttcagacacgcacctctcagtcataggagaaaaccagacgtttaattacggtgacttttgttcgatcattacggataataaagacaaccttttcgctagataacaattataacgcaagctgctccaacacctgcacggatcgcatttgtctccagcgtgtttttttttgtttgttttttgttttttttttttttacttctctaaactgcctttgaatttccccttctcttctgaccagaaaatttaatatgttgcaagagatagatttcacgaaaacgcgttgtcccttctgtagctacatctgctccgacctattaagaaaagtaagacattttgatactaattgcaaataaattgtgatgtgttcaccgagtaattgatttaatgaagttcatatgaaactcctgagattggccaagtgaaaggccccctggtgcttctattgtggagggaaaggaaggttggtttttcgttttctttctttaaaaaaaaaaaaatagaggtggcttggagggaggaaggggatgggggagggggtgggcacagatgttacctccacagaggcagctccgtggcgggaacgagcagccagatagtccctccctcccgtcggcgtcggccgctagccgccagcccggctaaacgaggcgcaggctgccgctcccagcctcgggccccggcagtcggttgagcgcaattcaggggcaaacgtgggccaaggagagggtcagtgcgcgggccgcccgcgtcctccgagttgccaaagttgcacagggcgctgcctccggatcctgttccctcgcttcctgaagtgctcgacgatggcctctaaacctctttatccggctagaggcccagaggctaggaggggcccccaggcggctctcccctgagtcccggcgcccaggtcccagttgaggccaggggagagggctgcggtagctagcactacgccactccgcgtgcgggccagggtctccaaggttcgggtcccgagctcaccccacaagcaagaatatacggacaataaagccgccttcggcctcacgggggttttccttttcaacctttctggccagccacgtcggcgagttaaagggccgggcgtgcatgaagggtacagagagggaataagacttttctgaacacctactgtgtgccagacccagtgcttcacaacagttccctttctccaagcaacggtgggaggtattattgctccctcttaacagatgtggaaactgagatcggacccttgacagcaacgtgccaacaatgccctggctaccctgggccatcaacaagcacggctcgtcggaaaggagaaggcagattcccgcaaaactgtccccagtttgccccaaagccctccaaatattccccccggagcatagggatacaaggcagaaactgccgccgggccccgcccatatctcctagttggcggagcacagtctcctgctcgagtttgaaatttttgtttcgttttgttttaaagaaagaagacctcttttgaataatcagagccctagctgagctagcgagtggctccaagctcctcggagttgccctgcagatgaactttccctgagttcttcctcccgggtcgcgggtccccctaatctgggtcccaaagtgcccgcaggagacagcggtgcaagggtggtcatgctgactcgggtgtcgggcgccgccagaacccacaagccagagtgcgtgggagacgggggccggagggatgccccctccaccctctcagcccacttctgggaggccgcacccgctctgcgccttgaagagaccgcccgcagcgcgaaggcgggtcctcacccgaggatgtggcgaaacgcttaacacccaggcaaatgcaaatggtcaacgctggggtctgaccgaggccaaattatctccccaagaggcaaaagcaggcgcgaatgaaggcgaagagaccagcccctcgctttccgtttcgacatttgcaactgtacagcgctccacccccagcccggggggaggggggctgggaagccagcagggcctgcctgggccgggccgccagaatgccaccttgttctgggtggaaactggacactaagtgcccagcctgcttcttccagggagctccgacaccacgctctatcagaacgtgtccggcgctggcccacccttgccgctgctcatggcccgccgtattcgttgttcggcccgaagaacttccccttttgctttgatgcgggcttttcc

SEQ ID NO: 2823 - DNA, 2650 bp, artificial
  synthetic oligo
gggaaaggggcgacgccccgcaacggccgctcgaaaaagaagcgctgtcagtgaccatccacccctagccctccccgtcccgtggcgcctttgccgagttctaacttcccgggcagactgctctgcggtctcaggaactaattgggaccttctcgcgcccaggaacaaactggcgccgcctctttttgtctccctttctgggttaccgtgaagggactccgaatgtgttgagagcatattgcttacaagcgacttagctctcggcacacattcgtggaaggcaaccatacaaatgctaatgaaaactaactttcggttacttccgcttttttttacacttgattggcacatctcctaattaaatgactgatacttttgtcaaactatttttatttggagttccaggttcaattcagtcctccgggaggaaagctaaagcagtttcgtggtttgttcagaacatcttgtaaaactgtctggagccccctggatcgatcgatctatctatctatctatctatctatctatctatctatctatctatatttttttcctcaaacattaactacgactacccaggctttttaatatcgggcttagccaaaccgctgcatttgaaagaggcaaataaaaaggtacaaagaggctgaacgggattgtcctgtccggggcccattgtcccgccgggctcggttacattgctgaggtggtggcggaacgtggccgcgcattgggagccctgggtcgggtagggtggaaacacaacttaggggaaacttcggaggagccaggggctttccctccttgcaagaacaaagacatggtcaggttttgggccggccccgccccacccccacccccaccccgaccaccactcccaaacccagcgggctcaacctacgctcttcatttctctccagggaaaatagatgcagcagcagcccccagtccgcgctccctttccgggaagaccgccgggagctcagtctcctgctgcttgcctctgagaaactccggcgctgaccgtattttaccccccttgggtttttgccttttgcaggtgagaaacctttcaaatgtgaatttgaaggctgtgacagacgctttgccaacagcagcgaccgtaagaagcacatgcatgtgcatacctcggacaagccctatatctgcaaagtgtgcgacaagtcctacacgcacccgagctccctgcgcaaacacatgaaggtaattacctctttattagcggtcggcggtttgtaaacactcggcccgacgccgggccgcggaacggaagcgcccgcgctgccaaccctctgtcttccacgttaaatccgatttgctccagcagtgacaccttgaacccattttggggaccgggcgggggtgggggtgagggggtgggcgggagtgagcaaagttgggagggggaggaagcggagggaacaatcggttgtttactgggaagctctagccgagctcgcctgggcttgcggggctgccgtggccgcctcttcccgactcagcccgcggtgggaaccgagagtagccgcgccgaacccgagggtgggtggttcattcgctctttggcttcggataaaacaatagggccgaggagtgcaatctgattcccacacatttgtctgcgacttcgcagcgctcagggcccctgtgccaccttctctgtacctgctttctcaagccgaaacgggcttggtgaaacctgggcccggagttagtattttataggacctcacagtgtactgcttacctcactccatccgcggagaaagcatttttgaagtggcatgaccaaaacggaatgctttattccttttccgtaacaccagtcttaggagcaaaactggtttttggcgaacatctccgggttttctagacatcggtaatacggattttttttaagcagcatttttcttttaagtgggtcactgggcggtcttgttgttacagtgctcgaattctgctcttgtttttgcttgcacattgccagttggaattatattcattataatatatacatgttaattttaggttcatgaatctcaagggtcagattcctcccctgctgccagttcaggctatgaatcttccactccacccgctatagcttctgcaaacagtaaagataccactaaaaccccttctgcagttcaaactagcaccagccacaaccctggacttcctcctaattttaacgaatggtacgtctgaggacaaacacaaaccctgttaattatagaatggaccaaatacatttttaaaagaaaactgagaccaatcagatggaaatggagttttaaggcaagaggccatatatagggctacatcttgttaattgcaattgtccaggaaggttttgggcaagatccaaaagtagccatgcccttttctcaggatagaaaatatgttttggcatttgaagcattttttacaaaatctttacactactttttcttccccttcctcttgctctctgcacaccccattcttaaactcctccaattcattttaacacttgtcctgtttcttgagaggaagttatagaaggcttgttggtggtggtgatgttaaactgatggaaattctttttcgccttagtggtgattgtttaaactctcacagtcttaaaccg

SEQ ID NO: 2824 - DNA, 2500 bp, artificial
  synthetic oligo
ggaagaaaggcttcatggaggatggagatttagcttggacttgaagcatcatataatataaaaataataagtaggtcacggtagatcaaggaatgagggagcagaaaactcagtttgaagacaatcaataagtaatatttcattagtattatttttattattatatcattaatataattatgtatttccactatagataaaaatagaaaatatgactaaacactataaatttctataagccaaccacccagagattccttttggtgtatattctttcaagatttattcttagcatatttgttgtgtatctatttacatatgtgcatagttgtctatgtgtgtttaatttggtatttacagatttatacacacatatacatagccccatatgggcacatattcatatatgtacttttacaaaatactaatcatgcttgtggtgtccagtgagaaggatctcaaggaggtgcaggaaaaatgttcacaccccaggcacaaatcaccatctctccttggttacccctaagtccacacctagtatacacactgaaaatgatggtgcaaattatttaacgacataaaataacattctaagacgttgagggaaaaaaaggaagttatcgtgtatgtgcctgatcccacatacacacttaaagataattagccatgtctatgtattataatatgcagagaaaaaggactagaagcaaagcctcaaaaagttaacttggtagtggaaccttgggtgatattttcttctctacgcttttatgatgttccaaattgtctccggtaaacatgcattattttgtaatctgaaaaaaatcaatgtaataaaacataagcaatataaaaacacacacataaattcaaatctgcctgtgagcgtcctgctcaagatgcatcttcggtttttgagcagctaaagtcaaattagcattaacaagaagacagagaaagcaaagctcttgtgttggtcaagccctgacttcaaggctcttggccttctatgcctgcctttgaggtgtctagtgggtgggtcaggtgtacggaaagcaagaaagccttgataggtgtcgctaagggaggagggcgcgcctccctgagccccgcccggccaccaccagcgctgctctgaccgccaccatcttaacgctgcttccccacaggctgcaacgtgcccgcggtctagactgcgaggccgcgggctgcaccggagcgcgcagtatcttcccccggactgcgaccacccgcaccgccagccacggagccctggcccgggcccgcggttccctttgcgacgcctccccgtgagtcgactgggccgtgggtatcgaggacaagcaaacagaaacccccactgcccaccgccgctgccgccgccaggaaggcgctttgtcatgcccggagccggcgccgggcagctctttgccaagtttcaccttcggtgacacaacttttccgtgtttcttttttaggcagctgccacatcacgaggctaatgagcacactaaggtttgtaataaacctgcctgccagatacacaggaactgagggaggctggttgaccagacctttcagcgcgatcgtcggttcccagctagccgaaaaacaaatgttccccggaatgagagcatctaggagcaccttgtcctgtttccaagagaatggctcacattgttcccagagctccgaaaatcactcacaaattcaagagctcttggaagccttaatgttcaataaaccccccaaggggagaggcaagcatacacacagagaatcaaaggcaaaataagcaggtcaattctcaatactttcaaagtcaccattgaaagaagtttctgaaaatatctatgggcatattcaagaagtgcactcagcctgtcttctttaggttgtttacttctacttttaagagctagataaatattttaagaaccctagctatttactaaccctcaactccagaacagtaacaaatgctacctacattatttggagcaagttttgagaactgggtttcatgtttgttattaaatttacctatagccatgcaatagacccatcactgttaattattaccattgagcaacagttctacaatacagataaatactacatgattcccaacttcgagaactgtaattaatatgcttgttcaaggcgttgtgtctctgttaacaagatatatttttggaaatattatctaactgaaggcagcataaatagtatacaaaataaagcttgcacttttttatttttccatttaaaatgagttacgtaagtagtgaaaaacctcttctgtggagctacgctttgttgtggggggtggatttctttcatcacgattaatatagctatcaaaggaaaaaatccagaaatgaaaatctttcaatgagctcagcacaccctgaggagccccattcggttaataaaaaccactgacatttgttaacaagaaaaggagggagggaaagaaggagagtcggaggaagaacgg

SEQ ID NO: 2825 - DNA, 2250 bp, artificial
  synthetic oligo
cccgcggaggcccactcacgctgggcactagtgacaaggggacatcagcctttgttctcctggggcttggcgaggctgcgctgccaaagcgcagcgcgggcggcgccagggcaccagggttgctcacctttgcacgcggcgtgtcgaagggtgcaaactcctgccttcccggagggttggggtggataaggagtttaggattaggaggtgtcgggtggcggggggggggaaggaggtggtgggaaaggaggggggaggggttctgcgtctcgaccaggctctttgtttgcattgggggcggggagagggggctgaaggtgggttcaagcttgggttctgacagcagggcagattcctgagtatgtcaccatgttgcacgcgcgcagcacacatatgcacactcgcgcacacgcacacacatgcactcatacagacaggcggccggctgtcagcagacagcgcggttcccggcgctccaggctgcagcagcttcgtctgcccgcagcgccaccaccgtgcgtccagaggggaagtggaggaggctggaggcactcgagggtcgacaattccgcgaggaaggagggaaagtggtgcaaacctagatccaccccctagcgacctctgcccccccttttctcccggggtcgcagaggtcatgggcagcttaggctccgggaaggaggcaaggagccgccggagggcggcgcgcacgcgagggggcgagggaaacgaaggaaaggaaagcaggcggactcggcgggcgggcttacccttagaagcatctttctcctctttgggcttggtcacctttccactcatagatcccagcttgcttgacaaggttcgctcagaagacggaagtcctcgccgagcgggtcggacttgggagagtgcttagggcggcaagtctcgaccacgagctcccctcggtgtggttcggggcggaatccgcttttccccaccgctgccgccgccgccgctgcctacgagagagtggggaggaaaggaaaggggtgaaggaggagccgccgtcgccgccgccgccgccgcgatcccgagcggccggccgcgggaggagccgctcgccgcgctcaagaagtgaagagacaaagcggcgcggcgcttcctccgcgccccgcgccctcagcttctgcccgcctgcggagagccacgctcgcaacccccggggcggccgagaggagcggccgggactccccggcttcactgccggcctccctgggctccgcgcgggccgctcgctgggagttgcctgggtgggctgcccgcgcactggcaggctgctttcccccgcctctcccaatccgctgcgggccgccaactcgatcaaaataaaaccccgaggaaggctttttaaaaaatcaaaacaaagataaaaatattcacttaaaaataacaagcctccctgaaagggaaatgtttgaacatgtgatgagcaacgtgtgagcctgttacaccgcagagtcgcgcagcttctcgcccgcggggaatggggaggagagggtcgcctcttttctttctttctatttaatccatttccaggttcctattattttgccaaaaagggggccggagttgctcgccggcggaggagtgggagacgatggcccttacctgctctctttctctctctccctacacccacaccccctcggagctcgcccgctccctcgctcgcgctctccttccaaagaactctccggtcctagagagccacgaatcaacaccgcggcgcattctatataaacggcaaggtgtgggcacgcggagggtgggggctggcgaaggcggggcctcacaaagccgcctgcccgctgtagtaaaaggagagctcggcaggggcgcgccgacgtcagccgccggttggcaaaaccccggcgagccccgcgtagtgcgggcgagcgtgtctgctgggcgtaccctggcccctccggggcagggagggcccgcgggtgccactgtagcgggctcccaccgttggccaaggagatggaaggccggcgctccccccaccccggcccctgtaactcctctactcctagcgcctgctttcccaggcccgtgctggtcgccacctacactttggggactcccctgttggcaactgctcgcaccgagcagtggaatctcagtccgggagtcgacgacttttcgcttctggctagctgctcaagttgagacagtccggctctcagtggggagagaagggctctctgggatctgggtgtcagt

SEQ ID NO: 2826 - DNA, 1250 bp, artificial
  synthetic oligo
cttagaaacatgtatttcttttaagggagatgataaaacttaatgataattttattttatgtactaattttcattcttgggaattattagacatattttgctagaagagttagctttatttatgtctgtaaggctttctggatacttagcaattattccacaacaaaaactgcaaaattctaacttttttctctaaatcttaaaaatgattacgttagttcctccaacttttgatgttatttttagctcagtgattttttttttgtttgtttgtttttaacacagtttgctctggaattgtctgcactgaaaaaacattgcattattacaagggatttgttattgaacccaaggaaatgacgttagtgttccataccgttttagcttaattttggtattattatgatgttttaactagctagaatttttagggttttggaaattagtttttttttttccttttttttcctaaaagggactgaactttatattagaacagaaaatctcgtgtttgagcattcatttttatttccttttttctttccccttgctccttcatcttgggattttcaatagttgagagtagtccacacagaatccactctccaccccatttttcttaatgacaaaaacctttgcaagaatgaaggggggatcaataccatttctgaccgttactcttgtaatttgataagtatgaaactaaccccgaagtagtgctttgcagggacagcaggaaagttctcaatcaggactggagcactttccggagacctagtttaacaacttcaacgggcacttggggaaactgaggcccaagaagacgaggcaggcactttccctgtgattttttttcttctacaaaatactactttcgtccacggaaaacacttttctcgggcacctagtgtggggaggacattgctagggtccagactgcctgcctacccacgagggccgcgctctttccacttttattcccccggcctccccggatcggcgccctggatgtgatcgacaccatgaagttgccccataatcctctctggcaacataggatgtaaaatttgatcagctcattggatgaagccgacaagtcccaaaaatgtgtgaaaagggggctaagaggtaggcaggcgccgcgttgaggcagcgctcctgccagccccgctccgagttatcggtgctgcagccgcggcgcaagcgggggctgggaccgagctgcggggccgcagcggcggcggcgaccg

SEQ ID NO: 2827 - DNA, 2000 bp, artificial
  synthetic oligo
aattgcttgtttttaccctccctttcctggagtcatttcagaccaaatttgagtccacaattgctagcaattggaaacccagagtaacctacggacaggtattttattgaaggccaaacacggtaaaaatatggtggggggatagatgggacaaaagagtttcctctcgcccctgggtttttggagcacccgggttgaggggccaggggagatgaggctcactgaccaggcagcttgcaggtttgctccaatcacagcagcaaggattgaagcaccaaccagccgggaggggggcgaggtctgtggccctgggattgggagaagggggagtggtaccaaggctaagactgaacccgaacccgagcctggacgcgcggcaggaccaggaggaggactgggtggagggcaaagcgtatgggtctgtaaatcaacgccggccccctcccaccccatgctgcacagtgggggatggaatgcggggggtgagggttggcagtggaaatgtcttagggggctggtgctgccttcccagggagacccgacctttcttgaagaggcggagtgggtttagtctccaggatccgcagtgatgtgtaaaaagcgggcacgacccccgaagcctcagaaagccccctccccacccccccaccaggccctccccggcccgcaggtgaatgactggcccacacaaaggaagccggctggaaatgtggaattcggaccaatttacgggagactctgtcgcctagggtcccagcggacctcaagcaaagaaacctgtggtcagtagtggatgaggataaaaacagtgcaccaggccaagcttattggaaaggctgagtttagttattctgggatagcgaggtaacaggattaaagggattaaggaaatcacctcaaacagctgaggagggggtaaaaaaacactggttctatttgttttcttcctaggccccaaacagatacactggggccgtgtggctgggcgcgaaactaaaggcccttcggggggcacagtggaatggccaagggtcagggactggaggaaagtggggagggggatggagtggggagggggatggagtagaaagcgggctcgagactctggatgaaaaggagccttctctggaaaacaaataggtggactgagttgacatgttaaaaacaaaacgcctgggaggagtttcggagatctttgaaaatctaaggagtactttttaataccaaatcttccagcgctgaatgttgactccggcggttcagctaccagggttgaaacgtatttgtttcctgctggggatccctgtaaccatttatttttaataggatcatcgagatttccgaagggttttcgttttgtaaatatttcagctaggctcaaatgtcttcccgccccagtgcacaaaggtaaaagtgccccgtttttggtcggtttcagcggccgcgcctttccagccccgcctcgcgtggctgcggcagcagacactttcagcagacgctcactgcgatcaacaagtgcgcggccgcgggctctgcgcattagctactactgtgtgcccgctctcgggagacgctcctggaagactcggaactctgttccgagtttcagttgagaatattggaagctggtgtatggtggatcaccagtagttaaaaggaaaccatttcagattatgcttgcctccccccaggtcccaccccgcccctaggatgggatctcagttgtaaaaccgagtgttggttcctccccaacctgcaaaaaagtttcagggccgcaaaattatcaggactccatcatgttggttataaaatttattgatctcatttaggaattaagagtaaaagcttgaaaaccctgaaacaaagtagcccctccccactacccaaacgaaatctgaacacattagcgcgaagaaatatcaaacagatcacggcagaaatcaccaactcaacatgattggacagaagctgtcccgcggccaggggcggcgaggcgggag

SEQ ID NO: 2828 - DNA, 1250 bp, artificial
  synthetic oligo
attcttacccctagagccatttaatgctgatcttgaattgtttgctgctattaccgttaagggaggcgacaaggggggcaagtagctccggagtaggggatggactggttttatttataaatgcttctttttgtcttatgcgggccagtgaaaaatgaggtaagaggaagatctgtaaaagatctggagaagatcaggaaacgattgttcaaatccgtgtgccttttcttaaaatcttttgaggttttgggcttgaccagctcttcaaaaggaagaaaagggcacatgtgatccctggcctgctaaacagagtttgcttcccttgaggaggtatcaagccaaattctacttaacctggaatggggaaaaggtgggcagaacggtcattgtcggcatcgccaaacgggggtcacggcagatccccttagctgttggatttcttataggcctggtttagctgttccacgctgtagccagcagagggcactgttgctacatagaatcttttttgactgtttttggtggtgaattttcagagctatttaaaaaacttccatccagtaagaagtatgaacgattttccatgaaattttaatgtgaaaaatagattattattaaaaactgatggatgtctatttggttgttaacccattgaaccatagaaagagagtgaagatgttccataacaatcaaagattaaaatagcaagaacaaaaaataaatgtgataataaatatcagcatcatatccctcaattgtttcgaacataagtagttagggcttttgctcatagggatgatacttaaattttcaaatgaagaaagttgatttgtgaatttatattactcatttggaagaatgaaaactgggatatgcatggtcatgtgatcttataatgtacaattcagttttctacatagaagtctccagtaaaatatgcttctacgtgcagtgggaatttaaaaattaacaatgtaaaagatgtataattaattatcataaatgaaataacaaagaaagaatgtgtatgattctgagtaggattagaattgaaatctgttcgttatgtttaggtaatatttgtagaaatttaatggaagagttgtatcgatactaatttatttcttaccgttttgataggaatatgtggaacaaaaagaaaattcatattgtagaaacttagactcacattttgtgttagaacctatgagctactctgggtgttttattttaagatggtttttgctcat

SEQ ID NO: 2829 - DNA, 2900 bp, artificial
  synthetic oligo
ccgaaaggcaggggcgggcgcggcgagcccctgccagatccggggatgataacgtgcctgctccatgtcgcggcttctagctgtccaggctccgccccctgtgagtgtgtaagtgtgtgatgctgccgcggccgccgccgccgcctgtgcagccgctgccgccgccgccgccgccgccgccgccgccgccgccgccgccgccgctgccgccccggctgccgcgccgcgccgctgcctctgccccggccgcccccgccgccgctgccgccgccggcccgcagccagccaggcgggcggcccagcccgcctgagcccgcagcggctgccgccgcagcgtcgggtcgctgggtgcgcgggctaccgcggaccgagcggacccgagtgggcgaccaggcgcttgcccgcccagtgccactgccgccgcttcctcgccggagcacaggaccagacacctccagcgcccgctgctgctgccgatgcggcccggacacttttagctgggcgggagggctggagagccgggggccgccgagaaccgccagcgagctgtgccgagagccgcgccgacccgctgcgatcagggacaggcgcccgcccgccgccgccgcctggccgctatggatctattcgactttttcagagactgggacttggagcagcagtggtaggtgttgatttttgccttctcctttgatgagcgagtctcctggcgaagtctgaggttttcgcctttgttaagaggagctgaagctgtcgtggggggcgccccggactccctcccacttgctctcagccacctctggccccggccgcgctgactcctaggtcggatgccggggtggggggaggtgcgggaagagggagggatgcggacccgaaagcgtcgctttgcgctccaagtctaaagagttgcatttggctcacatcgaattcggtgccgcccgagggctgaaccgcacgacctcccaggagcttttctctcggagcggcttgccggtctggcctccttgagccccggatgccgcccgcccgaaatgtctcaactttccaggtgcccaacgcccgcggcgggccatgggggaaaggcaacggccaggtgcggccagcagccctctgcttccttggtggccaccgcccccgctgccgccacctccatccctgcgctgcgcggcgcgcacacctttccttctgccgactcagcccaagttccctgcactcccgggtggagcagcggctttgggggccaccactcaggggaccttggttcgaggccgacttcggcgcttggctttcaagactgagggttttcggagttggccccccaaatccgcagctctgatgtcaatgcacatttaattaccggatggacccccttcggcctcccactgggaggcagccgtagttttttgtaagggacctccagctcagattcaaaggttgagtcagctcttcacaaaataccctaaacttgtcgctgagacattttgaaagatggtagaaaggtgactggggacctggaaagttgttaactctcttagagatgtgcgtgcgcgtgtgcataaatactgatatacatatctattaacttttcaaaaacttcacctactacaaacattatcacagtttatttgtcataatacttaaacgtatcagattccccccgcagtctaaggaattagatggggagggggcgcagtggtaaccgcttaaaattgcattcttggttattgccttttaaaatgtatttagaatgatctgtagtacctaccaatagtgcgaaatcttttgcaatgttaaactactagcggccgttggttatgaatgctgtgtatttttacaaggatttcccctgttgatgtgatattttaggcaatttccttctttaaaaaagggtcatatgcttagccaacagcttcattatgccaatcatgcctcctttagttgcaaatccaagatagtcagaacttaaatacattttattttacagcaattccggataaatccttgaagcgcaaattatgctgtatcagtattaatctataaggcgttttggataccacggttttatcagctctgtagaaatacattgttacattaaaaaatgctgttatttgaaagtaaaaattactataaaattattgctcaattagatattatgcttctgcacacagcctttactctgcttcactaatttattttgcagacaactgataaccatagcactctatttgcatacaatttgcctaatatgtggtgtgggttacatcgttaatttaacagacattgttataattaatttcatgggtatagttcaaatgttaaacatatacaaggtattaggtttttagaaacatgttttttatattaattccggtttaatcttatgcatatgcaattgcatatttaaagggaatggactcttttatgtttgatttctttaaaaaaaatgataggctccctcacccctgtgggaggctttctttttcttatcttaaggaaaatgcaaaacctttttttcctccagatccctaactgagacacatcagttaagaagcatagacttggacacttcgtgaatattatgtgaaatactgattaattagtgtaacgcatctgcataaataagcctgtcctttccctctgtacatgatccaggaaaatttctccttcttactgctcgtgagtggcacacttcgtgatgcatctctgtttataaacatttgtaatgtggttgtgcttttgtgttttgtatagctccacagagaaaaggaacataaatgtgacaatagtggatgaactaaaaagcttgacattgtcttgagtggaaattggtacctttcccacttctctttggaagtccagagcatgccagttacgtgttcattatatgtttacttcca

SEQ ID NO: 2830 - DNA, 1700 bp, artificial
  synthetic oligo
aatacagaatgtgaggtcccgttccagccaatggaaaccggacacagcagtagggtggatgcgtcaggtcataaatgaccctgtctcctttgtttggtgtattctcgtggcaaaactgctggcgagtgtaccctttctgcagaaagtaaaaatggccttactaaataataatgttcaagtgctatttctttacggcactagggaacaagcatttcaaacaatttgatgggccatatggggatacattctcctctgggggtggtctccagtcgtctctcatgatggagcgtgctcccttacctcattgcaagcgtctcatgggtgagaaattgagacccacccggtgtgatgaataaacctgtactctcagcaatgcaaaaataaaaagagggagagagagagagagaaaaaaaaaaccagaaactggccagcaacctagcttaaaggatcctcacatactgcagtgatgactctgtgcacagaccaaggaaggagaagccgcaggagccagtaaagtaaaaaaactgcaggggtggtaaagtatgccttagtcaggatgtcctggaggttagaaagaggtgagaaatccccaggggcgttgaacctcagaaagagctgagaattccttggggggggggttgaacctcagaaagaggtgagaaatccccatggtgggggggttgaacctcagaaagaggtgagaaatccccatggtgggggggttgaacctcacacaaacctccggaagtaagaaaaatatttagaaacccccctttcctttcttctcaggggaagaaagagtagctccactcccgccggtccctcccctaagggaagggaaaggagaaggaaaaacagcagcataggtggctggcagagactaaggaaagaccagcagagaagaaaaagaacttaggagagaagagagaaagcaagcaaaaacagcagtcacagagccaaacagcgaggcaggcacgccaagggttaagtccctctccccagccccagtctatgtgaaaaagagggcggtggacccttgctgggaggagagcagaggagctgaatagggcataattcttgcaatttgcggcaggcatctgccaagcctctaggctggtgactgccctaggcccagactgcagccacgcaaatctcacccagcccgagaaactaagtgtaaaaagaaatgaaaaaaaagaaagtaaagggggggaacacaggagaaacagccggccgcgcacgcgtagggggcggccgtggctggtccccgctcacggcaggagcaagagaactcgggaaaagaaagggaaacaggatgacaaaggatgacagaggatgagggagagagagagagagagagagagagagagagaaatacagtgcaaatgagagagaaagagaaatggaaagggtaagtaagagaaactggaagagacagaaatcaaagacatagagggtgaaactagaaaaagaaatagtgtaaaaggaaggcacaaagttaagacatgttgcagattgtgaaagttgtaagaaaagctataaaagggaatttatgcaagaaatattgtataatttaaaagtaattaggcctcctgaatgtaaaattatttttaaaaagtttatgtacaaggtatgtaagaaacataaaatatacttttaataacaggattttaaggaggcataagaatgtggatttttac

SEQ ID NO: 2831 - DNA, 1450 bp, artificial
  synthetic oligo
ctaaaccaaaacaaaaaccggtgtcaaaggggcttggcccccttcagcaattgaaggcatagaagttacacaccgggccaattagggagtggaaatttgcattacaagaagaccctttgcttcacaaaagtagttctcataagattgcaatagatggcacccaggggggttaaagattcaattttcaaaaccgagttttgcccacaactctttcgcagcacgttctgttgtggaaaaccagtctccagactgacttttgaccagccttccagccccaagatttgttgtttaccaaaggatacatgccatccttatactatctcatactcaacccccttctttgctatgcccggggcaattgctccaaaacagatatggctcctcccaggctggcacctggctcccggaggtagtcacagtggacaagtatctaggcctggggtggagagtacgagctagacctgagtcccagtcctgctgagccatctcaagttgcagggcctgtcccctctttcaggcctgagtgtccacatttatagaacaagggaaggttgatagaagaatctcccaaagtgtttttcattctaggagttcattcctaggcattgctgggtggccctggggatactcttgacctatgaagtaagatagggacattgccttagataacgccaataataatacacaggggaaaatccaaatgcctgcgtgcaagtactttagcccttgtaccatttacagatgctgaaggtgcagcggtggggatggcctgtgtccctacagaaagcacatcttacaagtcacacgcctcaccatctaagtgctcagctttctgaaacctgctcattcagaacatatgaacctcatgctgtggtattccaggtctcagcttggcaagctcaatgatgttttcattccaatcagtgctgaatacaaacagacccttatccctaaattgtgaaatttagagaaaagtagagtctcaaggtgcaaaatttgaacctcacaaaatttaactaaaccgaagtttgggatatagtaagagctcaaggaaatggcttctaattgctcattgggaatagatttttgagattaaaacaaatttttcaaacctgtccagactcagaggcttgggagtgaacagttgtcacttaactttatggcagtggtggctggaagctcgcccaccctgattctttgttctccctcccataattgctcaaactgagaggtctgtaggcaccttaaggattcaaagtgatttgtgaaagttgtaaagtccaagcctcaactagagagttgttcttggaggtaggaagtttgagggacttaaaatgaactggggggaaaaaggcaacagaggaagagtgagaacagagagagagaaaggctcagaggaaggaagataggggagggggggagagaaggagagagagaacgtgaacatttc

SEQ ID NO: 2832 - DNA, 5800 bp, artificial
  synthetic oligo
gagggccttgaaggtaaggttcagtcaccagagagcaataacctcttctggctgcttgccctttgcagagcagacgggactggacccagacaaggcggattccttcacaactgccctgacgaactgtgtacccccagcctcgccctgttgggctgggcgcatcctggcagcgctggggctgcgaagccacagcccctgcatgtgcctcgcggttgggcctggacgccgctctttctccaggtaacttcgtgaaacgctaggaggcaatcgcccagcctcactgcgcctacgtagcccacgaagggatcttgctgggttctcggaggtggccccagcgctttccgagggccgagagcgtgggcgtggagggaaggaggggcctagtgggcggcgggcccacccctttattcgtggcctgcggctccgctgagcgtgaccagatgtgttggtgacaggttgctactcagaggtgcggacaggagctgagcgctgctgctgtcggagcagacgcggcgttcccgggttgtgctcagcccctgcagctgccatcggctggagaagtccaggttaggaaacgcatccggggaggggatcctagagaaggggcgcagccaaatacccgggaggtgggataggtgggaggggagtcgctggactcggcgccagggcagatggtggacagggcgcgctggcccgcccggcagttcccaaggaacctatgttcctgcagaagccgcaggtgtccgtcttgggataactgcggagggagccaatccagcccagcttgggcgggagcatcgcgtgccctggtccagtggaacgggagactggccagcgagcctggactctgagctaagcgtactggcgggcgacgccgacagcgtccgcgctaagggtgggggactgggaagtggggagtggggcactcggccgggatggagagaatgcagttcactaactgccacctgagagccctggtccccgctgccgccacagcgggtctgtttggcagtcagggcgcgagctggtgagcggatgcgtgggcggagggactggcgctacccacccagcagccacccactgcaggtgagtgcccctcccagggcgaggggaggagaagggcctggccgctagccctagggtcaggctctggtgaaaatgggaagggggatgggggctgaataggctactttgtgatgagactcccgtccctgtgacacttcagggtcctctggggatctgtcattcctcttgcaagctctcttgttctctggtccctctcctcctctccttatttcctcctctcctctcctctcctctcatctcctctcctctcctctcccttcatcgtgtctctacctctatctccgccggtgcctctctcggtatctgtctctcagtctctgccttctctgtgtctcgtacggtctcctgtctttcttggtctctcggtcctgagcgctctctcgccctgtcactgatgaccgctggcttttggctctccgtgctcgctcttcgtgtgtcccggccacgcacggctcaccagctcgttttccccagacgcggaaagtctaccttcggcgtgcgggtttcccaagcgcgccgggccccgcctgcggccctccggcgggctctgtctgctggaggcgctccgctaaccctgctgtcgcctctttccaccagcgcaccgcctaggcaagccagctgacgccgggggcacagaccaccctccactgagtgcggagcagccaaggtgagtgcaccgatgccccttccgcccctccgatccctccccagctgccctggttcgagccgactggagaaatgaggctgcaacagcgaagccagcctgcggccgctttctcctctaaagactggtgggagggcccgggaggcccctcgggcggccgcagctctttggctgcccgctgccccatcccggagtggaaaccctgagtttccaggcttcgggctggcggggtcgcgggcagggcagcgcggcttcccctttaaggccggagccgctcgtcgccgtgagtgtgagggtgtgtgagtgtgcggcgtgcgtgtctcctcctccccgagtgacacagcagtgagaaatgcctatcagtaacttaaacccccgaaactccaccttccgggcgcgcggcgcggagccgggcggtgggaatggagcgagcagattgaggccgccactgcagcgccgccagcatgaacttggccgcgagctgaagcggccggcggcgggcgggcgcgggggcaccggccgctagccagggggtgatctgcaacagggctgggttccttggcggccgcctgagtccaggctgcccgcgccggcggccgcccgcccctcggacactgcccccgccgccgccggagctctgcagcacggtaaggctgagggcgggtgcaggaagtctgactgttctgggggttccggggtacacttgtagcccccagttatggtccccatcgctgaggatcggggtcccaggggtgcttcgagtcggtagaccctaaagtttgctctgagcacacggcccacctggcgctgcgggcggccacccccttctcgaaccagcccggctgggctgggcgcagctcgaaacgccggagaccacggcctttggctcggcgcccgtcgggcgtctgaaatccggcggggacagccacgtaccggggaggaaaggtagaagggcgcaagctcctcgggctacgctgggctactgggaggctcccactctgtcccagcacccccgggtcgcttgcagcctgggtgtcaccggcgacggtgccttcacatgccagctgcctgagcccaggccagtaggcagtgggcgctggatgaaggatttccccaccccaacgctgtttgccgcctctgagcgagagtgtggagtgtgcgcgccgaatccgctgccctgcactccctcccctgccaactcctgggaagcgcagcccggagctgagctggtgttcagggcagcccggactgggttcctgcggagcagccccggcgcccctgcgtcagagtccgcgcttcaggttccccagcatccgcgcgacgacagagctgggcgcccggcgccggctagcgcgggcgggaagccccccggagcgccgccaaatacttttctcggccagttggcttggccaggctccgtcccaatgcagtgtgtccgaagcctcctggaaagctggagatgtcgtctgattctgatccgtgattaaattcggactgagcagacactaataggattagcctgccagaaagctcggccctgaagccatcggaacctgtgcaaacacgcgcctcgggctggagcattcactcccgccccgccgcgcttctgcagctgggtgcggctgacctgggcacccggagtgtgggtgtgtgtgagcgggcgggagcacagcgtggctgggggacgtggggagaaggggctgcttttgctggggtggcttgtcgttgttgtttggcaccacggtgccccccgggggcgcggtccccacggtgaacgtgctgctcacgggtaggcaaacccaggccggctccgggacattgtctgcaagggcgagcgagccgagcttactagaggcggctgcgctggaacaaaggcgcaaagtctccctgagaccaagcaattttgaaagagttggctagggagagggcctgggtctcccggggtagacccccgcgggaattgcgccgcccccagcggccccggcccgcgcctggggaattgtgttccctggttgcggtgagccggcgagcgacatcgcagcggcgcggcccagctcttggcaggcgtgggttgccgcccgagtgcccaccggccgggcggggtcgaccgtgcacccgccggggcttcccggccgccaccgcagctctgggcccctggaggccgcgcagcttctttccttccctccctcccacctcttcttgtctttatagatcccccctccctcccacccccgccgccgccgccgccaacaatccgctttataaaaagcccctttgtttcccaggaggctggagagagggaaggggaaaagggacgcagaggcagagggcgggggcggctgtctccaagtggtttcgagccgctcgggacaggagggcaagtgtaggcgatgggggagggggctgtgtttcgaggaccctctgtgggaacccacgaaggcgcacggagcctcagccccggccctcgctgcacgcccggcctgccagccctggacaccctaaatcctggcggccgggacggccgagtggactgcactgcgagctggcgggcgcgcgcagaggccctaggctgcaagcgctccgcggggtgggcagacgcgactcgccgatgcgctcgccgggctcgggcatagggggcgccctttccttggtttcgctttgcagcgggcgcccctcgccgccggagctcagggcagctgtcgcgcccgccggtggctaagacggaggcggcagctcggaggcttaggccacccgcgtctggctacacgcctcatttcttcccgcgccctcctgccacaccctccgccccaccacacacaagggctcaaactctccgagcgccctttgtttggaggcgcggaggcagtgggagccgccacctccggggttcgtgtagcctaggcgggcagtgaggatgagcgtgctactctggactgcgcgctggcctgctgcctctgcacctaacccagcgcctgacactaaagctgccagctttagttagattgaccatttagcgggtccttgtcccttataactgcccccctaaaactttcgagaaccagggcttgcactgaggaatgtcaaatataatgttagaagtaacctttcgccattctgttggcctgctccgcccctgtgccccaaagtggtcggtgtctctcatagagtttgttcgggaagggaatactgaaaagaaaaaagtgacaaataaggaaagtgggcggggcccaggctcaggctggtgggtctcccaagcgaagtcagattccacccgctctctggccgcctccgcccctcctacttccatttaatctgatgtcgacgttttatttgtgcctttttgcatatctttctcctactcccctcccctcccatctctggaggttattgataagtgctgctcaaacatttgttttctgcgtctttggagtagaagatgaagcgttaacacccccaacgcgcatacacacatcccaaatgcgcgcatacacacatcccaactgcatctaaaaccacaagaaagtaatcaaagggtaaactactggttctgccttctcctccctcctttgtgcttctcttctggagcaagatcattggaaaataaagctgctgatgtgcgagatggaacatatggtgcctccataagagagaagctgaaatggccttgaacctgccggacagaccagctgtttgctgccagccagagcagctaatcagcttcttccccttaaagtaacagccctcttttcacttcatgaccagtttgcatattaaataggatattctccagaggggaaaagtgatgggctcctatactgctttgtgcttggtggttctccaatgcctgctccctgctctgggggccgccctgccctctcccggtgcctgcctgcgatgtgcgagtgtttctttcagtactgaagtaagaatgttgctcaaagtggaacttgggacagacgaggcaggaaaaaagaaagaaagaggtggggctgagagatttccagatgcctgggaggaaatctctctgttttgttcagcttcggaaaaaac

SEQ ID NO: 2833 - DNA, 1400 bp, artificial
  synthetic oligo
ttcttttcattactgcgtagtattctgttgtgatattaccacaatttatatatacattctatggttgatgggcatttgggttgtttccaattattgactattacagataatactatgaacactcttgtgtatatgataaacacatttctattgggtatatatttagaagttgaattactcagtctggattatacatacattgactttagagatacaaattgttacaaattgttttccactcagcatatgtccttgaaatccatccaaattgttgtatcagtagctcattcccttgtttaaagtagtattccatgtgcttttcagcggtggtatggacatacaacaatttgtttaaccattcacctggccatgtagttctcctggacaaaaacacaccaccccacagattgggacacctaaaattcatgtttatcatcagaatttcttcttttgtgaactttgttttcatattcattacccattttctgctgagtaatttgtctttttatgtttgatttgtacaagatacacattctggacataaaaagtttaaatatcatatacatcataaatatcatgacttgggttttttgcatcttcaccaggaattctgctctaccctacaatcctgaagatattctagattttcttctcttggttttaaagttattctttacaaatgtaggtctttaatagatttgagattgttaaaaacatgtttgtagtataactcatataaagtaaagtgcacctactgtaggtgcacatttctatgagttttgacaaatgtatacacctgtggaattaccatcaaatcatacaatattttcatcatacccgaagtttcctcacgtcccttcccagtaaattcccacgtttatcacccagaaaaaaccaccactctgattttttcccgacatatattagtttcatccttttctaaaatttcaaataattgtagtcagacaataggtaatttttgtgtaaggcttttcttcccccactcagcataagatttcggggattcattcgtgttgttatacgtatctatagtttattcctacatatggctgactaggattccattcatttttctctattcttccgttggtgacattgggttgtttctagtttttggctcttatggctaaactgctatgaacattgatgcaggggtctttgtgtggacatatgtttccatgtctgaagtaagtagctaaaagtggaaatgctcagtagcatggcaggtgtatgtttagcttttgatgtgtttgcatggttttgttttcccaacagcaatgcatgaaagttgcaagttgctctaaattcttgccaatacttgatattatcaacctaaaaaaattagcttttttagtgggtgggtaatggcatcttgaggc

SEQ ID NO: 2834 - DNA, 1050 bp, artificial
  synthetic oligo
tatcaccatcgttgtagacctaatcggcaactccatggtcattttggctgtgacgaagaacaagaagctccggaattctggtaagccaccccttcttctccctacccagtgtgcagagacttgcaacccctagggcgttagtttttgagctccccgaatagagaatctatggacagtgccctcatattgaacatccctgctcccaaattccccgcaagcctgggggtggtagtattctgtcccggccctctaaacgtggaggttctcaaggccgagagagcacagagaattagctttgggcatccaagtacaaagcgttcccgtggtgcgcggcagcccgaggatccctgtcccgtcggggcctgatgcggagggagccggcacccgagcgggagagtcaggcgattcgcccggggacagcaagccgagccggacgccgcaagggcggccgcgctgaggcagcgcggaccgaactgacgcggagggagcagcggggctgcgacctgctctgtgaaagttaagttcgcggcggccgcggcggcccttaccagagcgcaacgcagtggcctctccctagccgggccaagagcccgctcgccgcggccctggggctccaggacggctcccgggcagatcccgggcggcggagcacagacccccgcgcccgagaatcgagcagggaggtctgagcccgccggagccgagctccgtccgcccgtcccagggcgaacggcagagagaggcaagcggcgggtcgggcacagcaggcggtggcagcgacggcggcggcagcggagatcccaaggtccgtaagcggggaactggggggtcgcagggcgggccggccaagaggcttgggagctgggcgttgctgggggtggagggatagaaggcagcaaaaccgagtagggattggcgggagggcgacgggagagctcagaggcggcgatgggggactcagagaggctgcaaagggctggggtctgggagccgcaggcgggacttcccccgctgctagccactgccgagcgggaggaggccgggggccgg

SEQ ID NO: 2835 - DNA, 1200 bp, artificial
  synthetic oligo
cacagaggagggagactactggctccgagttgggaaggctgcctggaggagggggcctgaagaatgagcagaatctcagaatctgggcagggggcataggagggaggcctgggctggggcccttgcccactgggtgagagaaggaagggcacagtccagctgcccaaagcccttggatgcaggaattaggactcttgttagacgcagggacatggggggtgtggccggaaagcagcccagtgccagggtcctgggagtccccggctagcagcccactgcccgaaagggagggagagaggcaaactggaagccccttagaggtgacccacctagctttccgtcacctgccctcttacctaaccatgacctgagacattttctcctctaactccatggctcctgagaggagtctttagactcgtagtttgctttgcattttccacttgttagaaaaatgctttgtggtgcccatcctcgtgtgcataactttgctttcttttactttagttccttagattcccaaaagtggtcaaagggttgggattttttcctagctcttgatattgccagattaatttccaaaggggccgtaccaatatataaccctgcaacagttgaacagcacgctgatttcacagcaatcttgccagcactgcgtgttctcaaaaatgagaacatttctaatgcagtaggtgggaagtgttacctcgttggtcattgttacttgtttattggagtggctttccttccacgcctgaagttgaaccttcccccaaatatttgttaggccaccgcattccctccttcctgcagtatgcagtgttttcaggttctttgcccatttatctacaggggtcttaaccttttagttgggtatgagctttatcttatctggcgtacattttccttcaacactgttatttgcttttgttgagctttaagcagagaagggacttttagccagatcagcattgtggacacctccccctgaccctggtctcctgcctcagtgctcaccacacctgagaccttgtccagtgctcttgctgcctgtggatctgtcccgcctgttgtgcccatggaggaaaggatggaggccaccagccttggttgagtggatggcattctgacgttgggcagggctgggcagggcagggtggagggcaggtcgttgcaggcccggaggcagggagactgttg

SEQ ID NO: 2836 - DNA, 1650 bp, artificial
  synthetic oligo
aaaaggaagcaggaggatgggatccagagtccccgtcaaccaaccatcccagccctggaatccaacacggattccacaggacgccctctcggtcgcattcctatcccgctagggggctggcaatggccacacaaggtttccaaacagcgggaacaagagacgaggagtggcagccgggaactgagagggaagaaggcggaggacagcgaacgggagaagccgagggccccgcgcacccccggagaagggccggggagagaggaccaggagctccgccagggtggggcaagatttgcgtccccgccctgcccctcggctcccgcaccaggtggccagaggagctcggctcacagcgtgaagtcagtccccggattcctgggaattctcccccgtgcccagcccctccttcccccgcccccgcccccgccccggagttctcgccgatccctgcacgggttcccccacgttctcccaagccaacacccctcctgcaaagcacttgattccttcccagtccagaccaataaacccgggagttgaatccaggccactaaacgcatacctgtctgagccctgtctgctcctgggtgccttgaccttgacctccctccacttagccctaggaggtctcagcccacagcatccgggacatttctctagacagtctgcagggtgcacacagaaagtacacaaatgcggggccgggggagcctccgcgcacacagagacggggcacaggaacgcactcacgtagtcacgccacgcacaggcaagaagccccgttccgggccgcggggctgggctccaggtccgagctccgggccccgcgtctccttccctccccgcggggccctgctggtccacgccccgcaaagcccggccaggcactgccacccgcagagagcccaacccgctgatcccggcggcgcccactcacccgagacgcctaaggcccgggagcccatcgttcgggcagggccaggcgggagtgggtgtcggggtgggcacccagcccccggacggacttggaccgcgcccggggacgcccacgcactcccacgctccaggcccgccgggatctagattcggcgccccccgcacggcgggagcctggctccctcccccgccctgggtcctgcggggagagcgtgtgcggggaactgcgctcgttgctatgcaacctccatcccgcgcccgccgcaccgcgcctcccgggacggaagcgcgccccacccgggccaaccccaacttcccaccccacccgtggctggttcccacggagcgccaacacccaacagccccaggatgggagggtgcggacggctccctaccttgtcctcctcgagccctcccgctctcccacgcccgccgctccgggcctccccactggcccgctcctccccgcggagggccgcgcccccgccgcagcgccggcggccctacctgcagcatcactttgtactgctcctccggtttctggaccacgcacatattacatcccatgttgctggccggcgagaggaggcggagggcgggaacgggaagacgcctttcactgacccgggcgcgggacctcgggtcccgggccggggccaggggccataccctggcgcggggggcgggccgcctagcgggggaggggggcacgcc

SEQ ID NO: 2837 - DNA, 1050 bp, artificial
  synthetic oligo
ccacacggggctgttgaatcggagcccttcctttcctccctggctcctcgttagaagagaaatcaagaatggcgggcctgcccagaatgtggagaagagaggcgagtttcttatccagggcttctcccagaaagcagaacttgagacaagggctggtgtgcaggttgcaacctgccacccaatggctggctagtcttgaggaatggcgtcatattgagggctcagcatcggtctctgcagctggtggatggaagaacattcactagcggcagtgtctagatgagccgtggtaagaggaagcccttgccgttgggcttatacagagcctccagccctcccaccatggccactggcatcgtgggtccatcgcatcctggggagaagctggctgacctccaccagatggtcccctctgttcgctagcttctggcgcgccccctccacactgcatgctccccagcggcatgggcgcgaagacgagcacggggccccacactctccctgagcactcccgtaggtacctcttcgccaaacctgtctcttcttccaatcttcctccacccgggtccctgaccagtcagcccagccattttccactgcccgggggtcatggacaccttcatctcaggccatttctccctctacaaagtagacaacctagtgtcttgctcccctagaggatgtcccctcactgctgtctctcagggccaccctgcaaagggcctcagtgtgacagcaggtgtttttcctagtggtgacatgagatgaccagtcgaggacctgggtctgagtcagtcatggggacaccccatcaccacctcccatgaggccataggtgtgagctgaaggggcataccagtgtgaaagagccgggtgaccgggggtctggactgcctgggcctcaatgtgccatctccacctcaatattcagttcacaatgggtggcttgggtcacacaggccctggatgccccatgatcaggctgtaagtctctcctaggtcccagtagcatggccacagctatgcttttttcagtggtgagtgagtagc

SEQ ID NO: 2838 - DNA, 35067 bp, human
gcctgcttttgcccgggtcctgagaacaggggctccccacactttttttttttttggttttgttttatttcgtttccgcgcgtctctttctactgcaaacagaaatgggagggtggacaggcgggtaggagcggatcagacgcccaggacgcagcagcccgagtccgcacagggtttgcgggaggtggtgaccgcgctggggacgccaggacgcgaatgaacctccggggcgcgctcggggcctgcgctcagagcttggtgagctcggttttggaactttccttttcttttccagaaagctttgccttctttcctttcttcgttccttccttccttccttcctctcttcctctttcttttctttctttctttctttctttctttctttctttcttttctttcttcctttcacttggcaagattggttttggagctttccttttcttttccagaaagctttgccttctttccttccttcgttctttccttccttccttcctctcttcctctttctttcttttctttctttctttctttctttctttctttctttctttctctcttcctttctttctttctttctttcttttctttctttcacttggcaagattgcttttggagctttccttttcttttccagaaagctttttccttccttccctccttccttccttctctccctccctcctttcctttcctccctctgttccttcctccctccctccctccttctctccctccctccctccttccctttctttcttctttctttctttctctttcttttttctttctctttcatttctttcctcttccttcccccatcctcccccttcatcgtccctcctcctcctccttctcctcctcctcctcctccttctccctcctcctcctccttctactccttttcctcctcttccctctgccatttgtctctttcccctttgcgtttttattcgcagtcgttgtttttgtccatccactaacttctctgaaacctgattcttttgggacgcttggcaaaaggcatttcatacagggaggcggtcacatacgctaacaagacacggtgaaaagtctcttctcatcggcttggtgtgctgctctcttctctctctcgctgtctctctctgtctgtctctctgtcccctgtctgtcgctatttttctctgtctatctctgtatctctgtctctctctttctctcctctgtctctctgtatctctgtccatctctgtctctctttctctctctcctctctctctttttctctgtctctgtctgtatctctatctctgtctctctttctctctgtcttcgttcctctctctctttttttctctcttcctctgtctctctttctatctctgtctctctctctcctctctctctgtctctttttctctgtctctgtctgtatctctgtctgtctctgtctctctttctctcctctctctgtgtctctgtctctgtctctctttctctcctctctttttctctgtctctgtatctctgtctatctctgtctctctttctctctctcctctctctctttctctgtctctgtctgtatctctatctctgtctctctttctctctgtcttcgttcctctctctctttttctctttctctgtatctctgtctatctctgtctctctttctctctctcctctctgtctctttttctctgtctctctctgtgtctctacctctgtctctctctctcctctctttttctctgtctctgtctgtatctctgtctatctctgtctctctctctcctctctctctttctctgtctctgtctgtatctctatctctgtctctctttctctctgtcttcgttcctctctctctttttctctttctctgtatctctatctctgtctctctttctctctctcctctctctctgtctctttttctctgtctctctctgtgtctctacctctgtctctctctctcctctctttttctctgtctctgtctgtatctctgtctatctctgtctctctctctcctctctctctttctctgtctctgtctgtatctctatctctgtctctctttctctctgtcttcgttcctctctctctttttctctttctctgtatctctgtctatctctgtctctctttctctctctcctctctctctgtctctttttctctgtctctctctgtgtctctacctctgtctctctctctcctctttttctctgtctctgtctgtatctctgtctgtctctgtctctctttctctcctctctctgtatctctgtctctgtctctctttctctcctctctctctttttctctgtctctgtatctctgtctatctctgtctctctttctctctctcatctctctctgtctctttttctctgtctctctctgtgtctctacctctgtctctctttctctcctctctttttctctgtctctgtatctctatctctgtctctctttctctctctcctctctctctttttctgtctctgtctctctgtctgtctctgtctctctttgtctctctcctctctgtctctttttctctgtctctctctgtgtctctacctgtgtctctctttcctctctctttttctctctctgtctgtatctctgtctacctctgtctctctctctctcctctctctctgtctctttttctctgtctttctgtctctctatctctgtgactctttccctctctcctctctctctctttttctctctctccctgtctcagggaagcatcagtaaaacctccaacaagcacccccttgtacacagcccaggccaagagaggtgcagaccctgctttctgcctgcagccgcctgctgtaaaatgtcaatgcaaaacatttcatacagtccacccactctgcagactggagctgcggcctctcggacagcgtcttgaattggcaacgaaaaacgtgtggggtagaaaaagctctcgtctggatttctaacatgttatcaagcactcaaacgctgggtgtttcctgcctgtctttaaagggaagggcagggagagaacgtaaaagctctggtcagagaagggaaaggtctttaggtgagaggggtgaggccgcctccgtgctcatcccacaggaagagttggagttttacagaaagatgagatctctttcgcgtagccagaaactcttaggaaaagcggggtgttggaaaggcagaaagtgtgccatgaatcggacgtgcgtgatttcaaagccacttgtctgcagtgagaattacaattggggcttcagttgaaaaagggcctttgctttttctccgaggccgaggggccttgaatagccacacagctcctgactggtgtccccatgctcattcctggaggctcggacaccctggtagagcggagtttcctactagacaaaggggtccagattgcggcccaagaaggaacctcaggtcggggaaagcctgggcctcacgggaccccccaggaaagcctggtccttggggttggagaagacagctgagctgggaggacggagggttttcggtagggagacagtgagcagctgtgagaggtttacggcgcagtccctggggacccagtttcccagcagaggcagagatggggaggcctttagaagcagaaaagttacccggcctctgaggacccagaaagttgctctaagccagagacccttctccgaatctccctctctgtctgtctctgcctctctccctctttctcttccccctccctgtctccctctctgtgtctctgcctctctttgtctctctctgtatctctatctgtgtctctctttttctctctccatctctctgtctctccgtttctctctttctctctccctctctctccctgtccgtgtcgctctttctctctctccatctcccagtctctccctttctctctctccatctctccctgtctctctctttctctgtctccatctctttctctgtctctccttgtctctctctttctctctctccatctctctctgtctctccctgtctgtttctctctctccatctgtctgtctctccctttctctctctctgtctctccctctctctccctgtctgtgtctctctttctctctctccatctctctctgtctctccctgtgtttctctctctccatctctctctgtctctccctgtctgtttctctctctccatctgtctgtctctctctttctctctctatctctccctctctctccctgtctgtgtctctctttctctctctccatctctctctgtctctccctgtgtttctctctctccatctctctctgtctctccctgtctgtttctctctctccatctgtctgtgtctctctttctctctctccatctctctctgtctctccctgtctgtttctctctctctatctgtctgtctctctctttttctctctctatctctccctctctctccctgtctgtgtctctctttctctctctccatctctctctgtctctccctgtgtttctctctctccatctctctctgtctctccctgtgtgtttctctatctccatctctctgtctctccctttctctctctctgtctctccctctctctccctgtctgtgtctctctttctctctctccatctctctctgtctctccctgtgtgtttctctctctccatctctctgtctctccctttctctctctctgtctctccctctctctccctgtctgtgtctctctttctctctctccatctctctctgtctctccctgtgtttctctctctccatctctctctgtctctccctgtctgtttctctctctccatctgtctgtgtctctctttctctctctctatctctccctctctctccctgtctgtgtctctctttctctctctccatctctctctgtctctccctgtgtttctctctctccatctctctccgtctctccctgtctgtctctttctctgtctccatctctctctgtctctccttgactctctttctctctgtctccatgtctctgtctctccctgtctgtgtctctctttctctctctccatctctctccgtctttccccctctgtctctttctctgtctccatccctctgtctctccctttctctctgtctttccttgtctctctctttctctctctctctccatctctctctctccctgtctctctctctccatctccccgtctctccgtttctctctctgcctctccctgtctgtctctctctttctgtgtcttacacacaccccaacccaccgtcactcatgtccccccactgctgtgccatctcacacaagttcacagctcagctgtcatcctgggtccccaggccccgccggggaggaagatgcgccgtggggttacgggaggaaggggactccgggcctcctggtgccccactttatttgcagaaggtccttggcaggaaccgtgacgcgtttggtttccaggacttggaaaacgaatttcaggtcgcgatggcgagcaccggcttcccctgaagcacattcaatagcgagaggcgggagggagcgagcaggagcatcccaccatgaaaaccaaaaacacaagtatttttttcacccggtaaataccccagacgccagggtgacagcgcggcgctaagggaggaggcctcgcgccggggtccgccgggatctggcgcgggcggaaagaatatagatctttacgaaccggatctcccggggacctgggcttctttctgcgggcgctggagacccgggaggcggccccggggatcctcggcctccgccgccgccgcctcccaagcgcccgcgtcccggtttggggacacccggccccttcttctcactttcggggattctccagccgcgttccatctcaccaactctccatccaagggcgcgccgccaccaacttggagctcatcttctcccaagatcgtgcgtccccggggcgcccggatccccccctcgccatctcaaccccggcgcgacccgggcgcttcctggaaagatccaggcgccgggctctgcgctcctcccgggagcgagggcggccggacgactgggaccctcctctctccagccgtgaactccttgtctctctgtctctctctgcaggaaaactggagtttgcttttcctccggccacggagagaacgcgggtaacctgtgtggggggctcgggcgcctgcgcccccctcctgcgcgcgcgctctcccttccaaaaatgggatctttcccccttcgcaccaaggtgtacggacgccaaacagtgatgaaatgagaagaaagccaattgccggcctggggggtgggggagacacagcgtctctgcgtgcgtccgccgcggagcccggagaccagtaattgcaccagacaggcagcgcatggggggctgggcgaggtcgccgcgtataaatagtgagatttccaatggaaaggcgtaaataacagcgctggtgatccacccgcgcgcacgggccgtcctctccgcgcggggagacgcgcgcatccaccagccccggctgctcgccagccccggccccagccatggaagagctcacggcttttgtatccaagtcttttgaccagaaaagcaaggacggtaacggcggaggcggaggcggcggaggtaagaaggattccattacgtaccgggaagttttggagagcggactggcgcgctcccgggagctggggacgtcggattccagcctccaggacatcacggagggcggcggccactgcccggtgcatttgttcaaggaccacgtagacaatgacaaggagaaactgaaagaattcggcaccgcgagagtggcagaaggtaagttcctttgcgctccggctccaggggggccctcctggggttcggcgcctcctcgccacggagtcggccccgcgcgcccctcgctgtgcacatttgcagctcccgtctcgccagggtaaggcccgggccgtcaggctttgcctaagaaaggaaggaaggcaggagtggacccgaccggagacgcgggtggtgggtagcggggtgcggggggacccagggagggtcgcagcgggggccgcgcgcgtgggcaccgacacgggaaggtcccgggctggggtggatccgggtggctgtgcctgaagccgtagggcctgagatgtctttttcattttctttttctttcctttcctttttttgtttgtttgtttgtttgagacagagtctcgctctgtcccccaggctggagtgcagtggtgcgatctcggctcactgcaacctctgcctcctgggttcaagcgattctcctgcctcagcctccccagtagctgggattacaggcatgcaccaccacgcctggctaatttttgtgcttttagtaaagacggggattcaccatgttggccaggctggtctcgaactcctgacctcaggtgatccacccgcctcggcctcccaaagtgctgggatgacaggcgtgaggcaccgcgcccggcctgggtcctgacggcttaggatgtgtgtttctgtctctgcctgtctgccttgtatttacggtcacccagacgcacagaggagccgtctccacgcgccttcccagcgctcagcgcctgccgggcccccggagatcacgggaagactcgaggctgcgtggtaggagacgggaaggccccgggtcagctcggttctgtttcctttaaggaacccttcattattatttcattgttttcctttgaacgtcgaggcttgatcttggcgaaagctgttgggtccataaaaaccactcccgtgagcggaggtggccgggatctggatggggcgcgaggggccccggggaagctggcggcttcgcgggcgcgtcctaagtcaaggttgtcagagcgcagccggttgtgcgcggcccgggggagctcccctctggcccttcctcctgagacctcagtggtgggtcgtcccgtggtggaaatcggggagtaagaggctcagagagaggggctggccccggggatctctgtgcacacacgacaactgggcggcatacatcttaagaataaaatgggctggctgtgtcggggcacagctggagacggctatggacgcctgttatgttttcattacaaagacgcagagaatctagcctcggcttttgctgattcgcagagttgaggtgcgagggtgaatgccccaaaggtaattcttcctaagactctggggctacctgctctccggggccctgcatttggggtgtggagtggccccgggaaatagcccttgtattcgtaggaggcaccaggcagcttcccaaggccctgactttgtcgaagcagaaagctgtggctacggtttacaaagcagtccccggtttctgaccgtctaagaggcaggagcccagcctgcctttgacagtgagaggagttcctccctacacactgctgcgggcacccggcactgtaattcatacacagagagttggccttcctggacgcaaggctgggagccgcttgagggcctgcgtgtaatttaagagggttcgcagcgcccggcggccgcttctgtggggttgctttttggttgtccttcgcagacaccgttttgctcctctgaactctctcttctccccctggccgtggacccgggagagcaaagtgtcctccagacctttcgaaagtgagaggaaaataaagaccaggccaaagacccagggccacaggagaggagacagagagtccccgttacattttccccttggctgggtgcagaaagacccccgggccaggactgccacccaggctactatttattcatcagatccaagttaaatcgaggttggagggcaggggagagtctgaggttaccgtggaagcctggagtttttgggaacagcgtgtccccgccgagcctgggagcccgtgggttctgcaaagcctgcgggtgtttgaggactttgaagaccagtttgtcagttgggctcaattcctggggttcagacttagagaaatgaaggagggagagctggggtcgtctccaggaaacgattcacttggggggaaggaatggagtgttcttgcaggcacgtgtctgataggaggtgaaacagaatgtgaaatccacgttggagtaagcgtccagcgctgaatgtagctcggggtggggtgggagggccctggtgtggatcgtggaaggaagaaagacagaacagggtgctagtatttaccccgttccctgtagacaccctggatttgtcagctttgcaagcttcttggttgcagcggccttgcctgtgcccctttgagactgtttccagactaaacttccaaatgtcagccccttacccttgacagcaagggacatctcattagggcatcgcgtgcttctcatctgtgctcagcaggcccgagataggaacagaggggcgttggagatgccacttccaccagccctgggttgaaggggagcgagggagacaccttttacttaaacccctgagcttggtcagagaggctgaatgtctaaaatgaggaagaaaaggtttttcacctggaaacgcttgagggctgagtcttctgcccttctgactcccccagcaaatacagacaggtcaccaactactggagatgagaaagtgccatttttggcacactctggtggggtaggtgcccgaccgcgtgtgaaaaagtgggaaggagagatttctgcgcacgcggttcagcccccaggcgcggtggcgcattcaggtactcagacgcggttctgctgttctgctgagaaacaggcttcgggtaggggctcctagctccgccagatcgcggagggacccccagccctcctgcgctgcagcggtggggatagcgtctctccgtaggcctagaatctgcaacccgccccgggtcctccccgtgtccttcccgggcgtcccgccggggatcccacagttggcagctcttcctcaaattctttcccttaaaaataggatttgacaccccactctccttaaaaaaaaaaataagaaaaaaaggttaggttatgtcaacagaggtgaagtggataattgaggaaacgattctgagatgaggccaagaaaacaacgctcgtgcaaagcccaggtttttgggaaagcagcgagtatcctcctcggcttttgccttatggaccccacgcagtttttgcgtcaaagcgcattggttttcgagggccccctttccaccgcgggatgcacgaaggggttcgccacgttgcgcaaaacctccccggcctcagccctgtgccctccgctccccacgcagggatttatgaatgcaaagagaagcgcgaggacgtgaagtcggaggacgaggacgggcagaccaagctgaaacagaggcgcagccgcaccaacttcacgctggagcagctgaacgagctcgagcgactcttcgacgagacccattaccccgacgccttcatgcgcgaggagctcagccagcgcctggggctctccgaggcgcgcgtgcaggtaggaacccgggggcgggggcggggggcccggagccatcgcctggtcctcgggagcgcacagcacgcgtacagccacctgcgcccgggccgccgccgtccccttcccggagcgcggggaggttgggtgagggacgggctggggttcctggacttttggagacgcctgaggcctgtaggatgggttcattgcgtttgtttttcaccaacagcaaacaaatatatatacatatatattatacaaataacaaataaatatatatgttatacagatgggtatattgtatatattatagatatttgttcgtccttggtgcaaagacacccggtgaacccatatattggctcctgactgccttcggttcccctgggattggttataggggcaacacatgcaaacaaaactttccctggattatacttaggagacgaagctacagatgcgtttgatccagagtgttttacaagatttttcatttaaaaaaaaatgtgtcttttggcccctgattcccctccgtcttcccgtgtggctgcattgaaaaggtttccttaggatgaaaggagaggggtgtcctctgtccctaggtggagagaaacagggtcttctctttcctccgttttttcacctaccgtttctatctccctcctcccctctccagccctgtcctctgctacaaaccaccccctcctccctccggctgtggggagcgcaggagcacgttgggcatctggatgagcggagactattagcggggcacgggggctccccgaggagcgcgcgaattcacgctgccccatgagaccaggcactggggggcggaggggccttgggtgtgcgcagagggacgggcgggcagagccttcctccgcattctaaacattcacttaaaggtatgagtttatttcaggggtgctgctgggagagcctccaaatggcttcttccagcccctgcctgacagttcagctcccctggaaggtcaactcctctagtcctttctcctggttctgggcaggacagaagtggggggagggagagagagagagagagagagagagagacggtcaggatccccggaccctggggaccccgtcaaaaataaatgaaattaagattgccgaccagagagagaaccgtgacaaagcaaacggcgttcaaagcaaagagacgaactgaaagcccgttcccgtaggactggttatgaggtcaacacattcaaacacagcttgctctcgattttgctgagcagaggaagatacagatgcatttgatccaaagtgtgttacatctttcattatatgtgtgtctctatatataaacatatataaatatataaacatacataaatgtatgtaaatatatataatctatatacatatataaatatataaacacatatataatatataaatctataaacatatataatatataaacataaatatataaacatatataatatataaatatattaacatatataaaatatgtataaatatatataaacatataaacatatataaatatataaacatatataaatatatacaaacatattgtatatatataaatatatataaaaacatatatatacatataaaaatatatataaacatatatacatataaagaaatatatataaacatatatacatataaaatatacatatataaacatatatatacataaaatatatatataaacatatatatacatataaaaatatatataaacatatatacatataaagaaatatatataaacatatatacatataaaatatacatatataaacatatatatacatataaagaaatatatataaacatatatacatataaaatatacatatataaacatatatatacataaaatatatatataaacatatatatacataaaatatatatataaacatatatatacatataaaaatatatatattaacatatatatacatataaaaatatatatatatttttggcccctgattcccttcggttcctgtgggatgggtgattgagtcaacacattcaaacacaacttttccatcgatgttgcttaggagatgaggatacagatgcgtttgatggagagggttttacgagctctttcatttaaaaatatatatatatatatatatatattttggctcctgattctcttccgtcttcccatgtggctgcattttaaaaggcttccctaagatcgttaggattaaatcaaccctccccaggcatctttaccgagggctgtggtccccaaagcgatacagcccaggagggagagaggctttggtgacttggaggaaggactgtgtccctccttagggcgtctgtggcctcagtgagggaaggaagctgcatcagacaggggtttcctcgctgtccacccctctggcagaagatggattgggctgccccgtataaattaatgaaaagattaaagtttcgctaaaggggacatcgagtttatgtgtcatctcctggtgtctgtgtgcctgggatctgcaatatatcccagcccttgatgtactgtttctataaaaataaattacttgtaatttaattccacactatttctttccgtagtctattaccgacgagagcacgttagttcagctgcggaaaattggttgtggggtgtgtgcggaccccgagaacgccctaaaataaagacaaatcggggacaagctgggggttatcgattgcaggggtcgcatgaaaatttaacgacggtaaataataataacaacaaacatgggaatgcaataaaagacataattctccatcgccgcggggggaaaggatcctatagtaaaggcgagtgcgctttgaggggtcataaaaatcaattagttccaacacccacgtcccgcgttgaggggacggggacgagcagggacagaaaaagaaaccatatttgaatcccatctctctgtgaattcttgggtcacatgcgtctcagtacagcccgtcccgtgctgtgaccggatagagtttcaatttactgtggaaatttgctgtaaataaattgagcatccgatagaagctgttgctgattaaccttttatttttagcgtggccctgcaaagtcgtatcacccagctgtcaggcttctaatcgaaagttatgagaccacggtgaggggcaggcggtaatttaattacaacaaatatctttgggtttatggcgcagagctaaattaaatgtcattattcactgtctgtaatggaaatcaaaaggaaatcgcattacggcatttgggaaagaaagcggggagtgctctttaatgaagaaataactgtcttaagcagtgtcacacacttcacttaccatattcgggcctaattggaatggatcgtgaatcactccaagactgatttattagcgcttcacgcagcggctaattcatcacttgtattcttcatcatttttttttttcctctcgccgtgttgaagggagagtgaatgaggctttccacgtttcaggaggattttcttttttgaaaaatgcccttccagaggcttttgggtggctggcttgctttctgggccctggaggagacaggcggagagtccaggtgggcatggagaggcacagtggcaggtcacctggatggtcagtggaggtggaggtctgaaggcgccagctttggaaattattggtgaatttcgatgtcagcaccaggcaggggcctttttggcgggggtgtgagggaggatgactttgctgggaaacaggatcaggttctccaggcgcactgcagcccggtaggacccactttggaaatgaaaagccagttccgaaagctgggctggaagcttccgtgttgggttcaagagcaagttcacgttgcgctgtgtagactcctggctgctcccaaactctgagggttttctgaggttcccttcataggggcaccggccctgggccatgcacagtgtgtaagggtggctgtgggccgagggacccagcacgtgttttgcccacaacagccggagtgactggttcactcaccgccttggcggaggacgcctgttctctggacgaatcatttctcttgggtggtgactgccttgtgggtcaaggtgcaggttttctgccacagaaaacctgttaggaggaattaagcgactaagactgtcagggaggtggtggtgggggagaggagggggtggtgtccagattaccaggcataggctaaactgcctgcactctccagctggtctgtctgtggaggaggggattgtcaatactgggagagcagaggaggctcgtaggaggtgagagggggtggaatttgcatgcaaatcttcacatgaggcctgtgtgaatttctccagcctcctgagggtcccctgcgctattgcactcaacttcttgatagtttaccccaagactcagaagtccttagaggggcagaatgcccccaccacaaagcctgctatccttgggcgtcctcatgacccttggtcatgaatgggaccctttcatgtatggggacccttggtaatatgaatgggacgccttcagctccccagggcttccgaggaggccgagaagggcaaagacacttccgaggaggccgagaagggcaaagacattttctgggcttggtgtgtcaagagctagattggagaaggggctggatttggaactctttagccatcagctcaccctctccgtttgtggctaaagtctgaaggtggaaacttcggttctcctacagggtctacaggagttggggggcggggcgcccacacagaacgctggaaagttcgacagtccacttccactggctcggaactcactttttcaccttaagttcatcagcggtaacgcataggtctcacttaggcagggcacggatgatttaacaatttctacttctaggtcaggtgcggtggctcacacctctaatcccagcactttgggaggcccaggagggtggatcgcttgaggtcaggagtttgagaccagcctggccaacatggtgaaaccccgtctctactaaaatacgaaaattagccaggcatggtggtgagcacctgtaattccagctactcgggaggctgaggcaggagaatcgcttgaacctgggaggtggacgttgcagtgaggtgagatcacaccactgcactccagcctggatgagagagcaagactctgtctcaaaaacaaaataaaacaaaaacaaaacaaaaatcaaaaaagaaaacccaatttccagttctaggccaggtgcagtggctcacgcctgtcatcccagcactttgggaggcccaggagggtggatcgcttgaggtcaggagttcgagaccagcctggccaacatggtgaaaccccatctctactaaaaatacaaacgttagctaggtgtggtggtgtgcgcctgtaatcccagctactcgggaagctgaggctggagaattgcttgaatctgggaggtggaggttgcagggaggcgagatagtgccactgcagtccagcctggaccagagagcaagactccgtctcaaaaacaaaagaaagcaaaaacaaaaaacaagagaccagcctggccaacatggtgaaaccgcgtctctactaaaatacaaaattagccgggcatggtggtgggcacctgtagtcccagctactcgggaggctgaggcaggagaatggcttgaacctgggaggtggagcttgcagtgagccgagatagtgccactgcactccagcctgggcgacagagcgagacttgatttcagaaccaccaccaccacaacaaaacaaaacaaaaaatccaaaaaaaccccaatttccagtactaggtagtcagtgatgcagggctggagacagaggggcggtaagtgtctgggcgcccaccatcagtcacctcccagctcccagaggtgcaaagtgcttggttcagcctcatgggaaggatgctccctggggaggctgggctgggttcacagggctcttcacatctctctctgcttctccccaaggtttggttccagaaccggagagccaagtgccgcaaacaagagaatcagatgcataaaggtgggtgtcgggactggggggacctgaagctgggggatcctgctccaggagggatggggtcgacgaggtgctggctacacccaggaccaccacactgacacctgctccctttggacacaggcgtcatcttgggcacagccaaccacctagacgcctgccgagtggcaccctacgtcaacatgggagccttacggatgcctttccaacaggtagctcactttttcttcctctgaagatccctagggacctgctgctcccttcccctttcccctatttgctgccgcatcctgacactcctagtccctccctgcccctgcagacttctcagctggcccttagaaaaaaagcctcttttccgaggaggcatttacaggcaccttggcacctatgaaatcaggctgggccaggcggggtggctcacacctgtcatcccagcactttgggaggctgaggagggtgcatcacctgagatcaggagttcaagaccagcctggccaacttaacgaaaccctgtctattaaaaatacaaaatgggtgtggtggctcacgcctgtcatcccagcactttgggaggccgaggcaggtggatcacctgaggtcaggaattcgagaccagcctgaccaacatgctgaaaccccgtctctactgaaaacacaaagcttagccgggcgtggtggtgcacacctgtgatcccaggtacttgggagggagaatcacttgaacctgggaggtggaggttgccgtgagccaatatcgcgccactgcactccactctgggtgacagagtgagactccaagactccatctcaaaaaaaaaaaaaaaaaaatcaggctgtaaaaatccacttttgggaaggtgaacacacacaagcccaaacagaaatctgacaaaaaccagaggggtgaaaagtccacacagtcaggcacccccacctggcttgctgcctggttaagaagggcgcagatgcctgtgcctggataccagagatgggacagacacccattcccttttcatcaccacccccgagtgcccgagggcctggggcgtctgcctggcccctggcccctggcttgggctctgcacctctgagctggagacaccctactcagctccccacttactttggagtgagcagcgcttgggtgcccagcgtggatttggggcttccagggagtcggggttcggtcgcggagcccaagcttcccaagggcgcccccgccctgccctggcttagtggtggggatgggatggggggaagcggggagctgcgtggaaggaggtgaagggtcacaggaggagagagcgcagcgcccacgtgcgccctgcctgaacgcgcagcgcagcgcccggctgcggtgccccttgccccttcggtccctaatttgggggtcgggagtgcatgcgcgggcggaacgggcttggggggggggctctggcagggcggacgcgtggcctcccttcttcaccgttttattccaaggggacaggctggggattgtatttgggcgcgtgtttggctgagggtgcagggacttggggggtggcggtggggagcgcggaaggtataaacgtataaatcataagtaaacaactcagaaatggaccccgagcgctggtcgccgctagctctccagctctccctggcccaggcccgaaggagaggggtccgcatccctccgcggttctcctctcctgggtacctggccttgaggtgggggaacgagcctacttcttgtaccgtcttttgccgacggcgggacccagtgaaattaggccgttggagcccgcaggcctgcctggctttgcgcaccggagtcttggggacctggtgtccccgggaaaaacttggggacctggtatccccgggagaggcttggggacctggtgtcccgggagaggcttgggtacctggtttctctggaagaggcttggacacctggtgtcctgggagggcctttgggacctggtgtcctgggagaggcttggagatctgttgtcctgggagaggcttggggacctggtgtccctggagaggcttggggacctggtgaccttggagaggcttggagacctggtgttctgggagaggcttggggacctggtgttctgggagaggcttggggacctggtgtctctggaagaggcttggacacctggtgacccgggagggccttggggatctggtgtcccgggagagccttggggacctggtgtcctgggagaggcttggggacctggtgaccttggagaggcttggggacctggtgtcctgaaagagccttggggatctggtgtcccaggagaggcttggggacctggtgtctctggaagaggcttggacacctggtgtcctggggagaggcttggggacctggtgtcctgggagaggcttggggacctggtgtcctgggagaggcttggagatctggtgagccgggagaggcttggggacctggtgtcccgggagaggcttggggacttggtgtcccgggagaggcttggacacctggtgtcccaggagaggcttggggacctggtgaccttggagaggcctggggacctggtgacccgggagagccttggggacctggtgtcctggggagagccttggggacctggtgaccttggagaggcttggggacctggtgtctcgggagtgccttggggacctagtgacccgggagaggcttggggacctggtgtcccgggagaggcttggggacctggtgtcctgggagagccttggggatctggtgtcctggggagaggctgggggacctggtgtctcgggagagagccttggggacctggtgacccgggagaggcttggacacctggtgtcccgggagaggcttggggacctggtgacccgggagagccttggggacctggtgtcctggggagaggctgggggacctggtgtctcgggagagagccttggggacctggtgacccgggagaggcttggacacctggtgtcccgggagaggcttgggagcctggtgtcccgggagagccttggggaccaggtgaccttggagaggcttggggacctggtgatcttggagaggcttggggacctggtgtctcgggagagccttggtgacctggggacccgggagaggcttggggacctggtgtccccgggagaggttacgggggctggttgggggagagaacgttgtgagccaaagtccctgaatccctgcgaagagagcgcatcgggagctccccctgagggcgttccatttgtggacccccctcccatgcgctttgcagggagctgttcggattcccctggcccggctcccgcggatgcatccagtggcagcgccaattctgggccagggggaaggaggaaaggcgggtgtggggtggtctccacggctggagaaggggcgacgctccctaggggagaagaggcacgttggaggtttccgggggcgcggggcggagcaggccccccagtccccatcctgcgccctcaccccgccgggtccgctcccgcaggtccaggctcagctgcagctggaaggcgtggcccacgcgcacccgcacctgcacccgcacctggcggcgcacgcgccctacctgatgttccccccgccgcccttcgggctgcccatcgcgtcgctggccgagtccgcctcggccgccgccgtggtcgccgccgccgccaaaagcaacagcaagaattccagcatcgccgacctgcggctcaaggcgcggaagcacgcggaggccctggggctctgacccgccgcgcagccccccgcgcgcccggactcccgggctccgcgcaccccgcctgcaccgcgcgtcctgcactcaaccccgcctggagctccttccgcggccaccgtgctccgggcaccccgggagctcctgcaagaggcctgaggagggaggctcccgggaccgtccacgcacgacccagccagaccctcgcggagatggtgcagaaggcggagcgggtgagcggccgtgcgtccagcccgggcctctccaaggctgcccgtgcgtcctgggaccctggagaagggtaaacccccgcctggctgcgtcttcctctgctataccctatgcatgcggttaactacacacgtttggaagatccttagagtctattgaaactgcaaagatcccggagctggtctccgatgaaaatgccatttcttcgttgccaacgattttctttactaccatgctccttccttcatcccgagaggctgcggaacgggtgtggatttgaatgtggacttcggaatcccaggaggcaggggccgggctctcctccaccgctcccccggagcctcccaggcagcaataaggaaatagttctctggctgaggctgaggacgtgaaccgcgggctttggaaagggaggggagggagacccgaacctcccacgttgggactcccacgttccggggacctgaatgaggaccgactttataacttttccagtgtttgattcccaaattgggtctggttttgttttggattggtatttttttttttttttttttttttttttttttttgctgtgttacaggattcagacgcaaaagacttgcataagagacggacgcgtggttgcaaggtgtcatactgatatgcagcattaactttactgacatggagtgaagtgcaatattataaatattatagattaaaaaaaaaatagccgtgcactcttgaccccgtcagcgtccaacgtggaaaaggcgttacctcttctcccagcgctggccgcctggccactgagggccctttgcaaaaatcacgggtgtagagatggccctgggcgcgctgggagtgtggttgtgtttctgaaggggataaaagagggcacggtggtgccaagatatcagtttggtacctgagctgtttctggttgggaagcgtaaaagccagggagagatccagagagttttcaagtttttgcagatgtaggtggttccagcttttctttctcccctactccatcttctgcgttcccccagttcttttatttctttgttttttatttttgagacagagacttgctttgtcgcccaggctggagtgcagtggcgcaatgtcagctcactgccacctccgcctcccgggttcaagcgatgctcctgcctcagcctcccgagtagctgggactacaggcacctgccaccacccccggctaattttttgtatttatagtagagacggggtttcaccgtgttggccaggctcgtctcgaactcctgacctcaggtgatctgcccgcctcggcctcccaacgtgcccccagttttataaacagcagatagcaacttgtcgtcacagctggcatgggctggacagttgcttgaaatgacctaaccaaaaacattcaagggttctgcccccagatttcgggagatccacgttccatgttctgattggttttctgggaacacagcaaggggtttggtgacctccgagaagatccatctgcatgattggcattagttaccacagcctgcccagagagaaactatcttctcccaacatttactaacatccactggtcaactctcttatttccataacacatttgcatctttctggattcaagcttggtggttttctttcctaacttctgatttagatacttctccctgaggtggggataaaagaaaaaaaaaaacaacttctttttttcttccgcataacactttctatcttgtcactgagctgaactgtagatccatttggacccgtctcatttgtatcttctgatattctttatacaaaccaaaagtccccttcaacattttttatgtcaaaatgttacaaccgctgtaaaatgacggagagagagagaaagaatcccagacattaacggtattagagagtttgcctcattcatccatttttcttaaaagctggaaattaaaaaaaaaaaagagagagagaggctttaatagttaagctgaaatttttatcgaaaagaagaattgcattttgaatctttgggaagtaggttcattcatcagagtatgtaaccctttggaaaagtggttggtaagatatgtacagccctagattttttttttttaaccaaaaaggctgagtaattttgaaaaatcgaaacataacagtgtgtcatcatttcctcccaagaaaaagctcactccacgtgagtagaaagacatctacctggtccctgtagaatctgaacgtttctctttagagacggaatttcaatcttgtcccccaggctggagtgcagtggcacaatctcggctcaccgcaacctccgcctcccgggttcaagccattctcctgcctcagcctcccgagtagctgggattacaggcacctgccaccaggcctgggtaactttctggtatttttagtagagacagggtttcagcctcccgagtagctgggattacaggcacctgccaccaggcctgggtaactttctggtatttttagtagagacagggtttcagcctcccgagtagctgggattacaggcacctgccaccaggcctgggtaactttctggtatttttagtagagacagggtttcagcctcccgagtagctgggattacaggcacctgccaccaggcctgggtaactttctggtatttttagtagagacagggtttcggcctcccgagtagctgggattacaggcacctgccaccaggcctgggtaactttctggtatttttagtagagacagggtttcggcctcccgagtagctgggattacaggcacctgccaccaggcctgggtaactttctggtatttttagtagagacagggtttcagcctcccgagtagctgggattacaggcacctgccaccaggcctgggtaactttctggtatttttagtagagacagggtttcggcctcccgagtagctgggattacaggcacctgccaccaggcctgggtaactttctggtatttttagtacagacagggtttcagcctcccgagtagctgggattacaggcacctgccaccaggcctgggtaactttctggtatttttagtagagacagggtttcggcctcccgagtagctgggattacaggcacctgccaccaggcctgggtaactttctggtatttttagtagagacagggtttcggcctcccgagtagctgggattacaggcacctgccaccaggcctgggtaactttctggtatttttagtagagacagggtttcggcctcctgagtagctgggattacaggcacctgccaccaggcctgggtaactttctggtatttttagtagagacagggtttcagcctcccgagtagctgggattacaggcacctgccaccaggcctgggtaactttctggtatttttagtacagacagggtttcggcctcctgagtagctgggattacaggcacctgccaccaggcctgggtaactttctggtagttttagtagagacagggtttcagcctcccgagtagctgggattacaggcacctgccaccaggcctgggtaatttttttgcatttttggtagagacaggtttttgctgtgttggcccggctggtctcaaactcctgacctcaggttgacctgcccgctttgtccctcgcaaagtgctgggattacaggcgtgagccaccgcacctggcctgaatctgaacttttaaaagggagttactgactctcaactgtgcggggacggtttcagtttgatttaatatggaaagagggccaagtgtcatcctcacaaatgggtccccgaagcagatcaaacgcagagaactgtgagggtgggacacgagtgtctgtggacactggctgcctttggcttttctcctgcgagagaagttgggtgactttctgtaggtggatgagtgatccctgaatgagtgtggggtacgtgtatgctagctgcttctttctccctgaaactctcggatggaaggaagtaagaaattcagcttgggctgtgaccagttctcaccaccaacgccctcttctctctcccttctccttccttccttccttcctttctttctttttctttctttctctctttctttcttttctttctttctgtttctttcctttttatctttctctctttttctttctcttttccttttttgtttctttctttctttttctttctttctttttctttcttctttctttcttcgatgaagtctcactctgtcacccaggctggagtgcagtggtgcaatcccagctcactgcatcctctacctcctggcttcaagaaattctcctgcctcagcctcccaagtagctgggatgacaggcacccaccaccattcccggataatttttgtattttttagtagagaccgggtttcgccatgttggccaggctggtcttgaactcctgacctcacatgatccacccgcctcagcctcccagagtgctgggattacggggtgaggcaccgcgcccggcctcctctctctttttctgagatgtttaggaaggactgggctgatggggaccctctgtatgtgatgtgcgtgggtttggtttcccggaaggccctccagagacacgtttgcgtgaacattcagcatggaaacaacatacgtctctccacaggaggtgagaaattgaatttatggggtgggtgtacgctggcgattcttggtgctttttgctcaaaacaaggttcttttgaaagtcacgttcctgctttccctgtggcttcccggtgagctcgctcgcagagcaaggaataccacccagagagcaacgtgggctgtgttccgatgtaacgccgttgcagagagaggatttggtgtgtgagatccgtaccagctccagcacactgataggaacacgttgctggccgaactgaacgatgctgggttgggtcctgattgatacgtattttcttccctcctctccccaaaacttggccaaatagtccgtggagggttgtcagtcgccgcagttgagcaaaaaacacttcttcctttgagtggctgttctggtgaaatctgtttctgacatatccacttttctctctcttttctctctctctgactgcgaagcacccacagggagaaggaattggatgtatcggatgttgctattagattttctttctccgttcgagtctctgactggtgcatactttgcaaaggtgtgttcctggcaattgccaagagttagaaaaatgcaccttctctggtggccgttggggtgttgtttcacaggcagtggtgacagggccccttggctgtggctgtcttctccagcgccgtggataaagagatgggacagattctgtgcctctgtacgatttagagcgtaactgaccgcgtccaacacccgtttttccacttacaaagctggtggtgcgacgggcttggtgtctcccgtacgggaaggaggcctttgggccgctccaaagacgccctgtcgtaggaatggcctctccatcccgccaaagtccagccaggcccccgaaatggtcccatttccttggaagcctgagtttctgttctggtcttgctgctgtccttggccacgtcagcacgtgggagcatctgtggataccgcagagtctggggacagctgggcgtttaaccgaaatgaagccgagacgggtttcaggttttggtgccaagctctggtcaggatgaaagggaaataccagagtcctctgtcctcgcctctgggtttcatgctgacctttctaacatttgttttcccctaagaacaagcagaagcctccagctccctttagctccacagttttcccggggacatagcgaggatggcacacggcagccactcccacgacacacatttcggaggcactttgctggaagccgcttgtctcctccagctttgggaggtctggggaggagagaggctttcggtggacacgtttgacattaaaaaaaaaaaaaaaaaaaaaaaaaaactggtgcctaatttattaaagagaattagcttagcgagtatatgctgatattcttcgacacacgtgggtaagttgatgccatttataaatgttttattgaaatttgatatttaatgagaagccggttaaggaatgtagacaatatcccgtttcaaagctatgaaatgtgctatttattgaaaggggatgtggcttcacgagttcagcccattgtacgtgcaggtcccgtgggaaggaggcaaaagcccctgcttcttactttgtgatgtatgtgcatttgttatttatttttttttccttggtcggacgttcataaatatgtactattttaattatgtcgagtgtaaatttgacatcgcgttgcatttatttttatatttctgaaaactgttgctttttctttttccctcccccattgacgacatagcggcccccgcgtccgggttacaaatacatctacagatattttcagggattgcttcagatgaaaacaaatcacacaccgtttcccaaaccaacagtcttcacatttctatccctctgttattgtcggcaggcggtgaggggtagaaaaaaaacaaacaaacaaacagaaaaaaaaaccaaaaaaaaccaccctgagtttctctggtgacgccctcattctcctaacgttcaataatctcaatgttgagttgcagcaacagactgtatttttgtgacgccccgtagtatgaatgtacatcttgtaaaactgagatataaataaacttataaatatttgtattcaagtgttaaaaaaaaaaaaattctcaacctctcccctgaggacaggcttattggaaaaaaaaaaaaaaaaaaaaaatcctgagtcggccgtggctgaacacagagtgttgttctgctccgtgcatttccagggtgggtacccagtgttgccccccagccttagatcgggaggtaccattgacttttgcttgtatcccatccccttcctttactgaaacctacctccccgcttctcagccaacgtccccccagaaggtggcaaaaaaaacagaggaaaaagccctgatttgaatcaagtcagagctgctaattctccactttctttaattaattaatttatttttttttttgagactgagtctcgctctgtcgcccaggccggaggagtgcaggggcgcgatctcggctcaccgcgacctccgcctcccgggttcaagcgactctcctgcctcagcctcccgagtagctgggatgacagtcacctgcaccaccgcgcccggctcatttttgtatttttagtagcaatggggtttcaccgtgttggtcaggctggtctcgaactcctgacctcgtgatccacccgcgtctgggcccggccggtgatgtgtgtgcttttaacttttattttgttccagttttcgacagtggcacggattttccagcacggtcttgcaaggatgattgagtcatttttgagacaaaaaatataataataataaatggaaaaagaaatcgacttttaaaaatgacaaatttttttttttttttttgcatagatttttctctctttatgtaaaggaaagttcatgattggatttggccggcctgactgcttcccggctgtgataaaaaacacatgtgagctgggagggaagtgggggagggacacagctgcccacacagggttcccaccgcggttacagggtgggcagtgctgggggagctttctctgtggggggctcagagcctgaggacaggtgagcctctccgacacctccccagttgcctggagtctaaaccgtccgttgtctgtaccgtccgttcttcctgctgactcctggtagttcctgaaagcttctcttggccagagaaggggtttcagaggccgtgtgtccaggccattctgcaaagtgcaacttgaccgttcctttccttttctggcctgcgtggtctgaagctcagagccctctcttcacccagcctgtgtgtgtcttgccggacagaagaaaaatggtgctttttgcgtgttagcagaggtgcttttcatggctgacctcaacgcgtccatctccagcctgttttttaggggcaaacgcaggcaagttctgaatgcacacagttatttcatggttaaactattcagctttggccgggcgcagtgtggctctcacgcctgtcatcccagcactttgggaggccgaggcgggtggatcacctgaggtcaggagttcgagaccagcctggccaacacggtgaaactctatctctactaaaaatacaaaaattagccgggcgtggtggtgtgtatctgtaatcccagctactcaggaagctgaggcaggagaatcgcttggacccaggaggcggaggttgcactgagccgagatcgcgccattgcactccagcctgggcgacagagccagacgctgtctcaaaaaaatgaataataaaataaaataacaggaactaaataaaataaaacgttcagctttgttctgcaaatccactcctattgttttacgtggtttgagagactctgtcccttagaaatagatgtttgttgccaattgtaatgaatctgtttcaaaaatgaacagaatattcaaatggtttgagagatcttttcccttagaaatagcttgttgccaatcacaaagaatgtttttcaaaaatgaatggaatcttcctggatatcgcttccagatcttcattttttttgcatagttcaacctgaaaagtaagtgtctcagccctgaatttctttctgatttttccatgggttgtcttgcagacttctctggacttgaccacatttaaaaaaaaaaaaattaactttttcacacggacacggtttcaataggaatgagatctttgagtttttatgtaacagattcttaccatcagttctcagattcccaaattacacacaaaaagccacggacttcgcctcctgctaacatgtccttctgtttctgaggcttctgttggtgttagactttcatgtttaatagcagacaatgtagggatttaaagaaaaatgcagagaaagcaaaaacactgaccaaacacacggagataagctttctaaagcctttgttcttggagttgtcgttaaaaaaaaaaagttgttttaaactttgcaagcatgcctatattgaactcataagcaagagagccaagaaaaatagtgtcggtcgtctactctacacgttttcccaaaacagacgtattttaatttcttttgtttgaactcacagatgctgagagttaaaagttaaatttttgtcatgaacaatagtggccaaaaccacagttacttttgcactatagcataataagaaaaatacaggctgggctcggtggctcacacctgtaatcaaagcacttttggaggcgaaacagccagatcccttgagcccaggagattgagaccagcctgggcaacatagcgagaccctcatctctacaaaaaaggtttgttacatatgtaacaaacctgcacattgtgcacatgtaccctaaaacttaaagtataataataaaaaaattaaaaaaaaattcaccaatcaactgcctgctggtgccttcaagagactcacctaacacataaggacttgcataaacttataaaacaattcaatggaagaatccttgaaagtattctgagaagacagtataataaactgatttctaaaaaggctataaaaaattgaataaatcattgttgggcatcctgtgctgaaatataatgcagccaataaaaattacaaaatgaataaacattttataacaattaaaaaaagtcaaataattaggcaggcatggtggtgctctcctacggttgaagctattcagcaggcaagaggatactttgtttttgttttttaattttttttgagacagagtctcgctctgttgccaggctggagtgcagtggcgtgatctcagctcactgtaatttctgcctcccgggttcaagcgattttcctgccccagcctcccgagtagctgggattacaggtgcccgccaccacacctggctaatttcttttgtatttttagtagagacgaggtttccccatgttggccaggctggttttgagctcccgacctcgggtgatccacccgcctcagcctcccaaagtgctgggatgacaggcgtgagccaccgcgcctggcccaggaggattatttgatcccaggaggtggaggctgcaggaagccatgattgcaccactgcactccagcctggctgacagagtgagaccacatctctaaataaatgaataaatacaggcagaaactttttttgttttgttttgatggagtcttgctctgtcaccaggcaggagtgcagtggtgccatctcagctcactgcaacctccacctcctgggttcaagcaatcctcctgcctcagcctcccgagtagctgggattacaggtgcccgccaccacgcccggctaattttttgtatgtttagtagagacgggatttcaccgtgttagccaggatggtcttgatctcttgactttgtgatctgcctgcctcagcctcccaaagtgctgggattacaggcatgagcccaggagttcaagaccagcctcagcaacaaagtgagaccttttctctccaaaaaatcaaaaatttagccagctgtggtggctcctgcccgtgatcccagtactgtgggaggctgaggcagaattgcttgagcccaggagttcgagaccaacctcagcaaaaaggactctctctctgtctctctctctctctctctctctctctctctctctctctctctctctatatatatatatatatatatatatatatatatatatatatatgagtttcaaaaattgctgggtgaccagctcatctactggttttccccttgggaaagtgaaattgtcatgtattgaagatttccaaggaagttgtattgaatgagaaacaaactcaatctgttcgtgtttaaagagctgcagtgcgtttgccgtgtttcccataaaactgcacttccaaaagacacgctgagaaaggagaccaggatttgtaattcagaaattggaaagcaagttaggctggacgtggtagctcacgcttgttgtaatctcagcactctgggaggctgaggcaggaggatcacttgagcccaggagttcaagaccagcccgtgccacatggtgaaaccctgtctctccaaaaaataaaacatttagccagatgtggtgactcatgcctgtaatcccggtattctgggaggctgaggcagagttgcttgagcccaggagttcaagaccagcctcggcaacaaagtgagaccctgtctctccaaaaaataaaacatttagccagctgtggtgactcatgcctgtaatctcagtactctgggaggctggggcagaatggcttgagcccaggagttcgagaccaacctcagcaacaaagtgagatcttgtttctccaaaaaatcaaaaatttagccagctgtgctggctcatgcctgtaatcccggtactctgggaggctgaggcagaatcgtttgagcccaggagttcgagaccaacctcagcaacaaagtgagatcttgtttctccaaaaaaatcaaaaatttagccagctgtgctggctgatgcctgtaatcccggtactctgggaggctgaggcggaattgcttgagcccaggagttcaagaccagcctcagcaacaaagtgagatcttgtttctccaaaaaataaaacatttagtcagctgtggtggctcaagcctgtgatcccagcattttgggaggccgaggcgggcggatcacgaggtcatgagatcgagaccatcctggctaacacggtgaaaccccgtctctactaaaaatacaaagaaaattagccgggcgtggtggcgggcgcctgtagtcccagctactcaggaggctgaggcaggagaatgccgtgagcctgggaggcggaccatgcagtgagtcgagatcgcgccactgccctccagcctgggccacagagcaagactccgtctcaaaaaaaaaaaaaaaaaactgctgcccaagctgtgtttgcaccactgccctccagcctgggcaacagagcaagactccgtctcaaaaaaaaaaaaaaaatgctgcccaagctgtgtttgcaccactgccctccagcctgggcaacagagcaagactctgtctcaaaaaaaaaaaaaatgctgcccaagctgtgtttgcaccactgccctccagcctgggcaacagagcaagactccgtctcaaaaaaaaaaaaaatgctgcccaagctgtgtttgcaccactgccctccagcctgggcaacagagcaagcctcagctttctgccatctccacaaccaagaaagcaattcacacagaaatcagtgcatcgtgcagtgacctcttcagaaaaccaatgagttttccacctgaggaactgtttctgagccccattcagaagaacacatccctgtaactgcagggcagatttactcactgatgcctgtttaaataaagcttccagcctctgcatggggtctgtctggaagctcctgtatctgtcccacattcttggaatcacaatgcacccttgggaggaagatatgtatttaaagggagtggatgttatggtgagaaaatgctgcccatccttctagaagacaaaagccacacaaaatacatcacaagaaccagtttttttcagagaagaacctgcacaaagaacctgctccccccacacccccacacacaggtgaattaacaggatgtatgttttatcataaaagcacaggtttgtttcctatgcactctctgaggatttggccatatgcaaagatgtacaaaaaccttctctttccccagggaaccgtaacccgtctgaaaagatgcccttctcagaagcgagttgaacgattgttggaaaagataaaatacgacgtgcacacacagagtagagaaatgtcacccatgcaaattatgtgtttgaatggaacacattcaggaagctaaatggggtatgaccacacatttgggttgatttatttgacgagtggaaggggcagatggaaatgaatactgctgttttcctttggaaggccatatatgggaataccaagaggattactttggaagtttagcttctccaggtggtctctctctctctctctttttttgagacagagtctcactctgtcacccaggctgcagtgcaatggcgtgatctcggctcactgcaacctcagcctcccaggtacaagcgattctcctgcctcagcctcccgagtagctgggatcacaggtgtgcaccaccacgcctggctaatgtttgtattttcagtagagatgaggttttaccatgttggccaggctggtcttgaactcctgacctcaggtgatccgcctgcctcggcctcccaaagtgctgggatgacagacatgagccagcacgcccggccccaggtggtctttttagcgggtattaaagcagctttctctctgagccttaaaccatgaagatagacagactcagtgtatgggttttagagttgtaattttataaaaataagaaaaagtcgacctatcattgatggttagtattttttgtagcagttgcatgcaatattaggataaggcatgttctcaaaaagaactctttttttttttttttttgagacggagtctcgctctgtcacccaggctggagtgcagtggcacgatctccgctcactgcaagctcctcttcccgggttcacgccattctcctgcctcagcctccccagtagctgggactacaggcgcccgccaccgcgcccggctaattttttgtatttttagtagagacggggtttcaccgtgttagccaggaaggtctcgatctcctgacctcatgatccgtccgcctcagcctcccaaagtgctgggactacaggcgtgagccactgcacttggcctttttttttttttagatggagttttgctcttgtcgcccgggctggagtataatggcatgatctcgactcactgcaacctccgcctcccgagttcaagcgattctcctgcctcagcctcccgagtagctgggattacaggtgcccaccaccatgtcaagataatgtttgtattttcagtagagatggggtttgaccatgttggccaggctggtctcgaactcctgacctcaggtgatccacccgccttagcctcccaaagtgctgggatgacaggcgtgagcccctgcgcccggcctttgtaactttatttttaattttttttttttttttaagaaagacagagtcttgctctgtcacccaggctggagcacactggtgcgatcatagctcactgcagcctcaaactcctgggctcaagcaatcctcccacctcagcctcctgagtagctgggactacaggcacccaccaccacacccagctaatttttttgatttttactagagacgggatcttgctttgctgctgaggctggtcttgagctcctgagctccaaagatcctctcacctccacctcccaaagtgttagaattacaagcatgaaccactgcccgtggtctccaaaaaaaggactgttacgtgga

SEQ ID NO: 2839 - DNA, 28604 bp, human
tgatccacccgcgcgcacgggccgtcctctccgcgcggggagacgcgcgcatccaccagccccggctgctcgccagccccggccccagccatggaagagctcacggcttttgtatccaagtcttttgaccagaaaagcaaggacggtaacggcggaggcggaggcggcggaggtaagaaggattccattacgtaccgggaagttttggagagcggactggcgcgctcccgggagctggggacgtcggattccagcctccaggacatcacggagggcggcggccactgcccggtgcatttgttcaaggaccacgtagacaatgacaaggagaaactgaaagaattcggcaccgcgagagtggcagaaggtaagttcctttgcgctccggctccaggggggccctcctggggttcggcgcctcctcgccacggagtcggccccgcgcgcccctcgctgtgcacatttgcagctcccgtctcgccagggtaaggcccgggccgtcaggctttgcctaagaaaggaaggaaggcaggagtggacccgaccggagacgcgggtggtgggtagcggggtgcggggggacccagggagggtcgcagcgggggccgcgcgcgtgggcaccgacacgggaaggtcccgggctggggtggatccgggtggctgtgcctgaagccgtagggcctgagatgtctttttcattttctttttctttcctttcctttttttgtttgtttgtttgtttgagacagagtctcgctctgtcccccaggctggagtgcagtggtgcgatctcggctcactgcaacctctgcctcctgggttcaagcgattctcctgcctcagcctccccagtagctgggattacaggcatgcaccaccacgcctggctaatttttgtgcttttagtaaagacggggattcaccatgttggccaggctggtctcgaactcctgacctcaggtgatccacccgcctcggcctcccaaagtgctgggatgacaggcgtgaggcaccgcgcccggcctgggtcctgacggcttaggatgtgtgtttctgtctctgcctgtctgccttgtatttacggtcacccagacgcacagaggagccgtctccacgcgccttcccagcgctcagcgcctgccgggcccccggagatcacgggaagactcgaggctgcgtggtaggagacgggaaggccccgggtcagctcggttctgtttcctttaaggaacccttcattattatttcattgttttcctttgaacgtcgaggcttgatcttggcgaaagctgttgggtccataaaaaccactcccgtgagcggaggtggccgggatctggatggggcgcgaggggccccggggaagctggcggcttcgcgggcgcgtcctaagtcaaggttgtcagagcgcagccggttgtgcgcggcccgggggagctcccctctggcccttcctcctgagacctcagtggtgggtcgtcccgtggtggaaatcggggagtaagaggctcagagagaggggctggccccggggatctctgtgcacacacgacaactgggcggcatacatcttaagaataaaatgggctggctgtgtcggggcacagctggagacggctatggacgcctgttatgttttcattacaaagacgcagagaatctagcctcggcttttgctgattcgcagagttgaggtgcgagggtgaatgccccaaaggtaattcttcctaagactctggggctacctgctctccggggccctgcatttggggtgtggagtggccccgggaaatagcccttgtattcgtaggaggcaccaggcagcttcccaaggccctgactttgtcgaagcagaaagctgtggctacggtttacaaagcagtccccggtttctgaccgtctaagaggcaggagcccagcctgcctttgacagtgagaggagttcctccctacacactgctgcgggcacccggcactgtaattcatacacagagagttggccttcctggacgcaaggctgggagccgcttgagggcctgcgtgtaatttaagagggttcgcagcgcccggcggccgcttctgtggggttgctttttggttgtccttcgcagacaccgttttgctcctctgaactctctcttctccccctggccgtggacccgggagagcaaagtgtcctccagacctttcgaaagtgagaggaaaataaagaccaggccaaagacccagggccacaggagaggagacagagagtccccgttacattttccccttggctgggtgcagaaagacccccgggccaggactgccacccaggctactatttattcatcagatccaagttaaatcgaggttggagggcaggggagagtctgaggttaccgtggaagcctggagtttttgggaacagcgtgtccccgccgagcctgggagcccgtgggttctgcaaagcctgcgggtgtttgaggactttgaagaccagtttgtcagttgggctcaattcctggggttcagacttagagaaatgaaggagggagagctggggtcgtctccaggaaacgattcacttggggggaaggaatggagtgttcttgcaggcacgtgtctgataggaggtgaaacagaatgtgaaatccacgttggagtaagcgtccagcgctgaatgtagctcggggtggggtgggagggccctggtgtggatcgtggaaggaagaaagacagaacagggtgctagtatttaccccgttccctgtagacaccctggatttgtcagctttgcaagcttcttggttgcagcggccttgcctgtgcccctttgagactgtttccagactaaacttccaaatgtcagccccttacccttgacagcaagggacatctcattagggcatcgcgtgcttctcatctgtgctcagcaggcccgagataggaacagaggggcgttggagatgccacttccaccagccctgggttgaaggggagcgagggagacaccttttacttaaacccctgagcttggtcagagaggctgaatgtctaaaatgaggaagaaaaggtttttcacctggaaacgcttgagggctgagtcttctgcccttctgactcccccagcaaatacagacaggtcaccaactactggagatgagaaagtgccatttttggcacactctggtggggtaggtgcccgaccgcgtgtgaaaaagtgggaaggagagatttctgcgcacgcggttcagcccccaggcgcggtggcgcattcaggtactcagacgcggttctgctgttctgctgagaaacaggcttcgggtaggggctcctagctccgccagatcgcggagggacccccagccctcctgcgctgcagcggtggggatagcgtctctccgtaggcctagaatctgcaacccgccccgggtcctccccgtgtccttcccgggcgtcccgccggggatcccacagttggcagctcttcctcaaattctttcccttaaaaataggatttgacaccccactctccttaaaaaaaaaaataagaaaaaaaggttaggttatgtcaacagaggtgaagtggataattgaggaaacgattctgagatgaggccaagaaaacaacgctcgtgcaaagcccaggtttttgggaaagcagcgagtatcctcctcggcttttgccttatggaccccacgcagtttttgcgtcaaagcgcattggttttcgagggccccctttccaccgcgggatgcacgaaggggttcgccacgttgcgcaaaacctccccggcctcagccctgtgccctccgctccccacgcagggatttatgaatgcaaagagaagcgcgaggacgtgaagtcggaggacgaggacgggcagaccaagctgaaacagaggcgcagccgcaccaacttcacgctggagcagctgaacgagctcgagcgactcttcgacgagacccattaccccgacgccttcatgcgcgaggagctcagccagcgcctggggctctccgaggcgcgcgtgcaggtaggaacccgggggcgggggcggggggcccggagccatcgcctggtcctcgggagcgcacagcacgcgtacagccacctgcgcccgggccgccgccgtccccttcccggagcgcggggaggttgggtgagggacgggctggggttcctggacttttggagacgcctgaggcctgtaggatgggttcattgcgtttgtttttcaccaacagcaaacaaatatatatacatatatattatacaaataacaaataaatatatatgttatacagatgggtatattgtatatattatagatatttgttcgtccttggtgcaaagacacccggtgaacccatatattggctcctgactgccttcggttcccctgggattggttataggggcaacacatgcaaacaaaactttccctggattatacttaggagacgaagctacagatgcgtttgatccagagtgttttacaagatttttcatttaaaaaaaaatgtgtcttttggcccctgattcccctccgtcttcccgtgtggctgcattgaaaaggtttccttaggatgaaaggagaggggtgtcctctgtccctaggtggagagaaacagggtcttctctttcctccgttttttcacctaccgtttctatctccctcctcccctctccagccctgtcctctgctacaaaccaccccctcctccctccggctgtggggagcgcaggagcacgttgggcatctggatgagcggagactattagcggggcacgggggctccccgaggagcgcgcgaattcacgctgccccatgagaccaggcactggggggcggaggggccttgggtgtgcgcagagggacgggcgggcagagccttcctccgcattctaaacattcacttaaaggtatgagtttatttcaggggtgctgctgggagagcctccaaatggcttcttccagcccctgcctgacagttcagctcccctggaaggtcaactcctctagtcctttctcctggttctgggcaggacagaagtggggggagggagagagagagagagagagagagagagacggtcaggatccccggaccctggggaccccgtcaaaaataaatgaaattaagattgccgaccagagagagaaccgtgacaaagcaaacggcgttcaaagcaaagagacgaactgaaagcccgttcccgtaggactggttatgaggtcaacacattcaaacacagcttgctctcgattttgctgagcagaggaagatacagatgcatttgatccaaagtgtgttacatctttcattatatgtgtgtctctatatataaacatatataaatatataaacatacataaatgtatgtaaatatatataatctatatacatatataaatatataaacacatatataatatataaatctataaacatatataatatataaacataaatatataaacatatataatatataaatatattaacatatataaaatatgtataaatatatataaacatataaacatatataaatatataaacatatataaatatatacaaacatattgtatatatataaatatatataaaaacatatatatacatataaaaatatatataaacatatatacatataaagaaatatatataaacatatatacatataaaatatacatatataaacatatatatacataaaatatatatataaacatatatatacatataaaaatatatataaacatatatacatataaagaaatatatataaacatatatacatataaaatatacatatataaacatatatatacatataaagaaatatatataaacatatatacatataaaatatacatatataaacatatatatacataaaatatatatataaacatatatatacataaaatatatatataaacatatatatacatataaaaatatatatattaacatatatatacatataaaaatatatatatatttttggcccctgattcccttcggttcctgtgggatgggtgattgagtcaacacattcaaacacaacttttccatcgatgttgcttaggagatgaggatacagatgcgtttgatggagagggttttacgagctctttcatttaaaaatatatatatatatatatatatattttggctcctgattctcttccgtcttcccatgtggctgcattttaaaaggcttccctaagatcgttaggattaaatcaaccctccccaggcatctttaccgagggctgtggtccccaaagcgatacagcccaggagggagagaggctttggtgacttggaggaaggactgtgtccctccttagggcgtctgtggcctcagtgagggaaggaagctgcatcagacaggggtttcctcgctgtccacccctctggcagaagatggattgggctgccccgtataaattaatgaaaagattaaagtttcgctaaaggggacatcgagtttatgtgtcatctcctggtgtctgtgtgcctgggatctgcaatatatcccagcccttgatgtactgtttctataaaaataaattacttgtaatttaattccacactatttctttccgtagtctattaccgacgagagcacgttagttcagctgcggaaaattggttgtggggtgtgtgcggaccccgagaacgccctaaaataaagacaaatcggggacaagctgggggttatcgattgcaggggtcgcatgaaaatttaacgacggtaaataataataacaacaaacatgggaatgcaataaaagacataattctccatcgccgcggggggaaaggatcctatagtaaaggcgagtgcgctttgaggggtcataaaaatcaattagttccaacacccacgtcccgcgttgaggggacggggacgagcagggacagaaaaagaaaccatatttgaatcccatctctctgtgaattcttgggtcacatgcgtctcagtacagcccgtcccgtgctgtgaccggatagagtttcaatttactgtggaaatttgctgtaaataaattgagcatccgatagaagctgttgctgattaaccttttatttttagcgtggccctgcaaagtcgtatcacccagctgtcaggcttctaatcgaaagttatgagaccacggtgaggggcaggcggtaatttaattacaacaaatatctttgggtttatggcgcagagctaaattaaatgtcattattcactgtctgtaatggaaatcaaaaggaaatcgcattacggcatttgggaaagaaagcggggagtgctctttaatgaagaaataactgtcttaagcagtgtcacacacttcacttaccatattcgggcctaattggaatggatcgtgaatcactccaagactgatttattagcgcttcacgcagcggctaattcatcacttgtattcttcatcatttttttttttcctctcgccgtgttgaagggagagtgaatgaggctttccacgtttcaggaggattttcttttttgaaaaatgcccttccagaggcttttgggtggctggcttgctttctgggccctggaggagacaggcggagagtccaggtgggcatggagaggcacagtggcaggtcacctggatggtcagtggaggtggaggtctgaaggcgccagctttggaaattattggtgaatttcgatgtcagcaccaggcaggggcctttttggcgggggtgtgagggaggatgactttgctgggaaacaggatcaggttctccaggcgcactgcagcccggtaggacccactttggaaatgaaaagccagttccgaaagctgggctggaagcttccgtgttgggttcaagagcaagttcacgttgcgctgtgtagactcctggctgctcccaaactctgagggttttctgaggttcccttcataggggcaccggccctgggccatgcacagtgtgtaagggtggctgtgggccgagggacccagcacgtgttttgcccacaacagccggagtgactggttcactcaccgccttggcggaggacgcctgttctctggacgaatcatttctcttgggtggtgactgccttgtgggtcaaggtgcaggttttctgccacagaaaacctgttaggaggaattaagcgactaagactgtcagggaggtggtggtgggggagaggagggggtggtgtccagattaccaggcataggctaaactgcctgcactctccagctggtctgtctgtggaggaggggattgtcaatactgggagagcagaggaggctcgtaggaggtgagagggggtggaatttgcatgcaaatcttcacatgaggcctgtgtgaatttctccagcctcctgagggtcccctgcgctattgcactcaacttcttgatagtttaccccaagactcagaagtccttagaggggcagaatgcccccaccacaaagcctgctatccttgggcgtcctcatgacccttggtcatgaatgggaccctttcatgtatggggacccttggtaatatgaatgggacgccttcagctccccagggcttccgaggaggccgagaagggcaaagacacttccgaggaggccgagaagggcaaagacattttctgggcttggtgtgtcaagagctagattggagaaggggctggatttggaactctttagccatcagctcaccctctccgtttgtggctaaagtctgaaggtggaaacttcggttctcctacagggtctacaggagttggggggcggggcgcccacacagaacgctggaaagttcgacagtccacttccactggctcggaactcactttttcaccttaagttcatcagcggtaacgcataggtctcacttaggcagggcacggatgatttaacaatttctacttctaggtcaggtgcggtggctcacacctctaatcccagcactttgggaggcccaggagggtggatcgcttgaggtcaggagtttgagaccagcctggccaacatggtgaaaccccgtctctactaaaatacgaaaattagccaggcatggtggtgagcacctgtaattccagctactcgggaggctgaggcaggagaatcgcttgaacctgggaggtggacgttgcagtgaggtgagatcacaccactgcactccagcctggatgagagagcaagactctgtctcaaaaacaaaataaaacaaaaacaaaacaaaaatcaaaaaagaaaacccaatttccagttctaggccaggtgcagtggctcacgcctgtcatcccagcactttgggaggcccaggagggtggatcgcttgaggtcaggagttcgagaccagcctggccaacatggtgaaaccccatctctactaaaaatacaaacgttagctaggtgtggtggtgtgcgcctgtaatcccagctactcgggaagctgaggctggagaattgcttgaatctgggaggtggaggttgcagggaggcgagatagtgccactgcagtccagcctggaccagagagcaagactccgtctcaaaaacaaaagaaagcaaaaacaaaaaacaagagaccagcctggccaacatggtgaaaccgcgtctctactaaaatacaaaattagccgggcatggtggtgggcacctgtagtcccagctactcgggaggctgaggcaggagaatggcttgaacctgggaggtggagcttgcagtgagccgagatagtgccactgcactccagcctgggcgacagagcgagacttgatttcagaaccaccaccaccacaacaaaacaaaacaaaaaatccaaaaaaaccccaatttccagtactaggtagtcagtgatgcagggctggagacagaggggcggtaagtgtctgggcgcccaccatcagtcacctcccagctcccagaggtgcaaagtgcttggttcagcctcatgggaaggatgctccctggggaggctgggctgggttcacagggctcttcacatctctctctgcttctccccaaggtttggttccagaaccggagagccaagtgccgcaaacaagagaatcagatgcataaaggtgggtgtcgggactggggggacctgaagctgggggatcctgctccaggagggatggggtcgacgaggtgctggctacacccaggaccaccacactgacacctgctccctttggacacaggcgtcatcttgggcacagccaaccacctagacgcctgccgagtggcaccctacgtcaacatgggagccttacggatgcctttccaacaggtagctcactttttcttcctctgaagatccctagggacctgctgctcccttcccctttcccctatttgctgccgcatcctgacactcctagtccctccctgcccctgcagacttctcagctggcccttagaaaaaaagcctcttttccgaggaggcatttacaggcaccttggcacctatgaaatcaggctgggccaggcggggtggctcacacctgtcatcccagcactttgggaggctgaggagggtgcatcacctgagatcaggagttcaagaccagcctggccaacttaacgaaaccctgtctattaaaaatacaaaatgggtgtggtggctcacgcctgtcatcccagcactttgggaggccgaggcaggtggatcacctgaggtcaggaattcgagaccagcctgaccaacatgctgaaaccccgtctctactgaaaacacaaagcttagccgggcgtggtggtgcacacctgtgatcccaggtacttgggagggagaatcacttgaacctgggaggtggaggttgccgtgagccaatatcgcgccactgcactccactctgggtgacagagtgagactccaagactccatctcaaaaaaaaaaaaaaaaaaatcaggctgtaaaaatccacttttgggaaggtgaacacacacaagcccaaacagaaatctgacaaaaaccagaggggtgaaaagtccacacagtcaggcacccccacctggcttgctgcctggttaagaagggcgcagatgcctgtgcctggataccagagatgggacagacacccattcccttttcatcaccacccccgagtgcccgagggcctggggcgtctgcctggcccctggcccctggcttgggctctgcacctctgagctggagacaccctactcagctccccacttactttggagtgagcagcgcttgggtgcccagcgtggatttggggcttccagggagtcggggttcggtcgcggagcccaagcttcccaagggcgcccccgccctgccctggcttagtggtggggatgggatggggggaagcggggagctgcgtggaaggaggtgaagggtcacaggaggagagagcgcagcgcccacgtgcgccctgcctgaacgcgcagcgcagcgcccggctgcggtgccccttgccccttcggtccctaatttgggggtcgggagtgcatgcgcgggcggaacgggcttggggggggggctctggcagggcggacgcgtggcctcccttcttcaccgttttattccaaggggacaggctggggattgtatttgggcgcgtgtttggctgagggtgcagggacttggggggtggcggtggggagcgcggaaggtataaacgtataaatcataagtaaacaactcagaaatggaccccgagcgctggtcgccgctagctctccagctctccctggcccaggcccgaaggagaggggtccgcatccctccgcggttctcctctcctgggtacctggccttgaggtgggggaacgagcctacttcttgtaccgtcttttgccgacggcgggacccagtgaaattaggccgttggagcccgcaggcctgcctggctttgcgcaccggagtcttggggacctggtgtccccgggaaaaacttggggacctggtatccccgggagaggcttggggacctggtgtcccgggagaggcttgggtacctggtttctctggaagaggcttggacacctggtgtcctgggagggcctttgggacctggtgtcctgggagaggcttggagatctgttgtcctgggagaggcttggggacctggtgtccctggagaggcttggggacctggtgaccttggagaggcttggagacctggtgttctgggagaggcttggggacctggtgttctgggagaggcttggggacctggtgtctctggaagaggcttggacacctggtgacccgggagggccttggggatctggtgtcccgggagagccttggggacctggtgtcctgggagaggcttggggacctggtgaccttggagaggcttggggacctggtgtcctgaaagagccttggggatctggtgtcccaggagaggcttggggacctggtgtctctggaagaggcttggacacctggtgtcctggggagaggcttggggacctggtgtcctgggagaggcttggggacctggtgtcctgggagaggcttggagatctggtgagccgggagaggcttggggacctggtgtcccgggagaggcttggggacttggtgtcccgggagaggcttggacacctggtgtcccaggagaggcttggggacctggtgaccttggagaggcctggggacctggtgacccgggagagccttggggacctggtgtcctggggagagccttggggacctggtgaccttggagaggcttggggacctggtgtctcgggagtgccttggggacctagtgacccgggagaggcttggggacctggtgtcccgggagaggcttggggacctggtgtcctgggagagccttggggatctggtgtcctggggagaggctgggggacctggtgtctcgggagagagccttggggacctggtgacccgggagaggcttggacacctggtgtcccgggagaggcttggggacctggtgacccgggagagccttggggacctggtgtcctggggagaggctgggggacctggtgtctcgggagagagccttggggacctggtgacccgggagaggcttggacacctggtgtcccgggagaggcttgggagcctggtgtcccgggagagccttggggaccaggtgaccttggagaggcttggggacctggtgatcttggagaggcttggggacctggtgtctcgggagagccttggtgacctggggacccgggagaggcttggggacctggtgtccccgggagaggttacgggggctggttgggggagagaacgttgtgagccaaagtccctgaatccctgcgaagagagcgcatcgggagctccccctgagggcgttccatttgtggacccccctcccatgcgctttgcagggagctgttcggattcccctggcccggctcccgcggatgcatccagtggcagcgccaattctgggccagggggaaggaggaaaggcgggtgtggggtggtctccacggctggagaaggggcgacgctccctaggggagaagaggcacgttggaggtttccgggggcgcggggcggagcaggccccccagtccccatcctgcgccctcaccccgccgggtccgctcccgcaggtccaggctcagctgcagctggaaggcgtggcccacgcgcacccgcacctgcacccgcacctggcggcgcacgcgccctacctgatgttccccccgccgcccttcgggctgcccatcgcgtcgctggccgagtccgcctcggccgccgccgtggtcgccgccgccgccaaaagcaacagcaagaattccagcatcgccgacctgcggctcaaggcgcggaagcacgcggaggccctggggctctgacccgccgcgcagccccccgcgcgcccggactcccgggctccgcgcaccccgcctgcaccgcgcgtcctgcactcaaccccgcctggagctccttccgcggccaccgtgctccgggcaccccgggagctcctgcaagaggcctgaggagggaggctcccgggaccgtccacgcacgacccagccagaccctcgcggagatggtgcagaaggcggagcgggtgagcggccgtgcgtccagcccgggcctctccaaggctgcccgtgcgtcctgggaccctggagaagggtaaacccccgcctggctgcgtcttcctctgctataccctatgcatgcggttaactacacacgtttggaagatccttagagtctattgaaactgcaaagatcccggagctggtctccgatgaaaatgccatttcttcgttgccaacgattttctttactaccatgctccttccttcatcccgagaggctgcggaacgggtgtggatttgaatgtggacttcggaatcccaggaggcaggggccgggctctcctccaccgctcccccggagcctcccaggcagcaataaggaaatagttctctggctgaggctgaggacgtgaaccgcgggctttggaaagggaggggagggagacccgaacctcccacgttgggactcccacgttccggggacctgaatgaggaccgactttataacttttccagtgtttgattcccaaattgggtctggttttgttttggattggtatttttttttttttttttttttttttttttttttgctgtgttacaggattcagacgcaaaagacttgcataagagacggacgcgtggttgcaaggtgtcatactgatatgcagcattaactttactgacatggagtgaagtgcaatattataaatattatagattaaaaaaaaaatagccgtgcactcttgaccccgtcagcgtccaacgtggaaaaggcgttacctcttctcccagcgctggccgcctggccactgagggccctttgcaaaaatcacgggtgtagagatggccctgggcgcgctgggagtgtggttgtgtttctgaaggggataaaagagggcacggtggtgccaagatatcagtttggtacctgagctgtttctggttgggaagcgtaaaagccagggagagatccagagagttttcaagtttttgcagatgtaggtggttccagcttttctttctcccctactccatcttctgcgttcccccagttcttttatttctttgttttttatttttgagacagagacttgctttgtcgcccaggctggagtgcagtggcgcaatgtcagctcactgccacctccgcctcccgggttcaagcgatgctcctgcctcagcctcccgagtagctgggactacaggcacctgccaccacccccggctaattttttgtatttatagtagagacggggtttcaccgtgttggccaggctcgtctcgaactcctgacctcaggtgatctgcccgcctcggcctcccaacgtgcccccagttttataaacagcagatagcaacttgtcgtcacagctggcatgggctggacagttgcttgaaatgacctaaccaaaaacattcaagggttctgcccccagatttcgggagatccacgttccatgttctgattggttttctgggaacacagcaaggggtttggtgacctccgagaagatccatctgcatgattggcattagttaccacagcctgcccagagagaaactatcttctcccaacatttactaacatccactggtcaactctcttatttccataacacatttgcatctttctggattcaagcttggtggttttctttcctaacttctgatttagatacttctccctgaggtggggataaaagaaaaaaaaaaacaacttctttttttcttccgcataacactttctatcttgtcactgagctgaactgtagatccatttggacccgtctcatttgtatcttctgatattctttatacaaaccaaaagtccccttcaacattttttatgtcaaaatgttacaaccgctgtaaaatgacggagagagagagaaagaatcccagacattaacggtattagagagtttgcctcattcatccatttttcttaaaagctggaaattaaaaaaaaaaaagagagagagaggctttaatagttaagctgaaatttttatcgaaaagaagaattgcattttgaatctttgggaagtaggttcattcatcagagtatgtaaccctttggaaaagtggttggtaagatatgtacagccctagattttttttttttaaccaaaaaggctgagtaattttgaaaaatcgaaacataacagtgtgtcatcatttcctcccaagaaaaagctcactccacgtgagtagaaagacatctacctggtccctgtagaatctgaacgtttctctttagagacggaatttcaatcttgtcccccaggctggagtgcagtggcacaatctcggctcaccgcaacctccgcctcccgggttcaagccattctcctgcctcagcctcccgagtagctgggattacaggcacctgccaccaggcctgggtaactttctggtatttttagtagagacagggtttcagcctcccgagtagctgggattacaggcacctgccaccaggcctgggtaactttctggtatttttagtagagacagggtttcagcctcccgagtagctgggattacaggcacctgccaccaggcctgggtaactttctggtatttttagtagagacagggtttcagcctcccgagtagctgggattacaggcacctgccaccaggcctgggtaactttctggtatttttagtagagacagggtttcggcctcccgagtagctgggattacaggcacctgccaccaggcctgggtaactttctggtatttttagtagagacagggtttcggcctcccgagtagctgggattacaggcacctgccaccaggcctgggtaactttctggtatttttagtagagacagggtttcagcctcccgagtagctgggattacaggcacctgccaccaggcctgggtaactttctggtatttttagtagagacagggtttcggcctcccgagtagctgggattacaggcacctgccaccaggcctgggtaactttctggtatttttagtacagacagggtttcagcctcccgagtagctgggattacaggcacctgccaccaggcctgggtaactttctggtatttttagtagagacagggtttcggcctcccgagtagctgggattacaggcacctgccaccaggcctgggtaactttctggtatttttagtagagacagggtttcggcctcccgagtagctgggattacaggcacctgccaccaggcctgggtaactttctggtatttttagtagagacagggtttcggcctcctgagtagctgggattacaggcacctgccaccaggcctgggtaactttctggtatttttagtagagacagggtttcagcctcccgagtagctgggattacaggcacctgccaccaggcctgggtaactttctggtatttttagtacagacagggtttcggcctcctgagtagctgggattacaggcacctgccaccaggcctgggtaactttctggtagttttagtagagacagggtttcagcctcccgagtagctgggattacaggcacctgccaccaggcctgggtaatttttttgcatttttggtagagacaggtttttgctgtgttggcccggctggtctcaaactcctgacctcaggttgacctgcccgctttgtccctcgcaaagtgctgggattacaggcgtgagccaccgcacctggcctgaatctgaacttttaaaagggagttactgactctcaactgtgcggggacggtttcagtttgatttaatatggaaagagggccaagtgtcatcctcacaaatgggtccccgaagcagatcaaacgcagagaactgtgagggtgggacacgagtgtctgtggacactggctgcctttggcttttctcctgcgagagaagttgggtgactttctgtaggtggatgagtgatccctgaatgagtgtggggtacgtgtatgctagctgcttctttctccctgaaactctcggatggaaggaagtaagaaattcagcttgggctgtgaccagttctcaccaccaacgccctcttctctctcccttctccttccttccttccttcctttctttctttttctttctttctctctttctttcttttctttctttctgtttctttcctttttatctttctctctttttctttctcttttccttttttgtttctttctttctttttctttctttctttttctttcttctttctttcttcgatgaagtctcactctgtcacccaggctggagtgcagtggtgcaatcccagctcactgcatcctctacctcctggcttcaagaaattctcctgcctcagcctcccaagtagctgggatgacaggcacccaccaccattcccggataatttttgtattttttagtagagaccgggtttcgccatgttggccaggctggtcttgaactcctgacctcacatgatccacccgcctcagcctcccagagtgctgggattacggggtgaggcaccgcgcccggcctcctctctctttttctgagatgtttaggaaggactgggctgatggggaccctctgtatgtgatgtgcgtgggtttggtttcccggaaggccctccagagacacgtttgcgtgaacattcagcatggaaacaacatacgtctctccacaggaggtgagaaattgaatttatggggtgggtgtacgctggcgattcttggtgctttttgctcaaaacaaggttcttttgaaagtcacgttcctgctttccctgtggcttcccggtgagctcgctcgcagagcaaggaataccacccagagagcaacgtgggctgtgttccgatgtaacgccgttgcagagagaggatttggtgtgtgagatccgtaccagctccagcacactgataggaacacgttgctggccgaactgaacgatgctgggttgggtcctgattgatacgtattttcttccctcctctccccaaaacttggccaaatagtccgtggagggttgtcagtcgccgcagttgagcaaaaaacacttcttcctttgagtggctgttctggtgaaatctgtttctgacatatccacttttctctctcttttctctctctctgactgcgaagcacccacagggagaaggaattggatgtatcggatgttgctattagattttctttctccgttcgagtctctgactggtgcatactttgcaaaggtgtgttcctggcaattgccaagagttagaaaaatgcaccttctctggtggccgttggggtgttgtttcacaggcagtggtgacagggccccttggctgtggctgtcttctccagcgccgtggataaagagatgggacagattctgtgcctctgtacgatttagagcgtaactgaccgcgtccaacacccgtttttccacttacaaagctggtggtgcgacgggcttggtgtctcccgtacgggaaggaggcctttgggccgctccaaagacgccctgtcgtaggaatggcctctccatcccgccaaagtccagccaggcccccgaaatggtcccatttccttggaagcctgagtttctgttctggtcttgctgctgtccttggccacgtcagcacgtgggagcatctgtggataccgcagagtctggggacagctgggcgtttaaccgaaatgaagccgagacgggtttcaggttttggtgccaagctctggtcaggatgaaagggaaataccagagtcctctgtcctcgcctctgggtttcatgctgacctttctaacatttgttttcccctaagaacaagcagaagcctccagctccctttagctccacagttttcccggggacatagcgaggatggcacacggcagccactcccacgacacacatttcggaggcactttgctggaagccgcttgtctcctccagctttgggaggtctggggaggagagaggctttcggtggacacgtttgacattaaaaaaaaaaaaaaaaaaaaaaaaaaactggtgcctaatttattaaagagaattagcttagcgagtatatgctgatattcttcgacacacgtgggtaagttgatgccatttataaatgttttattgaaatttgatatttaatgagaagccggttaaggaatgtagacaatatcccgtttcaaagctatgaaatgtgctatttattgaaaggggatgtggcttcacgagttcagcccattgtacgtgcaggtcccgtgggaaggaggcaaaagcccctgcttcttactttgtgatgtatgtgcatttgttatttatttttttttccttggtcggacgttcataaatatgtactattttaattatgtcgagtgtaaatttgacatcgcgttgcatttatttttatatttctgaaaactgttgctttttctttttccctcccccattgacgacatagcggcccccgcgtccgggttacaaatacatctacagatattttcagggattgcttcagatgaaaacaaatcacacaccgtttcccaaaccaacagtcttcacatttctatccctctgttattgtcggcaggcggtgaggggtagaaaaaaaacaaacaaacaaacagaaaaaaaaaccaaaaaaaaccaccctgagtttctctggtgacgccctcattctcctaacgttcaataatctcaatgttgagttgcagcaacagactgtatttttgtgacgccccgtagtatgaatgtacatcttgtaaaactgagatataaataaacttataaatatttgtattcaagtgttaaaaaaaaaaaaattctcaacctctcccctgaggacaggcttattggaaaaaaaaaaaaaaaaaaaaaatcctgagtcggccgtggctgaacacagagtgttgttctgctccgtgcatttccagggtgggtacccagtgttgccccccagccttagatcgggaggtaccattgacttttgcttgtatcccatccccttcctttactgaaacctacctccccgcttctcagccaacgtccccccagaaggtggcaaaaaaaacagaggaaaaagccctgatttgaatcaagtcagagctgctaattctccactttctttaattaattaatttatttttttttttgagactgagtctcgctctgtcgcccaggccggaggagtgcaggggcgcgatctcggctcaccgcgacctccgcctcccgggttcaagcgactctcctgcctcagcctcccgagtagctgggatgacagtcacctgcaccaccgcgcccggctcatttttgtatttttagtagcaatggggtttcaccgtgttggtcaggctggtctcgaactcctgacctcgtgatccacccgcgtctgggcccggccggtgatgtgtgtgcttttaacttttattttgttccagttttcgacagtggcacggattttccagcacggtcttgcaaggatgattgagtcatttttgagacaaaaaatataataataataaatggaaaaagaaatcgacttttaaaaatgacaaatttttttttttttttttgcatagatttttctctctttatgtaaaggaaagttcatgattggatttggccggcctgactgcttcccggctgtgataaaaaacacatgtgagctgggagggaagtgggggagggacacagctgcccacacagggttcccaccgcggttacagggtgggcagtgctgggggagctttctctgtggggggctcagagcctgaggacaggtgagcctctccgacacctccccagttgcctggagtctaaaccgtccgttgtctgtaccgtccgttcttcctgctgactcctggtagttcctgaaagcttctcttggccagagaaggggtttcagaggccgtgtgtccaggccattctgcaaagtgcaacttgaccgttcctttccttttctggcctgcgtggtctgaagctcagagccctctcttcacccagcctgtgtgtgtcttgccggacagaagaaaaatggtgctttttgcgtgttagcagaggtgcttttcatggctgacctcaacgcgtccatctccagcctgttttttaggggcaaacgcaggcaagttctgaatgcacacagttatttcatggttaaactattcagctttggccgggcgcagtgtggctctcacgcctgtcatcccagcactttgggaggccgaggcgggtggatcacctgaggtcaggagttcgagaccagcctggccaacacggtgaaactctatctctactaaaaatacaaaaattagccgggcgtggtggtgtgtatctgtaatcccagctactcaggaagctgaggcaggagaatcgcttggacccaggaggcggaggttgcactgagccgagatcgcgccattgcactccagcctgggcgacagagccagacgctgtctcaaaaaaatgaataataaaataaaataacaggaactaaataaaataaaacgttcagctttgttctgcaaatccactcctattgttttacgtggtttgagagactctgtcccttagaaatagatgtttgttgccaattgtaatgaatctgtttcaaaaatgaacagaatattcaaatggtttgagagatcttttcccttagaaatagcttgttgccaatcacaaagaatgtttttcaaaaatgaatggaatcttcctggatatcgcttccagatcttcattttttttgcatagttcaacctgaaaagtaagtgtctcagccctgaatttctttctgatttttccatgggttgtcttgcagacttctctggacttgaccacatttaaaaaaaaaaaaattaactttttcacacggacacggtttcaataggaatgagatctttgagtttttatgtaacagattcttaccatcagttctcagattcccaaattacacacaaaaagccacggacttcgcctcctgctaacatgtccttctgtttctgaggcttctgttggtgttagactttcatgtttaatagcagacaatgtagggatttaaagaaaaatgcagagaaagcaaaaacactgaccaaacacacggagataagctttctaaagcctttgttcttggagttgtcgttaaaaaaaaaaagttgttttaaactttgcaagcatgcctatattgaactcataagcaagagagccaagaaaaatagtgtcggtcgtctactctacacgttttcccaaaacagacgtattttaatttcttttgtttgaactcacagatgctgagagttaaaagttaaatttttgtcatgaacaatagtggccaaaaccacagttacttttgcactatagcataataagaaaaatacaggctgggctcggtggctcacacctgtaatcaaagcacttttggaggcgaaacagccagatcccttgagcccaggagattgagaccagcctgggcaacatagcgagaccctcatctctacaaaaaaggtttgttacatatgtaacaaacctgcacattgtgcacatgtaccctaaaacttaaagtataataataaaaaaattaaaaaaaaattcaccaatcaactgcctgctggtgccttcaagagactcacctaacacataaggacttgcataaacttataaaacaattcaatggaagaatccttgaaagtattctgagaagacagtataataaactgatttctaaaaaggctataaaaaattgaataaatcattgttgggcatcctgtgctgaaatataatgcagccaataaaaattacaaaatgaataaacattttataacaattaaaaaaagtcaaataattaggcaggcatggtggtgctctcctacggttgaagctattcagcaggcaagaggatactttgtttttgttttttaattttttttgagacagagtctcgctctgttgccaggctggagtgcagtggcgtgatctcagctcactgtaatttctgcctcccgggttcaagcgattttcctgccccagcctcccgagtagctgggattacaggtgcccgccaccacacctggctaatttcttttgtatttttagtagagacgaggtttccccatgttggccaggctggttttgagctcccgacctcgggtgatccacccgcctcagcctcccaaagtgctgggatgacaggcgtgagccaccgcgcctggcccaggaggattatttgatcccaggaggtggaggctgcaggaagccatgattgcaccactgcactccagcctggctgacagagtgagaccacatctctaaataaatgaataaatacaggcagaaactttttttgttttgttttgatggagtcttgctctgtcaccaggcaggagtgcagtggtgccatctcagctcactgcaacctccacctcctgggttcaagcaatcctcctgcctcagcctcccgagtagctgggattacaggtgcccgccaccacgcccggctaattttttgtatgtttagtagagacgggatttcaccgtgttagccaggatggtcttgatctcttgactttgtgatctgcctgcctcagcctcccaaagtgctgggattacaggcatgagcccaggagttcaagaccagcctcagcaacaaagtgagaccttttctctccaaaaaatcaaaaatttagccagctgtggtggctcctgcccgtgatcccagtactgtgggaggctgaggcagaattgcttgagcccaggagttcgagaccaacctcagcaaaaaggactctctctctgtctctctctctctctctctctctctctctctctctctctctctctctatatatatatatatatatatatatatatatatatatatatatgagtttcaaaaattgctgggtgaccagctcatctactggttttccccttgggaaagtgaaattgtcatgtattgaagatttccaaggaagttgtattgaatgagaaacaaactcaatctgttcgtgtttaaagagctgcagtgcgtttgccgtgtttcccataaaactgcacttccaaaagacacgctgagaaaggagaccaggatttgtaattcagaaattggaaagcaagttaggctggacgtggtagctcacgcttgttgtaatctcagcactctgggaggctgaggcaggaggatcacttgagcccaggagttcaagaccagcccgtgccacatggtgaaaccctgtctctccaaaaaataaaacatttagccagatgtggtgactcatgcctgtaatcccggtattctgggaggctgaggcagagttgcttgagcccaggagttcaagaccagcctcggcaacaaagtgagaccctgtctctccaaaaaataaaacatttagccagctgtggtgactcatgcctgtaatctcagtactctgggaggctggggcagaatggcttgagcccaggagttcgagaccaacctcagcaacaaagtgagatcttgtttctccaaaaaatcaaaaatttagccagctgtgctggctcatgcctgtaatcccggtactctgggaggctgaggcagaatcgtttgagcccaggagttcgagaccaacctcagcaacaaagtgagatcttgtttctccaaaaaaatcaaaaatttagccagctgtgctggctgatgcctgtaatcccggtactctgggaggctgaggcggaattgcttgagcccaggagttcaagaccagcctcagcaacaaagtgagatcttgtttctccaaaaaataaaacatttagtcagctgtggtggctcaagcctgtgatcccagcattttgggaggccgaggcgggcggatcacgaggtcatgagatcgagaccatcctggctaacacggtgaaaccccgtctctactaaaaatacaaagaaaattagccgggcgtggtggcgggcgcctgtagtcccagctactcaggaggctgaggcaggagaatgccgtgagcctgggaggcggaccatgcagtgagtcgagatcgcgccactgccctccagcctgggccacagagcaagactccgtctcaaaaaaaaaaaaaaaaaactgctgcccaagctgtgtttgcaccactgccctccagcctgggcaacagagcaagactccgtctcaaaaaaaaaaaaaaaatgctgcccaagctgtgtttgcaccactgccctccagcctgggcaacagagcaagactctgtctcaaaaaaaaaaaaaatgctgcccaagctgtgtttgcaccactgccctccagcctgggcaacagagcaagactccgtctcaaaaaaaaaaaaaatgctgcccaagctgtgtttgcaccactgccctccagcctgggcaacagagcaagcctcagctttctgccatctccacaaccaagaaagcaattcacacagaaatcagtgcatcgtgcagtgacctcttcagaaaaccaatgagttttccacctgaggaactgtttctgagccccattcagaagaacacatccctgtaactgcagggcagatttactcactgatgcctgtttaaataaagcttccagcctctgcatggggtctgtctggaagctcctgtatctgtcccacattcttggaatcacaatgcacccttgggaggaagatatgtatttaaagggagtggatgttatggtgagaaaatgctgcccatccttctagaagacaaaagccacacaaaatacatcacaagaaccagtttttttcagagaagaacctgcacaaagaacctgctccccccacacccccacacacaggtgaattaacaggatgtatgttttatcataaaagcacaggtttgtttcctatgcactctctgaggatttggccatatgcaaagatgtacaaaaaccttctctttccccagggaaccgtaacccgtctgaaaagatgcccttctcagaagcgagttgaacgattgttggaaaagataaaatacgacgtgcacacacagagtagagaaatgtcacccatgcaaattatgtgtttgaatggaacacattcaggaagctaaatggggtatgaccacacatttgggttgatttatttgacgagtggaaggggcagatggaaatgaatactgctgttttcctttggaaggccatatatgggaataccaagaggattactttggaagtttagcttctccaggtggtctctctctctctctctttttttgagacagagtctcactctgtcacccaggctgcagtgcaatggcgtgatctcggctcactgcaacctcagcctcccaggtacaagcgattctcctgcctcagcctcccgagtagctgggatcacaggtgtgcaccaccacgcctggctaatgtttgtattttcagtagagatgaggttttaccatgttggccaggctggtcttgaactcctgacctcaggtgatccgcctgcctcggcctcccaaagtgctgggatgacagacatgagccagcacgcccggccccaggtggtctttttagcgggtattaaagcagctttctctctgagccttaaaccatgaagatagacagactcagtgtatgggttttagagttgtaattttataaaaataagaaaaagtcgacctatcattgatggttagtattttttgtagcagttgcatgcaatattaggataaggcatgttctcaaaaagaactctttttttttttttttttgagacggagtctcgctctgtcacccaggctggagtgcagtggcacgatctccgctcactgcaagctcctcttcccgggttcacgccattctcctgcctcagcctccccagtagctgggactacaggcgcccgccaccgcgcccggctaattttttgtatttttagtagagacggggtttcaccgtgttagccaggaaggtctcgatctcctgacctcatgatccgtccgcctcagcctcccaaagtgctgggactacaggcgtgagccactgcacttggcctttttttttttttagatggagttttgctcttgtcgcccgggctggagtataatggcatgatctcgactcactgcaacctccgcctcccgagttcaagcgattctcctgcctcagcctcccgagtagctgggattacaggtgcccaccaccatgtcaagataatgtttgtattttcagtagagatggggtttgaccatgttggccaggctggtctcgaactcctgacctcaggtgatccacccgccttagcctcccaaagtgctgggatgacaggcgtgagcccctgcgcccggcctttgtaactttatttttaattttttttttttttttaagaaagacagagtcttgctctgtcacccaggctggagcacactggtgcgatcatagctcactgcagcctcaaactcctgggctcaagcaatcctcccacctcagcctcctgagtagctgggactacaggcacccaccaccacacccagctaatttttttgatttttactagagacgggatcttgctttgctgctgaggctggtcttgagctcctgagctccaaagatcctctcacctccacctcccaaagtgttagaattacaagcatgaaccactgcccgtggtctccaaaaaaaggactgttacgtgga

SEQ ID NO: 2840 - DNA, 13737 bp, human
atggggcggctggttctgctgtggggagctgccgtctttctgctgggaggctggatggctttggggcaaggaggagcaggtaattatttaaacaccctcttcttgttgtattttggtttgtggtttgctttgcaaccaggcactctttattttgtaaaacttaaacaatgagcatggaggtttctttcttcttttcttttttttttttttttttttccgggttcaagcaattctcctgcctcagcttctcaagtagctgggacaaaacatatttataagtaaatacatgaatattaagtatacttattgctcccggaatatccactgcttatatgagctttcggtggccagaactaggaactgtatgtgtgcgtgtgtgtgtctatctattgattgattgattggtagatatattcatttttaatctatccatcaatgtatctcatctatcttttcccattaatcacccatccatccactatccatccatctattattcattgatccatccactaatatatccatccacccatctatcaaacgattcatccactcatacattcacccacccatcaacccacccagccatccgtccacccaacctttcattcactcatccatccatccaccatccacccagctgttatctatccatcctcccatccacccatctatcatccatccatccatccatccacccatccacccatccatccaccaatacatccatccatccatccacccatccacccatccatctaccaatacatccatccatccatgcattcacccacacttttatccacttatccatccatccatccatccacccatccatccaccaatacatccatctatccatgcattcacccacacttttatccacttatccatccatccatccatccatccacccatccacccatccatccaccaatacatccatccatccatgcattcacccacacttttatccacttatccatccatccatccatccacccatccatccaccaatacatccatctatccatgcattcacccacacttttatccacttatccatccatccatccatccacccatccatccaccaatacatccatctatccatgcattcacccacacttttatccacttatccatccatccatccatccatccacccatccacccatccatccaccaatacatccatctatccatgcattcacccacacttttatccacttatccatccatccatccatccatccatccatccatccatccatccacccatccacccatccacccaccaatacatccatctatccatgcattcacccacacttttatccacttatccatccatccatccatccatccatccatccacccatccatccacccacccacccatccatgtacacatctacgtatccatctatccatgcatccatccatccatccatccatccatccattcacctatgtatctgttcatccatttatttatccactgactcactcatccacccacccatcctttcatccacttatccatctatccatccatccaccaacacatccatccacccacccatcaaaccatccatccacctatgcattcacccacactttcatccactcatccatccatccatccacccatccatgtacacatctatgtatccatctatccatgcatccatccacccatccacccattcacctgtgtatctgttcatccatttattcatccatccactcacccatccacccacccatccacttgtcttccacctatacacccacctgtccattgattcatccatctacctacccatccctatctatctgtgtctgtctgtctaactatttctatcatcatctatataattctatctatctaacattaccatttatctatctatctgtatctatctatcctccagatacctccacttagaacccaacatgacaaggttcactgtaccccatctttccaaacctgtaactgacttctttgacagtgagagacttggccgggcgctgtggctcatgcctgtaatcccagcactttgggaggccgaggtgggcggatcacaaggtcaggagatggagaccatcctggctaacacggtgaaaccccgtctgtactaatacaaaaaatcagccgggcatggtggcaggtgcctgtagtcccagctacttgggaggctgaggcaggagaatggcatgaacccgggaggcaaagcttgcagtgagccgggatcgcaccactgcactccagcgtgggcgacagagcgagactctgtctcaaaataaaaaaaagagacttggctttcattatgcaaaatatcattacatgtttgctcaattctaaaatatttccattgtccctgttcggaattacaaacccagacctcttgaaacatcaaacctactgaagtctatgcaaccttcctagcaaacgtagaaagtcttctttacggttggcccatttcttttcttttcttttcttttcttttcttttcttttttttttttgatagggagtcttgctgtgtcacccaggctggagtgcagtgacacgatctcggttcactacaacctctgcctcctgagttcaagccattctcctgcctcagcctcccaggtagctgggattacaggtacccaccaccatgtccagctcatttttttgtgtttttagtagagacggggtttcaccatgttggccaggctggtctcgaactcctgacctcgggtgatccacccgcctcggcctcccagtgttaagattacagacgtgagccgctgcacctggccagtccatttctgaagttggtgtgtgtggtgttttgagaaagacagtaaggtggatcgatggggacagtttccgatgccaccttaggtatccacaggggatgtgttgttggatacatgattgatctatacagatacatctgtgcatggcactagtgggtgaacttaccttttgcaaaaacaaaaacaaaagcagccgggcgcggtggctcacgcctgcaatctcagcactttaggtggatgaggcgggcggatcacgaggtcaggagatcgagaccatcctggctaacacagtgaaaccccatctctactaaaagtacaaaaaattatccaggcatggtggcgggcacctgtagccccagctactcgggaggctgaggcaggagaatggcgtgaacccgggaggcggagcttgcagtgagccgagattgcgccactgcagtccagcctgggtgacagagtgagagtctgtctcacacaatacactacactacactacactacactacactacactacactacactacaatacaatgcaatacaatgcaatacaatacgtcaggcgcggtggctcacgcctgtaatcccagtactttgggaggccgaggcgggtggatcatgaggtcaggagatcgagaccatcctggctaacacggtgaaaccccgtctctactaaaaatacaaaaaattagccaggtgtggtgacaggtgcctgtaatcccggctactcgggaggctgaggcaggggaatcgcttgaacccgggaggcggaggttgcagtgagccgagatcgtgccattgtactccagcctgggcaacagagtgagactctgtctcaaaaagaaaaataaatttaaaaaaataaaaaaatagagttgcctcaccgtgaacttcatgcgtctctctgtgtctagcagaaggagtacagattcagatcatctacttcaatttagaaaccgtgcaggtgacatggaatgccagcaaatactccaggaccaacctgactttccactacaggtaagtggcccccagaaagcgaaccccacgcccagggggctcaaaatcgctcttctgagccgtcagcgattgggaatgcttgagaacaaaagtgtaaagcatcagactgtgcaagccggaatgtttgttctgtgaaaccctcagccctcaccacaaccacaatctcattgccccaaaccttcttgccaagggatggctgactcactgtcaaaatcaactacattcttttttttgtttgtttttattttgagtcggagtctcactccgttgccacgctggagtgcagtggcgcaatctcggctcactgcaacctctgcctcccgggttcaagccattcccctgcctcagcctcccgagtagctgggattacaggcacctgccaccatgcctagctaatttttgtatttttagtagagatggtgattcaccatattggtcaggccggtttcaaactcctgacctcatgtgatccacctgcctcagcctcccaaagtgctgggatgacaggcgtgagccacggcatccggactgaaaatcacctagattcttcacgggagattaacagagagttttgttcacccagagctctgggtgaactttaagtcttatctgctaggcagccggggagggaaagactcagtctctgaaacatttcacagccttacccggggctacccccaaccctgtgtctccctgatgtgactttatttttatttttactttggcttagttagacacccagaagtatgcgtacgaacattgcaggaagggtttttccaataaatttaatcatgggtggatgattcttcagtttgataacaaaagagataaacggcaaagcgtacagaacagggaaattttaaaacgaagttatttggaaaataagactcaccgttgggagaccgaggtgggtggatcatctgagatcaggagttccagaccatcctggccaacatggtgaaaccccaactctactaaaaatacaaaaactagccgggcgtggcggcaggtgcctgtaatcccagctactcaggaggctgaggcaagagaatcgcttcaacctgggagacggagttcacggtgagccgagattgcactccagcctggccgacagagcgagactgtctcaaaaacaaaacaaaacaaaacaaaaacctcacaaaaagaaaaaaaaaagtgctggattttgcacgtagttgcagaattcagctcagtttcttcctctgtaaaaggggcagttcttggggggggtgttggctcatgcctgttatcccagcactttgggaggctgaggggggggggggtggatcacctgaggtcaggagttcaagaccagcctggccaacatggtgaaacctcgtctctactaaaaatacaaaaaaattagccgggcgcgggggcgtgcgcctgtaatcccagcaacttgggaggctgaggcaggagaatcgcttgaatccgggaggcagaggttgcagtgggccgagatcacgccattgcactccagcctgggcaacaagaacaaaactctgtttcaaaaaacaaacgaacaaataaaaaaacggccgggcgcggtggctcacgcctgtaatcccagcactctgggaggccgaggcgggtggatcacctgaggtcaggagatcgagaccagcctggtcaacatggcgaaatcccatctctattaaaaacacaaaaattagctgggggtggtggtgcgtgcccgtaatcccagctactcaggaggcagaggcaggagaatcgcttgaacccgggaggcagagattgcaatgagccgagatcgtgccactgcactccagcctcagggacagagcgagacaccatcttaaaaaaaaaaaaaaaaaaaaagccggtgtggtagctcacacctctcattccagcagtttgggaggccaaggtgtatggatcacctgaggtcaggagttccagaccagcctggccccaacatggtgaaaccctgtctccagtaaaactacaaaaattagctgtatatggtggcaggtgcctgtaatcccagctactcaggaggctgagacaggagaattgcttgaacccgggaggcagaggttgcagtgagctgagatcgcgccattgcactccaacctgggcgacaagagcaagaccccatctctaaataaataagacatgcttttttgttttgttgctgaatggtcatcgttttaaaccacagattcaacggtgatgaggcctatgaccagtgcaccaactaccttctccaggaaggtcacacttcggggtgcctcctagacgcagagcagcgagacgacattctctatttctccatcaggaatgggacgcaccccgttttcaccgcaagtcgctggatggtttattaccgtaagtattgtaaagccagctcaccatgcttttcagtacttccttcagcttattaccacaaggactgaaaaccaagctcatgcaaatcgccggatccatgattaccgttaactattgagaagcaagctcaccatgcctttcagtacttcctgcagcttattactgtaagtaacgaaaaaccaagctccagccagtcgcgggatcaatgattcccgtaactattgaaaaggaagctcagcatagttttcagtacttccttcagcttattaccgtaagtactgaaaagctcacgtaaatcgtcggatccatgattaccgtaataattgaaaagcaagctcagcacgcttttcactacttccttcagctgattaccgtaagtaccgaaaagcaatctcatgatagtcgctggatcaatgattaccgtaaccactgaaaagcaacccagcctacttttcgctacttccttcaggttattaccataagtactgaaaagctcatgcaaattaccggatccatgattaccataactattgaaaagcaagctcaccatgcttttcgtacttccttcagcttattaccataagtactgataaagcaagctcatgcaagtcactggatcagtgattaccgtagctattgaaaagcaagctcaccatgcttttcagtacttccttcagcttattaccataagtactgaaaagcaagctctagcaagtcgcaggatcagattcccgtaactattgaaaagcagcccagcatccttttcactacttccttcagcttattgccataaataaaaaagctcatgcaaataaccggatccatgattaccgtaactattgaaaagcaagctcaacatgcttttcagtatttccttcagcttattaccataagtactgaaaagcaagctctcgcaagtcgcgggatcaatgattaccataacaattgaaaagcaagctcagcatgcttttcagtacttccttcagctgattatcataagtaccgaaaagcaagctctcgcaagtcgcgggatcaatgattaccgtaacgattgaaaagcaatcccagcacacttttcagtaccccttcatctccttaccttcagttactttcagttaagttctgaaaatcaagctcatggaccattggccactagagcccggtgcccagctcctcactccaagtgggaagaaaccggccttccaggaagttccctcttacacgcacactggttggggattgaatctgcccccagtggggagaccagatgaccccgggagactgtgatttaagggaatgaattaaaggcggggcgcggtggctcacgcctgtaatcccagcactatgggaggccaaggcgggcggatcacttgaggtctggagttcgagaccagcctcaccaacatggtgaaaccccatctctacaaacaaacaaacaaacaaaaaattagccgggctggtggcgcatgcctgtaatcctagctgttcgggaggctgaggcagggaaattgcttgaacctgggaggcagaggctgcagtgagccacgttggtgccactgcactccagcctgggcgatttataaattcattatttaaaaataaataaggcccagggtggtggcttacccctgtaatcccagtactttgggagaccaaggcgggcggatcacttgaggtctggagttcgagaccagccttgccaacgtggtgaaaccccgtctctattaaaaataatttaaaaaaaattagccaggcgtggtggcacacgcttgtaatcccagctactcgggaggctgaggcagggaaattgcttgaacccgggaggcggaggctgcagtgagccaagacggtgccactgcactgcagcctgggcgatttataaatttattatttaaaaataaataaggcccagggcggtggctctcccctgtaatcccagtactttgggaggccaaggcagggggatcacgtgacgtggggagttcgagaccagcctgaccaacatggagaaactccatctctattaaaaatacataattagccgggcttggtggtgcatgcctgtaatcccagctactcgggacgctgaggcaggagaatctcttgaatctgggaggcggagtttgtggtgagccgagatcgcgccattgcactccagcctggacaacaagagtgaaactccatctcaaataaataaattcattaaattaaataagggaattaattagagatgctctctggtgccctgcctacacacacacacacacacacacacacacacacacacacacacacacagagtgagctggaaatactctctcatcctcatcccactcactggatgttctctctctttttttttttttttttgagagagagggtcttcctctgttgcccaggctggttttcttatgtgcgttgagaactggctgttaagtctcgggcgaggaaatgagggacaaatgtagggaaaccctgtttccaaaatgtttattctttatcctagaattctgtaaggctgtgtttcttttttacttttttattttttagaggtaggggaaacggatctgtttgagaatccggtgagaactatgaactctttattcgcgaaattacttacagatactgggtgcgtttcctgggctataataggtcaccacaaactggaggcttaaaacagcagaaatttattctctcccagttttgaagcccatgagtctgagatggagatgtctgagagccgcattccctctggaggttctaagggaggatccttcctgcctctcccagctcctgggggctccaggcatccctgggcttgtggccgcatcactccagtctctgcctccgtctccatgtggccttctcctctgtgtctcctcttctgtctcttacaagggcacctgtcattagatttaggggacaccctactccaggatgatctcacctcaaggtccttcacctaattacatctgcagagagcctatttccaaatccggtctcattccaggtcctgggctttaggatgtggacagatgtttctgggggccactgttccattcagtataattatattcagttccttccagggttctaggggaggctccttcctacctctcccagctcctgggggctccaggcatccctgggcttgtggccccatcactccagtctctgcctccgtctccacgtggcctcctcctctgtgtctgcgtctcctcctctgtctccgagaaggacacctgtcattggatttagaacccttccttctccagtatgacctcatcctaactaactgaatctataatgatcctaactaactgaatctataatgatcctttttttttttttttttttttttgagatagtctcgctctgtcacccaggctggagggcagtggttcaatctcggctcaccgcaacctccgcctccccggttcaagcgattctcctgcctcagcctcactaatagctgggattacaagcgctggccaccatgcctgtatttttagtagagacggggttttagcatattggccaggctggtctcgaactcctgacttcaggtgatccacccgcctcggccttctaaaggatcctatttttaaatacagttccattctgagtttctggggagttgggattttaacatatatttttgtgggggacttaatttagcccgtaacagacacacaggacattttccgcagaattttagagagttccttccttcacaaacctacaggttctcggagctctggtggaagcttctcctataaaagtaatgaggacgggtgaaccccgagacccataaggtattaaggggaggaggggtacaggctagagaaaggggatgaggtcagcctgtcacaatcagctcagagaggagggacgtcgcttccgttatttcttcttctcagtgaaacccagttccccgaagcacgtgagattttcgtggcatcaggatgcagtgacggtgacgtgttctgacctgtcctacggggatctcctctatgaggttcagtaccggagccccttcgacaccgagtggcaggtgagccgggcggccgcgactcagggcgatggtggctgagcgtcccccaggtgcgggctgtgggattcgctgtttcatcagacctcgctcccctctgtctacaccttcctgaattccactctgctgtatcttcctgagagagctctagtccagcttggctttttcatgtttctctctgtgtctctgaggggtctccagagaaagagaaccaataatatgtctgtctgtctgtctatcaatctatttatctatctatctatcaatctatctatatcattctattttatctctacctctatctatgtatctatatcattctatttccctctctttcaatctatcatctatctatctcattctattttatctctatctctgtctttcaatctatctcattctattttatctctatctctgtctttcaatctatcatctattttatctattaactctctttgttctatctatctctctatggctctatccatatctattttatctaccaactctcttttatctatctatgtatggtcaatcttctatatatatcatccctatctctatgtagttcaactatctatcatctctatctaactacccattatctctattctaccatctactatcttatctatgtatttatctatctatgtatgtatctatacatctatcatctatccgtctctatctatctaagtatcatctatctatctactctgtatcatctgtctgtctgtctctctatctatctaatgtatcatctatttatctctctatcatctgtctatgtatcatctatctctctatcattgctctatcatctatgtatcatctatctctctctcatcactctatcatctatgtatcatctatctatctctctatcatctatctatgtatcatctgtctctctctcatcgctctatcatctatgtatcatctatctatctatcatctgtctatgtatcatctatcaactctgtcatctctctgttttatctatgtatctatcatttctttatctgtctacctctagtcctatctctatctgtatctctacacacctgtctctctacacacacacacacacacacagacacacaaacacaggcacacagacacacacagacatgcacagacacacacagacacacacagacacacacaggcacacacacacagtcatgtgctgcctaacgaccttttggtcatcagcagactgcatgtatcacggtagtctcctatgattatcacacagctgtcctatgcagctgtcccaattattttcttctatatcatatttttcctgtaccttctctatgtttagatacacaaatacttacccttgcgttaggtttgtctgcagtattcagtacagtaacgtgctgtatggctgtgtagctgaagagcaatttactatacagcctaggtgtgcagcgggctagaccagctaggtgtgtgtaagtaaactctagaatattctcataatgaagaaatcacctcacaatgaatttcccagaacatgtccccatcgttaagcaatgcatgactgtatatctacctatatgtgtgtgtacacacacacatatacacacacatatgtacgtaccttgtgtacacagcttatatatacatatatacacacgcatatacacacatatagatacacagcttatatacacatatatatacacatgcatatacacacatatagatacacagcttatatacacacatatatacataccttatatatgcatatttatacacatgtatatacacatcttatatacgcacacatatacacacacacacagcttatatacacatatatatacccacacatatatacacagcttatatacacgtatatatatgtatatatgcaccttatatacacagcttatatacacatatttatacacacgtatacacacaccttatataaacacatatatacacacatatacacagcttatataacatatatacacacacatatatacataccttatatatgcatatttatacacatgtacatacacatcttatatacacatatatatacatacatatgtgcacagcttatatacacgtatatatacacatatatatgcaccttatatacacagcttatatacacatatttatacacacgtatacacacaccgtatatacacacacatacacacatatacacagcttatatacacagcttatatacaggtatatatacacacatgtatatacacacatgtatatatacacaaactttatatatatatacacacacagcttatatacaatacatatacacacatatatacacaccttatatacacacatatatacacacacatatatacagagcttatatacacagcttatatacacatatatatacacacgtatatacacacctaatatacacagcttatatatacacatatatacacacatacatatatacacaacacacgtacacagcttatatatacacatatatacacacacatatagatacatagcttatatatacacatatatacacatcttatatacatagcttctatacacacagatatacacacaccttatacacacaacttatatatacacaattatatatacacaccttatatatacagcttatatatacacacatatataaatatacatatagagatatcttattggtacatatatctacaaacatatataaactatatatgtataaactgatacatagaatagaacattcatctgtatctttatatccatttatatctgtaaagatatgtagatacaggctggatgcagtggctcacacctttaatcccagcactttgggaggccgaggagggtggatcacctgaggtcaggagttcaagaccagcctggccaacgtggtgaaacctcatctctactagaaatacaaaaattagccaagcatggtggtgcctgtaatccgagctactcgggaggctgaggcacaagaattgcttgaacccgacaggcagaggttgcagtgagccgagaccgcaccactgcactccagcctgggcaacagagcaagactctgtctcagtaaataaataaataatatattaaaataataataaagtaaatacaggccaggcacagtggctcatgcctgtaatcccagtactgttggaggccaaggcaggaggatcgcttgagcccaggagttgttgaccagcttgggcaacagagtgagaccccatctctttttctttttttagacacagtcccgctctgtcacccaggctggagtgcagtggtgcgatctctgcttgctacaaccttcgcctcccaggttcaagcgattctcctgcctcagcctcccaagtagctgggattacaggcacccgccaccacgcctggctaatttttgtattatcagtagagacggggtttctccatgttggccaggctggtctcgaacttgcgacctcaggtg

SEQ ID NO: 2841 - DNA, 16637 bp, human
atggggcggctggttctgctgtggggagctgccgtctttctgctgggaggctggatggctttggggcaaggaggagcaggtaattatttaaacaccctcttcttgttgtattttggtttgtggtttgctttgcaaccaggcactctttattttgtaaaacttaaacaatgagcatggaggtttctttcttcttttcttttttttttttttttttttccgggttcaagcaattctcctgcctcagcttctcaagtagctgggacaaaacatatttataagtaaatacatgaatattaagtatacttattgctcccggaatatccactgcttatatgagctttcggtggccagaactaggaactgtatgtgtgcgtgtgtgtgtctatctattgattgattgattggtagatatattcatttttaatctatccatcaatgtatctcatctatcttttcccattaatcacccatccatccactatccatccatctattattcattgatccatccactaatatatccatccacccatctatcaaacgattcatccactcatacattcacccacccatcaacccacccagccatccgtccacccaacctttcattcactcatccatccatccaccatccacccagctgttatctatccatcctcccatccacccatctatcatccatccatccatccatccacccatccacccatccatccaccaatacatccatccatccatccacccatccacccatccatctaccaatacatccatccatccatgcattcacccacacttttatccacttatccatccatccatccatccacccatccatccaccaatacatccatctatccatgcattcacccacacttttatccacttatccatccatccatccatccatccacccatccacccatccatccaccaatacatccatccatccatgcattcacccacacttttatccacttatccatccatccatccatccacccatccatccaccaatacatccatctatccatgcattcacccacacttttatccacttatccatccatccatccatccacccatccatccaccaatacatccatctatccatgcattcacccacacttttatccacttatccatccatccatccatccatccacccatccacccatccatccaccaatacatccatctatccatgcattcacccacacttttatccacttatccatccatccatccatccatccatccatccatccatccatccacccatccacccatccacccaccaatacatccatctatccatgcattcacccacacttttatccacttatccatccatccatccatccatccatccatccacccatccatccacccacccacccatccatgtacacatctacgtatccatctatccatgcatccatccatccatccatccatccatccattcacctatgtatctgttcatccatttatttatccactgactcactcatccacccacccatcctttcatccacttatccatctatccatccatccaccaacacatccatccacccacccatcaaaccatccatccacctatgcattcacccacactttcatccactcatccatccatccatccacccatccatgtacacatctatgtatccatctatccatgcatccatccacccatccacccattcacctgtgtatctgttcatccatttattcatccatccactcacccatccacccacccatccacttgtcttccacctatacacccacctgtccattgattcatccatctacctacccatccctatctatctgtgtctgtctgtctaactatttctatcatcatctatataattctatctatctaacattaccatttatctatctatctgtatctatctatcctccagatacctccacttagaacccaacatgacaaggttcactgtaccccatctttccaaacctgtaactgacttctttgacagtgagagacttggccgggcgctgtggctcatgcctgtaatcccagcactttgggaggccgaggtgggcggatcacaaggtcaggagatggagaccatcctggctaacacggtgaaaccccgtctgtactaatacaaaaaatcagccgggcatggtggcaggtgcctgtagtcccagctacttgggaggctgaggcaggagaatggcatgaacccgggaggcaaagcttgcagtgagccgggatcgcaccactgcactccagcgtgggcgacagagcgagactctgtctcaaaataaaaaaaagagacttggctttcattatgcaaaatatcattacatgtttgctcaattctaaaatatttccattgtccctgttcggaattacaaacccagacctcttgaaacatcaaacctactgaagtctatgcaaccttcctagcaaacgtagaaagtcttctttacggttggcccatttcttttcttttcttttcttttcttttcttttcttttttttttttgatagggagtcttgctgtgtcacccaggctggagtgcagtgacacgatctcggttcactacaacctctgcctcctgagttcaagccattctcctgcctcagcctcccaggtagctgggattacaggtacccaccaccatgtccagctcatttttttgtgtttttagtagagacggggtttcaccatgttggccaggctggtctcgaactcctgacctcgggtgatccacccgcctcggcctcccagtgttaagattacagacgtgagccgctgcacctggccagtccatttctgaagttggtgtgtgtggtgttttgagaaagacagtaaggtggatcgatggggacagtttccgatgccaccttaggtatccacaggggatgtgttgttggatacatgattgatctatacagatacatctgtgcatggcactagtgggtgaacttaccttttgcaaaaacaaaaacaaaagcagccgggcgcggtggctcacgcctgcaatctcagcactttaggtggatgaggcgggcggatcacgaggtcaggagatcgagaccatcctggctaacacagtgaaaccccatctctactaaaagtacaaaaaattatccaggcatggtggcgggcacctgtagccccagctactcgggaggctgaggcaggagaatggcgtgaacccgggaggcggagcttgcagtgagccgagattgcgccactgcagtccagcctgggtgacagagtgagagtctgtctcacacaatacactacactacactacactacactacactacactacactacactacaatacaatgcaatacaatgcaatacaatacgtcaggcgcggtggctcacgcctgtaatcccagtactttgggaggccgaggcgggtggatcatgaggtcaggagatcgagaccatcctggctaacacggtgaaaccccgtctctactaaaaatacaaaaaattagccaggtgtggtgacaggtgcctgtaatcccggctactcgggaggctgaggcaggggaatcgcttgaacccgggaggcggaggttgcagtgagccgagatcgtgccattgtactccagcctgggcaacagagtgagactctgtctcaaaaagaaaaataaatttaaaaaaataaaaaaatagagttgcctcaccgtgaacttcatgcgtctctctgtgtctagcagaaggagtacagattcagatcatctacttcaatttagaaaccgtgcaggtgacatggaatgccagcaaatactccaggaccaacctgactttccactacaggtaagtggcccccagaaagcgaaccccacgcccagggggctcaaaatcgctcttctgagccgtcagcgattgggaatgcttgagaacaaaagtgtaaagcatcagactgtgcaagccggaatgtttgttctgtgaaaccctcagccctcaccacaaccacaatctcattgccccaaaccttcttgccaagggatggctgactcactgtcaaaatcaactacattcttttttttgtttgtttttattttgagtcggagtctcactccgttgccacgctggagtgcagtggcgcaatctcggctcactgcaacctctgcctcccgggttcaagccattcccctgcctcagcctcccgagtagctgggattacaggcacctgccaccatgcctagctaatttttgtatttttagtagagatggtgattcaccatattggtcaggccggtttcaaactcctgacctcatgtgatccacctgcctcagcctcccaaagtgctgggatgacaggcgtgagccacggcatccggactgaaaatcacctagattcttcacgggagattaacagagagttttgttcacccagagctctgggtgaactttaagtcttatctgctaggcagccggggagggaaagactcagtctctgaaacatttcacagccttacccggggctacccccaaccctgtgtctccctgatgtgactttatttttatttttactttggcttagttagacacccagaagtatgcgtacgaacattgcaggaagggtttttccaataaatttaatcatgggtggatgattcttcagtttgataacaaaagagataaacggcaaagcgtacagaacagggaaattttaaaacgaagttatttggaaaataagactcaccgttgggagaccgaggtgggtggatcatctgagatcaggagttccagaccatcctggccaacatggtgaaaccccaactctactaaaaatacaaaaactagccgggcgtggcggcaggtgcctgtaatcccagctactcaggaggctgaggcaagagaatcgcttcaacctgggagacggagttcacggtgagccgagattgcactccagcctggccgacagagcgagactgtctcaaaaacaaaacaaaacaaaacaaaaacctcacaaaaagaaaaaaaaaagtgctggattttgcacgtagttgcagaattcagctcagtttcttcctctgtaaaaggggcagttcttggggggggtgttggctcatgcctgttatcccagcactttgggaggctgaggggggggggggtggatcacctgaggtcaggagttcaagaccagcctggccaacatggtgaaacctcgtctctactaaaaatacaaaaaaattagccgggcgcgggggcgtgcgcctgtaatcccagcaacttgggaggctgaggcaggagaatcgcttgaatccgggaggcagaggttgcagtgggccgagatcacgccattgcactccagcctgggcaacaagaacaaaactctgtttcaaaaaacaaacgaacaaataaaaaaacggccgggcgcggtggctcacgcctgtaatcccagcactctgggaggccgaggcgggtggatcacctgaggtcaggagatcgagaccagcctggtcaacatggcgaaatcccatctctattaaaaacacaaaaattagctgggggtggtggtgcgtgcccgtaatcccagctactcaggaggcagaggcaggagaatcgcttgaacccgggaggcagagattgcaatgagccgagatcgtgccactgcactccagcctcagggacagagcgagacaccatcttaaaaaaaaaaaaaaaaaaaaagccggtgtggtagctcacacctctcattccagcagtttgggaggccaaggtgtatggatcacctgaggtcaggagttccagaccagcctggccccaacatggtgaaaccctgtctccagtaaaactacaaaaattagctgtatatggtggcaggtgcctgtaatcccagctactcaggaggctgagacaggagaattgcttgaacccgggaggcagaggttgcagtgagctgagatcgcgccattgcactccaacctgggcgacaagagcaagaccccatctctaaataaataagacatgcttttttgttttgttgctgaatggtcatcgttttaaaccacagattcaacggtgatgaggcctatgaccagtgcaccaactaccttctccaggaaggtcacacttcggggtgcctcctagacgcagagcagcgagacgacattctctatttctccatcaggaatgggacgcaccccgttttcaccgcaagtcgctggatggtttattaccgtaagtattgtaaagccagctcaccatgcttttcagtacttccttcagcttattaccacaaggactgaaaaccaagctcatgcaaatcgccggatccatgattaccgttaactattgagaagcaagctcaccatgcctttcagtacttcctgcagcttattactgtaagtaacgaaaaaccaagctccagccagtcgcgggatcaatgattcccgtaactattgaaaaggaagctcagcatagttttcagtacttccttcagcttattaccgtaagtactgaaaagctcacgtaaatcgtcggatccatgattaccgtaataattgaaaagcaagctcagcacgcttttcactacttccttcagctgattaccgtaagtaccgaaaagcaatctcatgatagtcgctggatcaatgattaccgtaaccactgaaaagcaacccagcctacttttcgctacttccttcaggttattaccataagtactgaaaagctcatgcaaattaccggatccatgattaccataactattgaaaagcaagctcaccatgcttttcgtacttccttcagcttattaccataagtactgataaagcaagctcatgcaagtcactggatcagtgattaccgtagctattgaaaagcaagctcaccatgcttttcagtacttccttcagcttattaccataagtactgaaaagcaagctctagcaagtcgcaggatcagattcccgtaactattgaaaagcagcccagcatccttttcactacttccttcagcttattgccataaataaaaaagctcatgcaaataaccggatccatgattaccgtaactattgaaaagcaagctcaacatgcttttcagtatttccttcagcttattaccataagtactgaaaagcaagctctcgcaagtcgcgggatcaatgattaccataacaattgaaaagcaagctcagcatgcttttcagtacttccttcagctgattatcataagtaccgaaaagcaagctctcgcaagtcgcgggatcaatgattaccgtaacgattgaaaagcaatcccagcacacttttcagtaccccttcatctccttaccttcagttactttcagttaagttctgaaaatcaagctcatggaccattggccactagagcccggtgcccagctcctcactccaagtgggaagaaaccggccttccaggaagttccctcttacacgcacactggttggggattgaatctgcccccagtggggagaccagatgaccccgggagactgtgatttaagggaatgaattaaaggcggggcgcggtggctcacgcctgtaatcccagcactatgggaggccaaggcgggcggatcacttgaggtctggagttcgagaccagcctcaccaacatggtgaaaccccatctctacaaacaaacaaacaaacaaaaaattagccgggctggtggcgcatgcctgtaatcctagctgttcgggaggctgaggcagggaaattgcttgaacctgggaggcagaggctgcagtgagccacgttggtgccactgcactccagcctgggcgatttataaattcattatttaaaaataaataaggcccagggtggtggcttacccctgtaatcccagtactttgggagaccaaggcgggcggatcacttgaggtctggagttcgagaccagccttgccaacgtggtgaaaccccgtctctattaaaaataatttaaaaaaaattagccaggcgtggtggcacacgcttgtaatcccagctactcgggaggctgaggcagggaaattgcttgaacccgggaggcggaggctgcagtgagccaagacggtgccactgcactgcagcctgggcgatttataaatttattatttaaaaataaataaggcccagggcggtggctctcccctgtaatcccagtactttgggaggccaaggcagggggatcacgtgacgtggggagttcgagaccagcctgaccaacatggagaaactccatctctattaaaaatacataattagccgggcttggtggtgcatgcctgtaatcccagctactcgggacgctgaggcaggagaatctcttgaatctgggaggcggagtttgtggtgagccgagatcgcgccattgcactccagcctggacaacaagagtgaaactccatctcaaataaataaattcattaaattaaataagggaattaattagagatgctctctggtgccctgcctacacacacacacacacacacacacacacacacacacacacacacacagagtgagctggaaatactctctcatcctcatcccactcactggatgttctctctctttttttttttttttttgagagagagggtcttcctctgttgcccaggctggttttcttatgtgcgttgagaactggctgttaagtctcgggcgaggaaatgagggacaaatgtagggaaaccctgtttccaaaatgtttattctttatcctagaattctgtaaggctgtgtttcttttttacttttttattttttagaggtaggggaaacggatctgtttgagaatccggtgagaactatgaactctttattcgcgaaattacttacagatactgggtgcgtttcctgggctataataggtcaccacaaactggaggcttaaaacagcagaaatttattctctcccagttttgaagcccatgagtctgagatggagatgtctgagagccgcattccctctggaggttctaagggaggatccttcctgcctctcccagctcctgggggctccaggcatccctgggcttgtggccgcatcactccagtctctgcctccgtctccatgtggccttctcctctgtgtctcctcttctgtctcttacaagggcacctgtcattagatttaggggacaccctactccaggatgatctcacctcaaggtccttcacctaattacatctgcagagagcctatttccaaatccggtctcattccaggtcctgggctttaggatgtggacagatgtttctgggggccactgttccattcagtataattatattcagttccttccagggttctaggggaggctccttcctacctctcccagctcctgggggctccaggcatccctgggcttgtggccccatcactccagtctctgcctccgtctccacgtggcctcctcctctgtgtctgcgtctcctcctctgtctccgagaaggacacctgtcattggatttagaacccttccttctccagtatgacctcatcctaactaactgaatctataatgatcctaactaactgaatctataatgatcctttttttttttttttttttttttgagatagtctcgctctgtcacccaggctggagggcagtggttcaatctcggctcaccgcaacctccgcctccccggttcaagcgattctcctgcctcagcctcactaatagctgggattacaagcgctggccaccatgcctgtatttttagtagagacggggttttagcatattggccaggctggtctcgaactcctgacttcaggtgatccacccgcctcggccttctaaaggatcctatttttaaatacagttccattctgagtttctggggagttgggattttaacatatatttttgtgggggacttaatttagcccgtaacagacacacaggacattttccgcagaattttagagagttccttccttcacaaacctacaggttctcggagctctggtggaagcttctcctataaaagtaatgaggacgggtgaaccccgagacccataaggtattaaggggaggaggggtacaggctagagaaaggggatgaggtcagcctgtcacaatcagctcagagaggagggacgtcgcttccgttatttcttcttctcagtgaaacccagttccccgaagcacgtgagattttcgtggcatcaggatgcagtgacggtgacgtgttctgacctgtcctacggggatctcctctatgaggttcagtaccggagccccttcgacaccgagtggcaggtgagccgggcggccgcgactcagggcgatggtggctgagcgtcccccaggtgcgggctgtgggattcgctgtttcatcagacctcgctcccctctgtctacaccttcctgaattccactctgctgtatcttcctgagagagctctagtccagcttggctttttcatgtttctctctgtgtctctgaggggtctccagagaaagagaaccaataatatgtctgtctgtctgtctatcaatctatttatctatctatctatcaatctatctatatcattctattttatctctacctctatctatgtatctatatcattctatttccctctctttcaatctatcatctatctatctcattctattttatctctatctctgtctttcaatctatctcattctattttatctctatctctgtctttcaatctatcatctattttatctattaactctctttgttctatctatctctctatggctctatccatatctattttatctaccaactctcttttatctatctatgtatggtcaatcttctatatatatcatccctatctctatgtagttcaactatctatcatctctatctaactacccattatctctattctaccatctactatcttatctatgtatttatctatctatgtatgtatctatacatctatcatctatccgtctctatctatctaagtatcatctatctatctactctgtatcatctgtctgtctgtctctctatctatctaatgtatcatctatttatctctctatcatctgtctatgtatcatctatctctctatcattgctctatcatctatgtatcatctatctctctctcatcactctatcatctatgtatcatctatctatctctctatcatctatctatgtatcatctgtctctctctcatcgctctatcatctatgtatcatctatctatctatcatctgtctatgtatcatctatcaactctgtcatctctctgttttatctatgtatctatcatttctttatctgtctacctctagtcctatctctatctgtatctctacacacctgtctctctacacacacacacacacacacagacacacaaacacaggcacacagacacacacagacatgcacagacacacacagacacacacagacacacacaggcacacacacacagtcatgtgctgcctaacgaccttttggtcatcagcagactgcatgtatcacggtagtctcctatgattatcacacagctgtcctatgcagctgtcccaattattttcttctatatcatatttttcctgtaccttctctatgtttagatacacaaatacttacccttgcgttaggtttgtctgcagtattcagtacagtaacgtgctgtatggctgtgtagctgaagagcaatttactatacagcctaggtgtgcagcgggctagaccagctaggtgtgtgtaagtaaactctagaatattctcataatgaagaaatcacctcacaatgaatttcccagaacatgtccccatcgttaagcaatgcatgactgtatatctacctatatgtgtgtgtacacacacacatatacacacacatatgtacgtaccttgtgtacacagcttatatatacatatatacacacgcatatacacacatatagatacacagcttatatacacatatatatacacatgcatatacacacatatagatacacagcttatatacacacatatatacataccttatatatgcatatttatacacatgtatatacacatcttatatacgcacacatatacacacacacacagcttatatacacatatatatacccacacatatatacacagcttatatacacgtatatatatgtatatatgcaccttatatacacagcttatatacacatatttatacacacgtatacacacaccttatataaacacatatatacacacatatacacagcttatataacatatatacacacacatatatacataccttatatatgcatatttatacacatgtacatacacatcttatatacacatatatatacatacatatgtgcacagcttatatacacgtatatatacacatatatatgcaccttatatacacagcttatatacacatatttatacacacgtatacacacaccgtatatacacacacatacacacatatacacagcttatatacacagcttatatacaggtatatatacacacatgtatatacacacatgtatatatacacaaactttatatatatatacacacacagcttatatacaatacatatacacacatatatacacaccttatatacacacatatatacacacacatatatacagagcttatatacacagcttatatacacatatatatacacacgtatatacacacctaatatacacagcttatatatacacatatatacacacatacatatatacacaacacacgtacacagcttatatatacacatatatacacacacatatagatacatagcttatatatacacatatatacacatcttatatacatagcttctatacacacagatatacacacaccttatacacacaacttatatatacacaattatatatacacaccttatatatacagcttatatatacacacatatataaatatacatatagagatatcttattggtacatatatctacaaacatatataaactatatatgtataaactgatacatagaatagaacattcatctgtatctttatatccatttatatctgtaaagatatgtagatacaggctggatgcagtggctcacacctttaatcccagcactttgggaggccgaggagggtggatcacctgaggtcaggagttcaagaccagcctggccaacgtggtgaaacctcatctctactagaaatacaaaaattagccaagcatggtggtgcctgtaatccgagctactcgggaggctgaggcacaagaattgcttgaacccgacaggcagaggttgcagtgagccgagaccgcaccactgcactccagcctgggcaacagagcaagactctgtctcagtaaataaataaataatatattaaaataataataaagtaaatacaggccaggcacagtggctcatgcctgtaatcccagtactgttggaggccaaggcaggaggatcgcttgagcccaggagttgttgaccagcttgggcaacagagtgagaccccatctctttttctttttttagacacagtcccgctctgtcacccaggctggagtgcagtggtgcgatctctgcttgctacaaccttcgcctcccaggttcaagcgattctcctgcctcagcctcccaagtagctgggattacaggcacccgccaccacgcctggctaatttttgtattatcagtagagacggggtttctccatgttggccaggctggtctcgaacttgcgacctcaggtgatccacccgcctcagcctcccaaagcgttgggtttacaggagtgagccactgtgtccggcctcgcggctccattcttgaagtcagcgagactgtgaaccctccggaaggaaaactctggacagacaggttacatcactaatcattgtgtgtgtgtgtgtgtgtgtgtgtgtgtgtgtgtgtgtgtgtgtgtatgtgtatgtttctccagtccaaacaggaaaatacctgcaacgtcaccatagaaggcttggatgccgagaagtgttactctttctgggtcagggtgaaggctatggaggatgtatatgggccagacacatacccaagcgactggtcagaggtgacatgctggcagagaggcgagattcggggtaatgcttgttacacggcagtgtcccatagccttgtcaccaggctggagtaggcatagccactgccttcccgggaggtgggagggagggtgtcctgccttcgaggtgggagggagggtgtcctgccttcctgggaggtgggagggagggtgtcctgccttcgaggtgggagggagggtgtcctatcttcccgggaggtgggagggagggtgtcctatcttcccgggaggtgggagggaggctgtcctgccttcgaggtgggagggagggtgtcctgccttcctgggaggtgggagggagggtgtcctgccttcctaggaggtgggagggagggtgtcctgccttcctgggaggtgggagggagggtgtcctgccttcgaggtgggagggagggtgtcctgtcttcccgggaggtgggagggagggtgtcctatcttcccgggaggtgggagggaggctgtcctgccttcgaggtgggagggagggtgtcctgccttcctgggaggtgggagggagggtgtcctgccttcctaggaggtgggagggagggtgtcctgccttcctgggaggtgggagggagggtgtcctgccttcgaggtgggagggagggtgtcctgccttcctgggaggtgggagggagggtgtcctgccttctaggtgggagggagggtgtcctgccttcctgggaggtgggagggagggtgtcctgccttcgaggtgggagggagggtgtcctgccttcctgggaggtgggagggagggtgtcctgccttctaggtgggagggagggtgtcctgccttcctgggaggtgggagggagggtgtcctgccttcgaggtgggagggagggtgtcctgccttcctgggaggtgggagggagggtgtcctgccttcgaggtgggagggagggtgtcctgccttcctgggaggtgggagggagggtgtcctgccttcctgggaggtgggagggagggtgtcctgccttcctgggaggtgggagggagggtgtcctgccttcctgggaggtgggagggagggtgtcctgccttcctgggaggtgggagggagggtgtcctgccttcctgggaggtgggagggagggtgtcctgccttcctgggaggtgggagggagggtgtcctgccttcgaggtgggagggagggtgtcctgccttcccaggagggtgtgtctgagcaagctcagccttctgtcatcctccagggccccatctgaaagtaattcctctccttgtttcattctcgggctgctttcacttgggagagttttctttcttttgtttttttgagaaacattctcatggtgcccaggctggagtgcagtggcgcgatctcggctccctgcaacatctgtctcccacgttcaatcgattctcccgcctcagcctcccgagtgcctgggattacagtgtacacgccaccacacctgattaaatctttttattttttatttttttatttttatttttttttagagggagtctcagtctgtggtccaggctggagttcagtggcacggtcttggctcactgcaacctccgcctcccgagttcaagtgattctcctgcctcagcctcccaagtagctgggactacaggcacgcaccaccaagcccgcctaatgtttgtatttttagtagggatggcgtttccccatattggccaggctggtctcgaactcctgaccttgtgatccgcccgcctcggcctcccaaagtgctgggattaaaggcgtgagccaccgcgcccggcctttgacgtatgttttcagggggcatgatttaaggagcacagccaccaacacacgaaagcaagctctcatatgctgtaaacacctccagcaaccagaagcctccaaaggctacatgttggacctgcccttacttcctcggggtggctgtgggatgtgttgttgtccagagacacggtgtctctttccaggatattttccataggaatgaaaatttgctgacactaacattcattaaaaaaaaaaaataggtccatctctactaaaaatacaaaaattagcccggtgtggtggcggatgcctgtcatcccagctgctcaggaggctgagacaggagaatcgcttgagtccgggagacggaggttgcagtgagctgagatggagccactgcactccagcctgggcaacagagtgaggttctgcctcaaaaaaaaaaaaaaaaaaaagtaaaagatttgctgacacgaatatttacaaaaaacaaaaacaaaacaaaaaacaaacaacgagaaccaagaaaaaaaaacgaacaccaaaaaatgagggagactggttagggatgagatgtaacatcacgttgaaaacgtacagccgcacgtcatgttgaaaactgacagccgccttttcattttgtttcagatgcctgtgcagagacaccaacgcctcccaaaccaaagctgtccaaatttattttaatttccagcctggccatccttctgatggtgtctctcctccttctgtctttatggaaattatggaggta

SEQ ID NO: 2842 - DNA, 16722 bp, human
aaaatcgatggtgacctctgcttatgagtcatgagtgatctgttcgttgtaggtccctgaggacctcactctccactcctgtttcaggcatggggcggctggttctgctgtggggagctgccgtctttctgctgggaggctggatggctttggggcaaggaggagcaggtaattatttaaacaccctcttcttgttgtattttggtttgtggtttgctttgcaaccaggcactctttattttgtaaaacttaaacaatgagcatggaggtttctttcttcttttcttttttttttttttttttttccgggttcaagcaattctcctgcctcagcttctcaagtagctgggacaaaacatatttataagtaaatacatgaatattaagtatacttattgctcccggaatatccactgcttatatgagctttcggtggccagaactaggaactgtatgtgtgcgtgtgtgtgtctatctattgattgattgattggtagatatattcatttttaatctatccatcaatgtatctcatctatcttttcccattaatcacccatccatccactatccatccatctattattcattgatccatccactaatatatccatccacccatctatcaaacgattcatccactcatacattcacccacccatcaacccacccagccatccgtccacccaacctttcattcactcatccatccatccaccatccacccagctgttatctatccatcctcccatccacccatctatcatccatccatccatccatccacccatccacccatccatccaccaatacatccatccatccatccacccatccacccatccatctaccaatacatccatccatccatgcattcacccacacttttatccacttatccatccatccatccatccacccatccatccaccaatacatccatctatccatgcattcacccacacttttatccacttatccatccatccatccatccatccacccatccacccatccatccaccaatacatccatccatccatgcattcacccacacttttatccacttatccatccatccatccatccacccatccatccaccaatacatccatctatccatgcattcacccacacttttatccacttatccatccatccatccatccacccatccatccaccaatacatccatctatccatgcattcacccacacttttatccacttatccatccatccatccatccatccacccatccacccatccatccaccaatacatccatctatccatgcattcacccacacttttatccacttatccatccatccatccatccatccatccatccatccatccatccacccatccacccatccacccaccaatacatccatctatccatgcattcacccacacttttatccacttatccatccatccatccatccatccatccatccacccatccatccacccacccacccatccatgtacacatctacgtatccatctatccatgcatccatccatccatccatccatccatccattcacctatgtatctgttcatccatttatttatccactgactcactcatccacccacccatcctttcatccacttatccatctatccatccatccaccaacacatccatccacccacccatcaaaccatccatccacctatgcattcacccacactttcatccactcatccatccatccatccacccatccatgtacacatctatgtatccatctatccatgcatccatccacccatccacccattcacctgtgtatctgttcatccatttattcatccatccactcacccatccacccacccatccacttgtcttccacctatacacccacctgtccattgattcatccatctacctacccatccctatctatctgtgtctgtctgtctaactatttctatcatcatctatataattctatctatctaacattaccatttatctatctatctgtatctatctatcctccagatacctccacttagaacccaacatgacaaggttcactgtaccccatctttccaaacctgtaactgacttctttgacagtgagagacttggccgggcgctgtggctcatgcctgtaatcccagcactttgggaggccgaggtgggcggatcacaaggtcaggagatggagaccatcctggctaacacggtgaaaccccgtctgtactaatacaaaaaatcagccgggcatggtggcaggtgcctgtagtcccagctacttgggaggctgaggcaggagaatggcatgaacccgggaggcaaagcttgcagtgagccgggatcgcaccactgcactccagcgtgggcgacagagcgagactctgtctcaaaataaaaaaaagagacttggctttcattatgcaaaatatcattacatgtttgctcaattctaaaatatttccattgtccctgttcggaattacaaacccagacctcttgaaacatcaaacctactgaagtctatgcaaccttcctagcaaacgtagaaagtcttctttacggttggcccatttcttttcttttcttttcttttcttttcttttcttttttttttttgatagggagtcttgctgtgtcacccaggctggagtgcagtgacacgatctcggttcactacaacctctgcctcctgagttcaagccattctcctgcctcagcctcccaggtagctgggattacaggtacccaccaccatgtccagctcatttttttgtgtttttagtagagacggggtttcaccatgttggccaggctggtctcgaactcctgacctcgggtgatccacccgcctcggcctcccagtgttaagattacagacgtgagccgctgcacctggccagtccatttctgaagttggtgtgtgtggtgttttgagaaagacagtaaggtggatcgatggggacagtttccgatgccaccttaggtatccacaggggatgtgttgttggatacatgattgatctatacagatacatctgtgcatggcactagtgggtgaacttaccttttgcaaaaacaaaaacaaaagcagccgggcgcggtggctcacgcctgcaatctcagcactttaggtggatgaggcgggcggatcacgaggtcaggagatcgagaccatcctggctaacacagtgaaaccccatctctactaaaagtacaaaaaattatccaggcatggtggcgggcacctgtagccccagctactcgggaggctgaggcaggagaatggcgtgaacccgggaggcggagcttgcagtgagccgagattgcgccactgcagtccagcctgggtgacagagtgagagtctgtctcacacaatacactacactacactacactacactacactacactacactacactacaatacaatgcaatacaatgcaatacaatacgtcaggcgcggtggctcacgcctgtaatcccagtactttgggaggccgaggcgggtggatcatgaggtcaggagatcgagaccatcctggctaacacggtgaaaccccgtctctactaaaaatacaaaaaattagccaggtgtggtgacaggtgcctgtaatcccggctactcgggaggctgaggcaggggaatcgcttgaacccgggaggcggaggttgcagtgagccgagatcgtgccattgtactccagcctgggcaacagagtgagactctgtctcaaaaagaaaaataaatttaaaaaaataaaaaaatagagttgcctcaccgtgaacttcatgcgtctctctgtgtctagcagaaggagtacagattcagatcatctacttcaatttagaaaccgtgcaggtgacatggaatgccagcaaatactccaggaccaacctgactttccactacaggtaagtggcccccagaaagcgaaccccacgcccagggggctcaaaatcgctcttctgagccgtcagcgattgggaatgcttgagaacaaaagtgtaaagcatcagactgtgcaagccggaatgtttgttctgtgaaaccctcagccctcaccacaaccacaatctcattgccccaaaccttcttgccaagggatggctgactcactgtcaaaatcaactacattcttttttttgtttgtttttattttgagtcggagtctcactccgttgccacgctggagtgcagtggcgcaatctcggctcactgcaacctctgcctcccgggttcaagccattcccctgcctcagcctcccgagtagctgggattacaggcacctgccaccatgcctagctaatttttgtatttttagtagagatggtgattcaccatattggtcaggccggtttcaaactcctgacctcatgtgatccacctgcctcagcctcccaaagtgctgggatgacaggcgtgagccacggcatccggactgaaaatcacctagattcttcacgggagattaacagagagttttgttcacccagagctctgggtgaactttaagtcttatctgctaggcagccggggagggaaagactcagtctctgaaacatttcacagccttacccggggctacccccaaccctgtgtctccctgatgtgactttatttttatttttactttggcttagttagacacccagaagtatgcgtacgaacattgcaggaagggtttttccaataaatttaatcatgggtggatgattcttcagtttgataacaaaagagataaacggcaaagcgtacagaacagggaaattttaaaacgaagttatttggaaaataagactcaccgttgggagaccgaggtgggtggatcatctgagatcaggagttccagaccatcctggccaacatggtgaaaccccaactctactaaaaatacaaaaactagccgggcgtggcggcaggtgcctgtaatcccagctactcaggaggctgaggcaagagaatcgcttcaacctgggagacggagttcacggtgagccgagattgcactccagcctggccgacagagcgagactgtctcaaaaacaaaacaaaacaaaacaaaaacctcacaaaaagaaaaaaaaaagtgctggattttgcacgtagttgcagaattcagctcagtttcttcctctgtaaaaggggcagttcttggggggggtgttggctcatgcctgttatcccagcactttgggaggctgaggggggggggggtggatcacctgaggtcaggagttcaagaccagcctggccaacatggtgaaacctcgtctctactaaaaatacaaaaaaattagccgggcgcgggggcgtgcgcctgtaatcccagcaacttgggaggctgaggcaggagaatcgcttgaatccgggaggcagaggttgcagtgggccgagatcacgccattgcactccagcctgggcaacaagaacaaaactctgtttcaaaaaacaaacgaacaaataaaaaaacggccgggcgcggtggctcacgcctgtaatcccagcactctgggaggccgaggcgggtggatcacctgaggtcaggagatcgagaccagcctggtcaacatggcgaaatcccatctctattaaaaacacaaaaattagctgggggtggtggtgcgtgcccgtaatcccagctactcaggaggcagaggcaggagaatcgcttgaacccgggaggcagagattgcaatgagccgagatcgtgccactgcactccagcctcagggacagagcgagacaccatcttaaaaaaaaaaaaaaaaaaaaagccggtgtggtagctcacacctctcattccagcagtttgggaggccaaggtgtatggatcacctgaggtcaggagttccagaccagcctggccccaacatggtgaaaccctgtctccagtaaaactacaaaaattagctgtatatggtggcaggtgcctgtaatcccagctactcaggaggctgagacaggagaattgcttgaacccgggaggcagaggttgcagtgagctgagatcgcgccattgcactccaacctgggcgacaagagcaagaccccatctctaaataaataagacatgcttttttgttttgttgctgaatggtcatcgttttaaaccacagattcaacggtgatgaggcctatgaccagtgcaccaactaccttctccaggaaggtcacacttcggggtgcctcctagacgcagagcagcgagacgacattctctatttctccatcaggaatgggacgcaccccgttttcaccgcaagtcgctggatggtttattaccgtaagtattgtaaagccagctcaccatgcttttcagtacttccttcagcttattaccacaaggactgaaaaccaagctcatgcaaatcgccggatccatgattaccgttaactattgagaagcaagctcaccatgcctttcagtacttcctgcagcttattactgtaagtaacgaaaaaccaagctccagccagtcgcgggatcaatgattcccgtaactattgaaaaggaagctcagcatagttttcagtacttccttcagcttattaccgtaagtactgaaaagctcacgtaaatcgtcggatccatgattaccgtaataattgaaaagcaagctcagcacgcttttcactacttccttcagctgattaccgtaagtaccgaaaagcaatctcatgatagtcgctggatcaatgattaccgtaaccactgaaaagcaacccagcctacttttcgctacttccttcaggttattaccataagtactgaaaagctcatgcaaattaccggatccatgattaccataactattgaaaagcaagctcaccatgcttttcgtacttccttcagcttattaccataagtactgataaagcaagctcatgcaagtcactggatcagtgattaccgtagctattgaaaagcaagctcaccatgcttttcagtacttccttcagcttattaccataagtactgaaaagcaagctctagcaagtcgcaggatcagattcccgtaactattgaaaagcagcccagcatccttttcactacttccttcagcttattgccataaataaaaaagctcatgcaaataaccggatccatgattaccgtaactattgaaaagcaagctcaacatgcttttcagtatttccttcagcttattaccataagtactgaaaagcaagctctcgcaagtcgcgggatcaatgattaccataacaattgaaaagcaagctcagcatgcttttcagtacttccttcagctgattatcataagtaccgaaaagcaagctctcgcaagtcgcgggatcaatgattaccgtaacgattgaaaagcaatcccagcacacttttcagtaccccttcatctccttaccttcagttactttcagttaagttctgaaaatcaagctcatggaccattggccactagagcccggtgcccagctcctcactccaagtgggaagaaaccggccttccaggaagttccctcttacacgcacactggttggggattgaatctgcccccagtggggagaccagatgaccccgggagactgtgatttaagggaatgaattaaaggcggggcgcggtggctcacgcctgtaatcccagcactatgggaggccaaggcgggcggatcacttgaggtctggagttcgagaccagcctcaccaacatggtgaaaccccatctctacaaacaaacaaacaaacaaaaaattagccgggctggtggcgcatgcctgtaatcctagctgttcgggaggctgaggcagggaaattgcttgaacctgggaggcagaggctgcagtgagccacgttggtgccactgcactccagcctgggcgatttataaattcattatttaaaaataaataaggcccagggtggtggcttacccctgtaatcccagtactttgggagaccaaggcgggcggatcacttgaggtctggagttcgagaccagccttgccaacgtggtgaaaccccgtctctattaaaaataatttaaaaaaaattagccaggcgtggtggcacacgcttgtaatcccagctactcgggaggctgaggcagggaaattgcttgaacccgggaggcggaggctgcagtgagccaagacggtgccactgcactgcagcctgggcgatttataaatttattatttaaaaataaataaggcccagggcggtggctctcccctgtaatcccagtactttgggaggccaaggcagggggatcacgtgacgtggggagttcgagaccagcctgaccaacatggagaaactccatctctattaaaaatacataattagccgggcttggtggtgcatgcctgtaatcccagctactcgggacgctgaggcaggagaatctcttgaatctgggaggcggagtttgtggtgagccgagatcgcgccattgcactccagcctggacaacaagagtgaaactccatctcaaataaataaattcattaaattaaataagggaattaattagagatgctctctggtgccctgcctacacacacacacacacacacacacacacacacacacacacacacacagagtgagctggaaatactctctcatcctcatcccactcactggatgttctctctctttttttttttttttttgagagagagggtcttcctctgttgcccaggctggttttcttatgtgcgttgagaactggctgttaagtctcgggcgaggaaatgagggacaaatgtagggaaaccctgtttccaaaatgtttattctttatcctagaattctgtaaggctgtgtttcttttttacttttttattttttagaggtaggggaaacggatctgtttgagaatccggtgagaactatgaactctttattcgcgaaattacttacagatactgggtgcgtttcctgggctataataggtcaccacaaactggaggcttaaaacagcagaaatttattctctcccagttttgaagcccatgagtctgagatggagatgtctgagagccgcattccctctggaggttctaagggaggatccttcctgcctctcccagctcctgggggctccaggcatccctgggcttgtggccgcatcactccagtctctgcctccgtctccatgtggccttctcctctgtgtctcctcttctgtctcttacaagggcacctgtcattagatttaggggacaccctactccaggatgatctcacctcaaggtccttcacctaattacatctgcagagagcctatttccaaatccggtctcattccaggtcctgggctttaggatgtggacagatgtttctgggggccactgttccattcagtataattatattcagttccttccagggttctaggggaggctccttcctacctctcccagctcctgggggctccaggcatccctgggcttgtggccccatcactccagtctctgcctccgtctccacgtggcctcctcctctgtgtctgcgtctcctcctctgtctccgagaaggacacctgtcattggatttagaacccttccttctccagtatgacctcatcctaactaactgaatctataatgatcctaactaactgaatctataatgatcctttttttttttttttttttttttgagatagtctcgctctgtcacccaggctggagggcagtggttcaatctcggctcaccgcaacctccgcctccccggttcaagcgattctcctgcctcagcctcactaatagctgggattacaagcgctggccaccatgcctgtatttttagtagagacggggttttagcatattggccaggctggtctcgaactcctgacttcaggtgatccacccgcctcggccttctaaaggatcctatttttaaatacagttccattctgagtttctggggagttgggattttaacatatatttttgtgggggacttaatttagcccgtaacagacacacaggacattttccgcagaattttagagagttccttccttcacaaacctacaggttctcggagctctggtggaagcttctcctataaaagtaatgaggacgggtgaaccccgagacccataaggtattaaggggaggaggggtacaggctagagaaaggggatgaggtcagcctgtcacaatcagctcagagaggagggacgtcgcttccgttatttcttcttctcagtgaaacccagttccccgaagcacgtgagattttcgtggcatcaggatgcagtgacggtgacgtgttctgacctgtcctacggggatctcctctatgaggttcagtaccggagccccttcgacaccgagtggcaggtgagccgggcggccgcgactcagggcgatggtggctgagcgtcccccaggtgcgggctgtgggattcgctgtttcatcagacctcgctcccctctgtctacaccttcctgaattccactctgctgtatcttcctgagagagctctagtccagcttggctttttcatgtttctctctgtgtctctgaggggtctccagagaaagagaaccaataatatgtctgtctgtctgtctatcaatctatttatctatctatctatcaatctatctatatcattctattttatctctacctctatctatgtatctatatcattctatttccctctctttcaatctatcatctatctatctcattctattttatctctatctctgtctttcaatctatctcattctattttatctctatctctgtctttcaatctatcatctattttatctattaactctctttgttctatctatctctctatggctctatccatatctattttatctaccaactctcttttatctatctatgtatggtcaatcttctatatatatcatccctatctctatgtagttcaactatctatcatctctatctaactacccattatctctattctaccatctactatcttatctatgtatttatctatctatgtatgtatctatacatctatcatctatccgtctctatctatctaagtatcatctatctatctactctgtatcatctgtctgtctgtctctctatctatctaatgtatcatctatttatctctctatcatctgtctatgtatcatctatctctctatcattgctctatcatctatgtatcatctatctctctctcatcactctatcatctatgtatcatctatctatctctctatcatctatctatgtatcatctgtctctctctcatcgctctatcatctatgtatcatctatctatctatcatctgtctatgtatcatctatcaactctgtcatctctctgttttatctatgtatctatcatttctttatctgtctacctctagtcctatctctatctgtatctctacacacctgtctctctacacacacacacacacacacagacacacaaacacaggcacacagacacacacagacatgcacagacacacacagacacacacagacacacacaggcacacacacacagtcatgtgctgcctaacgaccttttggtcatcagcagactgcatgtatcacggtagtctcctatgattatcacacagctgtcctatgcagctgtcccaattattttcttctatatcatatttttcctgtaccttctctatgtttagatacacaaatacttacccttgcgttaggtttgtctgcagtattcagtacagtaacgtgctgtatggctgtgtagctgaagagcaatttactatacagcctaggtgtgcagcgggctagaccagctaggtgtgtgtaagtaaactctagaatattctcataatgaagaaatcacctcacaatgaatttcccagaacatgtccccatcgttaagcaatgcatgactgtatatctacctatatgtgtgtgtacacacacacatatacacacacatatgtacgtaccttgtgtacacagcttatatatacatatatacacacgcatatacacacatatagatacacagcttatatacacatatatatacacatgcatatacacacatatagatacacagcttatatacacacatatatacataccttatatatgcatatttatacacatgtatatacacatcttatatacgcacacatatacacacacacacagcttatatacacatatatatacccacacatatatacacagcttatatacacgtatatatatgtatatatgcaccttatatacacagcttatatacacatatttatacacacgtatacacacaccttatataaacacatatatacacacatatacacagcttatataacatatatacacacacatatatacataccttatatatgcatatttatacacatgtacatacacatcttatatacacatatatatacatacatatgtgcacagcttatatacacgtatatatacacatatatatgcaccttatatacacagcttatatacacatatttatacacacgtatacacacaccgtatatacacacacatacacacatatacacagcttatatacacagcttatatacaggtatatatacacacatgtatatacacacatgtatatatacacaaactttatatatatatacacacacagcttatatacaatacatatacacacatatatacacaccttatatacacacatatatacacacacatatatacagagcttatatacacagcttatatacacatatatatacacacgtatatacacacctaatatacacagcttatatatacacatatatacacacatacatatatacacaacacacgtacacagcttatatatacacatatatacacacacatatagatacatagcttatatatacacatatatacacatcttatatacatagcttctatacacacagatatacacacaccttatacacacaacttatatatacacaattatatatacacaccttatatatacagcttatatatacacacatatataaatatacatatagagatatcttattggtacatatatctacaaacatatataaactatatatgtataaactgatacatagaatagaacattcatctgtatctttatatccatttatatctgtaaagatatgtagatacaggctggatgcagtggctcacacctttaatcccagcactttgggaggccgaggagggtggatcacctgaggtcaggagttcaagaccagcctggccaacgtggtgaaacctcatctctactagaaatacaaaaattagccaagcatggtggtgcctgtaatccgagctactcgggaggctgaggcacaagaattgcttgaacccgacaggcagaggttgcagtgagccgagaccgcaccactgcactccagcctgggcaacagagcaagactctgtctcagtaaataaataaataatatattaaaataataataaagtaaatacaggccaggcacagtggctcatgcctgtaatcccagtactgttggaggccaaggcaggaggatcgcttgagcccaggagttgttgaccagcttgggcaacagagtgagaccccatctctttttctttttttagacacagtcccgctctgtcacccaggctggagtgcagtggtgcgatctctgcttgctacaaccttcgcctcccaggttcaagcgattctcctgcctcagcctcccaagtagctgggattacaggcacccgccaccacgcctggctaatttttgtattatcagtagagacggggtttctccatgttggccaggctggtctcgaacttgcgacctcaggtgatccacccgcctcagcctcccaaagcgttgggtttacaggagtgagccactgtgtccggcctcgcggctccattcttgaagtcagcgagactgtgaaccctccggaaggaaaactctggacagacaggttacatcactaatcattgtgtgtgtgtgtgtgtgtgtgtgtgtgtgtgtgtgtgtgtgtgtgtatgtgtatgtttctccagtccaaacaggaaaatacctgcaacgtcaccatagaaggcttggatgccgagaagtgttactctttctgggtcagggtgaaggctatggaggatgtatatgggccagacacatacccaagcgactggtcagaggtgacatgctggcagagaggcgagattcggggtaatgcttgttacacggcagtgtcccatagccttgtcaccaggctggagtaggcatagccactgccttcccgggaggtgggagggagggtgtcctgccttcgaggtgggagggagggtgtcctgccttcctgggaggtgggagggagggtgtcctgccttcgaggtgggagggagggtgtcctatcttcccgggaggtgggagggagggtgtcctatcttcccgggaggtgggagggaggctgtcctgccttcgaggtgggagggagggtgtcctgccttcctgggaggtgggagggagggtgtcctgccttcctaggaggtgggagggagggtgtcctgccttcctgggaggtgggagggagggtgtcctgccttcgaggtgggagggagggtgtcctgtcttcccgggaggtgggagggagggtgtcctatcttcccgggaggtgggagggaggctgtcctgccttcgaggtgggagggagggtgtcctgccttcctgggaggtgggagggagggtgtcctgccttcctaggaggtgggagggagggtgtcctgccttcctgggaggtgggagggagggtgtcctgccttcgaggtgggagggagggtgtcctgccttcctgggaggtgggagggagggtgtcctgccttctaggtgggagggagggtgtcctgccttcctgggaggtgggagggagggtgtcctgccttcgaggtgggagggagggtgtcctgccttcctgggaggtgggagggagggtgtcctgccttctaggtgggagggagggtgtcctgccttcctgggaggtgggagggagggtgtcctgccttcgaggtgggagggagggtgtcctgccttcctgggaggtgggagggagggtgtcctgccttcgaggtgggagggagggtgtcctgccttcctgggaggtgggagggagggtgtcctgccttcctgggaggtgggagggagggtgtcctgccttcctgggaggtgggagggagggtgtcctgccttcctgggaggtgggagggagggtgtcctgccttcctgggaggtgggagggagggtgtcctgccttcctgggaggtgggagggagggtgtcctgccttcctgggaggtgggagggagggtgtcctgccttcgaggtgggagggagggtgtcctgccttcccaggagggtgtgtctgagcaagctcagccttctgtcatcctccagggccccatctgaaagtaattcctctccttgtttcattctcgggctgctttcacttgggagagttttctttcttttgtttttttgagaaacattctcatggtgcccaggctggagtgcagtggcgcgatctcggctccctgcaacatctgtctcccacgttcaatcgattctcccgcctcagcctcccgagtgcctgggattacagtgtacacgccaccacacctgattaaatctttttattttttatttttttatttttatttttttttagagggagtctcagtctgtggtccaggctggagttcagtggcacggtcttggctcactgcaacctccgcctcccgagttcaagtgattctcctgcctcagcctcccaagtagctgggactacaggcacgcaccaccaagcccgcctaatgtttgtatttttagtagggatggcgtttccccatattggccaggctggtctcgaactcctgaccttgtgatccgcccgcctcggcctcccaaagtgctgggattaaaggcgtgagccaccgcgcccggcctttgacgtatgttttcagggggcatgatttaaggagcacagccaccaacacacgaaagcaagctctcatatgctgtaaacacctccagcaaccagaagcctccaaaggctacatgttggacctgcccttacttcctcggggtggctgtgggatgtgttgttgtccagagacacggtgtctctttccaggatattttccataggaatgaaaatttgctgacactaacattcattaaaaaaaaaaaataggtccatctctactaaaaatacaaaaattagcccggtgtggtggcggatgcctgtcatcccagctgctcaggaggctgagacaggagaatcgcttgagtccgggagacggaggttgcagtgagctgagatggagccactgcactccagcctgggcaacagagtgaggttctgcctcaaaaaaaaaaaaaaaaaaaagtaaaagatttgctgacacgaatatttacaaaaaacaaaaacaaaacaaaaaacaaacaacgagaaccaagaaaaaaaaacgaacaccaaaaaatgagggagactggttagggatgagatgtaacatcacgttgaaaacgtacagccgcacgtcatgttgaaaactgacagccgccttttcattttgtttcagatgcctgtgcagagacaccaacgcctcccaaaccaaagctgtccaaatttattttaatttccagcctggccatccttctgatggtgtctctcctccttctgtctttatggaaattatgga

SEQ ID NO: 2843 - DNA, 16636 bp, human
ggcatggggcggctggttctgctgtggggagctgccgtctttctgctgggaggctggatggctttggggcaaggaggagcaggtaattatttaaacaccctcttcttgttgtattttggtttgtggtttgctttgcaaccaggcactctttattttgtaaaacttaaacaatgagcatggaggtttctttcttcttttcttttttttttttttttttttccgggttcaagcaattctcctgcctcagcttctcaagtagctgggacaaaacatatttataagtaaatacatgaatattaagtatacttattgctcccggaatatccactgcttatatgagctttcggtggccagaactaggaactgtatgtgtgcgtgtgtgtgtctatctattgattgattgattggtagatatattcatttttaatctatccatcaatgtatctcatctatcttttcccattaatcacccatccatccactatccatccatctattattcattgatccatccactaatatatccatccacccatctatcaaacgattcatccactcatacattcacccacccatcaacccacccagccatccgtccacccaacctttcattcactcatccatccatccaccatccacccagctgttatctatccatcctcccatccacccatctatcatccatccatccatccatccacccatccacccatccatccaccaatacatccatccatccatccacccatccacccatccatctaccaatacatccatccatccatgcattcacccacacttttatccacttatccatccatccatccatccacccatccatccaccaatacatccatctatccatgcattcacccacacttttatccacttatccatccatccatccatccatccacccatccacccatccatccaccaatacatccatccatccatgcattcacccacacttttatccacttatccatccatccatccatccacccatccatccaccaatacatccatctatccatgcattcacccacacttttatccacttatccatccatccatccatccacccatccatccaccaatacatccatctatccatgcattcacccacacttttatccacttatccatccatccatccatccatccacccatccacccatccatccaccaatacatccatctatccatgcattcacccacacttttatccacttatccatccatccatccatccatccatccatccatccatccatccacccatccacccatccacccaccaatacatccatctatccatgcattcacccacacttttatccacttatccatccatccatccatccatccatccatccacccatccatccacccacccacccatccatgtacacatctacgtatccatctatccatgcatccatccatccatccatccatccatccattcacctatgtatctgttcatccatttatttatccactgactcactcatccacccacccatcctttcatccacttatccatctatccatccatccaccaacacatccatccacccacccatcaaaccatccatccacctatgcattcacccacactttcatccactcatccatccatccatccacccatccatgtacacatctatgtatccatctatccatgcatccatccacccatccacccattcacctgtgtatctgttcatccatttattcatccatccactcacccatccacccacccatccacttgtcttccacctatacacccacctgtccattgattcatccatctacctacccatccctatctatctgtgtctgtctgtctaactatttctatcatcatctatataattctatctatctaacattaccatttatctatctatctgtatctatctatcctccagatacctccacttagaacccaacatgacaaggttcactgtaccccatctttccaaacctgtaactgacttctttgacagtgagagacttggccgggcgctgtggctcatgcctgtaatcccagcactttgggaggccgaggtgggcggatcacaaggtcaggagatggagaccatcctggctaacacggtgaaaccccgtctgtactaatacaaaaaatcagccgggcatggtggcaggtgcctgtagtcccagctacttgggaggctgaggcaggagaatggcatgaacccgggaggcaaagcttgcagtgagccgggatcgcaccactgcactccagcgtgggcgacagagcgagactctgtctcaaaataaaaaaaagagacttggctttcattatgcaaaatatcattacatgtttgctcaattctaaaatatttccattgtccctgttcggaattacaaacccagacctcttgaaacatcaaacctactgaagtctatgcaaccttcctagcaaacgtagaaagtcttctttacggttggcccatttcttttcttttcttttcttttcttttcttttcttttttttttttgatagggagtcttgctgtgtcacccaggctggagtgcagtgacacgatctcggttcactacaacctctgcctcctgagttcaagccattctcctgcctcagcctcccaggtagctgggattacaggtacccaccaccatgtccagctcatttttttgtgtttttagtagagacggggtttcaccatgttggccaggctggtctcgaactcctgacctcgggtgatccacccgcctcggcctcccagtgttaagattacagacgtgagccgctgcacctggccagtccatttctgaagttggtgtgtgtggtgttttgagaaagacagtaaggtggatcgatggggacagtttccgatgccaccttaggtatccacaggggatgtgttgttggatacatgattgatctatacagatacatctgtgcatggcactagtgggtgaacttaccttttgcaaaaacaaaaacaaaagcagccgggcgcggtggctcacgcctgcaatctcagcactttaggtggatgaggcgggcggatcacgaggtcaggagatcgagaccatcctggctaacacagtgaaaccccatctctactaaaagtacaaaaaattatccaggcatggtggcgggcacctgtagccccagctactcgggaggctgaggcaggagaatggcgtgaacccgggaggcggagcttgcagtgagccgagattgcgccactgcagtccagcctgggtgacagagtgagagtctgtctcacacaatacactacactacactacactacactacactacactacactacactacaatacaatgcaatacaatgcaatacaatacgtcaggcgcggtggctcacgcctgtaatcccagtactttgggaggccgaggcgggtggatcatgaggtcaggagatcgagaccatcctggctaacacggtgaaaccccgtctctactaaaaatacaaaaaattagccaggtgtggtgacaggtgcctgtaatcccggctactcgggaggctgaggcaggggaatcgcttgaacccgggaggcggaggttgcagtgagccgagatcgtgccattgtactccagcctgggcaacagagtgagactctgtctcaaaaagaaaaataaatttaaaaaaataaaaaaatagagttgcctcaccgtgaacttcatgcgtctctctgtgtctagcagaaggagtacagattcagatcatctacttcaatttagaaaccgtgcaggtgacatggaatgccagcaaatactccaggaccaacctgactttccactacaggtaagtggcccccagaaagcgaaccccacgcccagggggctcaaaatcgctcttctgagccgtcagcgattgggaatgcttgagaacaaaagtgtaaagcatcagactgtgcaagccggaatgtttgttctgtgaaaccctcagccctcaccacaaccacaatctcattgccccaaaccttcttgccaagggatggctgactcactgtcaaaatcaactacattcttttttttgtttgtttttattttgagtcggagtctcactccgttgccacgctggagtgcagtggcgcaatctcggctcactgcaacctctgcctcccgggttcaagccattcccctgcctcagcctcccgagtagctgggattacaggcacctgccaccatgcctagctaatttttgtatttttagtagagatggtgattcaccatattggtcaggccggtttcaaactcctgacctcatgtgatccacctgcctcagcctcccaaagtgctgggatgacaggcgtgagccacggcatccggactgaaaatcacctagattcttcacgggagattaacagagagttttgttcacccagagctctgggtgaactttaagtcttatctgctaggcagccggggagggaaagactcagtctctgaaacatttcacagccttacccggggctacccccaaccctgtgtctccctgatgtgactttatttttatttttactttggcttagttagacacccagaagtatgcgtacgaacattgcaggaagggtttttccaataaatttaatcatgggtggatgattcttcagtttgataacaaaagagataaacggcaaagcgtacagaacagggaaattttaaaacgaagttatttggaaaataagactcaccgttgggagaccgaggtgggtggatcatctgagatcaggagttccagaccatcctggccaacatggtgaaaccccaactctactaaaaatacaaaaactagccgggcgtggcggcaggtgcctgtaatcccagctactcaggaggctgaggcaagagaatcgcttcaacctgggagacggagttcacggtgagccgagattgcactccagcctggccgacagagcgagactgtctcaaaaacaaaacaaaacaaaacaaaaacctcacaaaaagaaaaaaaaaagtgctggattttgcacgtagttgcagaattcagctcagtttcttcctctgtaaaaggggcagttcttggggggggtgttggctcatgcctgttatcccagcactttgggaggctgaggggggggggggtggatcacctgaggtcaggagttcaagaccagcctggccaacatggtgaaacctcgtctctactaaaaatacaaaaaaattagccgggcgcgggggcgtgcgcctgtaatcccagcaacttgggaggctgaggcaggagaatcgcttgaatccgggaggcagaggttgcagtgggccgagatcacgccattgcactccagcctgggcaacaagaacaaaactctgtttcaaaaaacaaacgaacaaataaaaaaacggccgggcgcggtggctcacgcctgtaatcccagcactctgggaggccgaggcgggtggatcacctgaggtcaggagatcgagaccagcctggtcaacatggcgaaatcccatctctattaaaaacacaaaaattagctgggggtggtggtgcgtgcccgtaatcccagctactcaggaggcagaggcaggagaatcgcttgaacccgggaggcagagattgcaatgagccgagatcgtgccactgcactccagcctcagggacagagcgagacaccatcttaaaaaaaaaaaaaaaaaaaaagccggtgtggtagctcacacctctcattccagcagtttgggaggccaaggtgtatggatcacctgaggtcaggagttccagaccagcctggccccaacatggtgaaaccctgtctccagtaaaactacaaaaattagctgtatatggtggcaggtgcctgtaatcccagctactcaggaggctgagacaggagaattgcttgaacccgggaggcagaggttgcagtgagctgagatcgcgccattgcactccaacctgggcgacaagagcaagaccccatctctaaataaataagacatgcttttttgttttgttgctgaatggtcatcgttttaaaccacagattcaacggtgatgaggcctatgaccagtgcaccaactaccttctccaggaaggtcacacttcggggtgcctcctagacgcagagcagcgagacgacattctctatttctccatcaggaatgggacgcaccccgttttcaccgcaagtcgctggatggtttattaccgtaagtattgtaaagccagctcaccatgcttttcagtacttccttcagcttattaccacaaggactgaaaaccaagctcatgcaaatcgccggatccatgattaccgttaactattgagaagcaagctcaccatgcctttcagtacttcctgcagcttattactgtaagtaacgaaaaaccaagctccagccagtcgcgggatcaatgattcccgtaactattgaaaaggaagctcagcatagttttcagtacttccttcagcttattaccgtaagtactgaaaagctcacgtaaatcgtcggatccatgattaccgtaataattgaaaagcaagctcagcacgcttttcactacttccttcagctgattaccgtaagtaccgaaaagcaatctcatgatagtcgctggatcaatgattaccgtaaccactgaaaagcaacccagcctacttttcgctacttccttcaggttattaccataagtactgaaaagctcatgcaaattaccggatccatgattaccataactattgaaaagcaagctcaccatgcttttcgtacttccttcagcttattaccataagtactgataaagcaagctcatgcaagtcactggatcagtgattaccgtagctattgaaaagcaagctcaccatgcttttcagtacttccttcagcttattaccataagtactgaaaagcaagctctagcaagtcgcaggatcagattcccgtaactattgaaaagcagcccagcatccttttcactacttccttcagcttattgccataaataaaaaagctcatgcaaataaccggatccatgattaccgtaactattgaaaagcaagctcaacatgcttttcagtatttccttcagcttattaccataagtactgaaaagcaagctctcgcaagtcgcgggatcaatgattaccataacaattgaaaagcaagctcagcatgcttttcagtacttccttcagctgattatcataagtaccgaaaagcaagctctcgcaagtcgcgggatcaatgattaccgtaacgattgaaaagcaatcccagcacacttttcagtaccccttcatctccttaccttcagttactttcagttaagttctgaaaatcaagctcatggaccattggccactagagcccggtgcccagctcctcactccaagtgggaagaaaccggccttccaggaagttccctcttacacgcacactggttggggattgaatctgcccccagtggggagaccagatgaccccgggagactgtgatttaagggaatgaattaaaggcggggcgcggtggctcacgcctgtaatcccagcactatgggaggccaaggcgggcggatcacttgaggtctggagttcgagaccagcctcaccaacatggtgaaaccccatctctacaaacaaacaaacaaacaaaaaattagccgggctggtggcgcatgcctgtaatcctagctgttcgggaggctgaggcagggaaattgcttgaacctgggaggcagaggctgcagtgagccacgttggtgccactgcactccagcctgggcgatttataaattcattatttaaaaataaataaggcccagggtggtggcttacccctgtaatcccagtactttgggagaccaaggcgggcggatcacttgaggtctggagttcgagaccagccttgccaacgtggtgaaaccccgtctctattaaaaataatttaaaaaaaattagccaggcgtggtggcacacgcttgtaatcccagctactcgggaggctgaggcagggaaattgcttgaacccgggaggcggaggctgcagtgagccaagacggtgccactgcactgcagcctgggcgatttataaatttattatttaaaaataaataaggcccagggcggtggctctcccctgtaatcccagtactttgggaggccaaggcagggggatcacgtgacgtggggagttcgagaccagcctgaccaacatggagaaactccatctctattaaaaatacataattagccgggcttggtggtgcatgcctgtaatcccagctactcgggacgctgaggcaggagaatctcttgaatctgggaggcggagtttgtggtgagccgagatcgcgccattgcactccagcctggacaacaagagtgaaactccatctcaaataaataaattcattaaattaaataagggaattaattagagatgctctctggtgccctgcctacacacacacacacacacacacacacacacacacacacacacacacagagtgagctggaaatactctctcatcctcatcccactcactggatgttctctctctttttttttttttttttgagagagagggtcttcctctgttgcccaggctggttttcttatgtgcgttgagaactggctgttaagtctcgggcgaggaaatgagggacaaatgtagggaaaccctgtttccaaaatgtttattctttatcctagaattctgtaaggctgtgtttcttttttacttttttattttttagaggtaggggaaacggatctgtttgagaatccggtgagaactatgaactctttattcgcgaaattacttacagatactgggtgcgtttcctgggctataataggtcaccacaaactggaggcttaaaacagcagaaatttattctctcccagttttgaagcccatgagtctgagatggagatgtctgagagccgcattccctctggaggttctaagggaggatccttcctgcctctcccagctcctgggggctccaggcatccctgggcttgtggccgcatcactccagtctctgcctccgtctccatgtggccttctcctctgtgtctcctcttctgtctcttacaagggcacctgtcattagatttaggggacaccctactccaggatgatctcacctcaaggtccttcacctaattacatctgcagagagcctatttccaaatccggtctcattccaggtcctgggctttaggatgtggacagatgtttctgggggccactgttccattcagtataattatattcagttccttccagggttctaggggaggctccttcctacctctcccagctcctgggggctccaggcatccctgggcttgtggccccatcactccagtctctgcctccgtctccacgtggcctcctcctctgtgtctgcgtctcctcctctgtctccgagaaggacacctgtcattggatttagaacccttccttctccagtatgacctcatcctaactaactgaatctataatgatcctaactaactgaatctataatgatcctttttttttttttttttttttttgagatagtctcgctctgtcacccaggctggagggcagtggttcaatctcggctcaccgcaacctccgcctccccggttcaagcgattctcctgcctcagcctcactaatagctgggattacaagcgctggccaccatgcctgtatttttagtagagacggggttttagcatattggccaggctggtctcgaactcctgacttcaggtgatccacccgcctcggccttctaaaggatcctatttttaaatacagttccattctgagtttctggggagttgggattttaacatatatttttgtgggggacttaatttagcccgtaacagacacacaggacattttccgcagaattttagagagttccttccttcacaaacctacaggttctcggagctctggtggaagcttctcctataaaagtaatgaggacgggtgaaccccgagacccataaggtattaaggggaggaggggtacaggctagagaaaggggatgaggtcagcctgtcacaatcagctcagagaggagggacgtcgcttccgttatttcttcttctcagtgaaacccagttccccgaagcacgtgagattttcgtggcatcaggatgcagtgacggtgacgtgttctgacctgtcctacggggatctcctctatgaggttcagtaccggagccccttcgacaccgagtggcaggtgagccgggcggccgcgactcagggcgatggtggctgagcgtcccccaggtgcgggctgtgggattcgctgtttcatcagacctcgctcccctctgtctacaccttcctgaattccactctgctgtatcttcctgagagagctctagtccagcttggctttttcatgtttctctctgtgtctctgaggggtctccagagaaagagaaccaataatatgtctgtctgtctgtctatcaatctatttatctatctatctatcaatctatctatatcattctattttatctctacctctatctatgtatctatatcattctatttccctctctttcaatctatcatctatctatctcattctattttatctctatctctgtctttcaatctatctcattctattttatctctatctctgtctttcaatctatcatctattttatctattaactctctttgttctatctatctctctatggctctatccatatctattttatctaccaactctcttttatctatctatgtatggtcaatcttctatatatatcatccctatctctatgtagttcaactatctatcatctctatctaactacccattatctctattctaccatctactatcttatctatgtatttatctatctatgtatgtatctatacatctatcatctatccgtctctatctatctaagtatcatctatctatctactctgtatcatctgtctgtctgtctctctatctatctaatgtatcatctatttatctctctatcatctgtctatgtatcatctatctctctatcattgctctatcatctatgtatcatctatctctctctcatcactctatcatctatgtatcatctatctatctctctatcatctatctatgtatcatctgtctctctctcatcgctctatcatctatgtatcatctatctatctatcatctgtctatgtatcatctatcaactctgtcatctctctgttttatctatgtatctatcatttctttatctgtctacctctagtcctatctctatctgtatctctacacacctgtctctctacacacacacacacacacacagacacacaaacacaggcacacagacacacacagacatgcacagacacacacagacacacacagacacacacaggcacacacacacagtcatgtgctgcctaacgaccttttggtcatcagcagactgcatgtatcacggtagtctcctatgattatcacacagctgtcctatgcagctgtcccaattattttcttctatatcatatttttcctgtaccttctctatgtttagatacacaaatacttacccttgcgttaggtttgtctgcagtattcagtacagtaacgtgctgtatggctgtgtagctgaagagcaatttactatacagcctaggtgtgcagcgggctagaccagctaggtgtgtgtaagtaaactctagaatattctcataatgaagaaatcacctcacaatgaatttcccagaacatgtccccatcgttaagcaatgcatgactgtatatctacctatatgtgtgtgtacacacacacatatacacacacatatgtacgtaccttgtgtacacagcttatatatacatatatacacacgcatatacacacatatagatacacagcttatatacacatatatatacacatgcatatacacacatatagatacacagcttatatacacacatatatacataccttatatatgcatatttatacacatgtatatacacatcttatatacgcacacatatacacacacacacagcttatatacacatatatatacccacacatatatacacagcttatatacacgtatatatatgtatatatgcaccttatatacacagcttatatacacatatttatacacacgtatacacacaccttatataaacacatatatacacacatatacacagcttatataacatatatacacacacatatatacataccttatatatgcatatttatacacatgtacatacacatcttatatacacatatatatacatacatatgtgcacagcttatatacacgtatatatacacatatatatgcaccttatatacacagcttatatacacatatttatacacacgtatacacacaccgtatatacacacacatacacacatatacacagcttatatacacagcttatatacaggtatatatacacacatgtatatacacacatgtatatatacacaaactttatatatatatacacacacagcttatatacaatacatatacacacatatatacacaccttatatacacacatatatacacacacatatatacagagcttatatacacagcttatatacacatatatatacacacgtatatacacacctaatatacacagcttatatatacacatatatacacacatacatatatacacaacacacgtacacagcttatatatacacatatatacacacacatatagatacatagcttatatatacacatatatacacatcttatatacatagcttctatacacacagatatacacacaccttatacacacaacttatatatacacaattatatatacacaccttatatatacagcttatatatacacacatatataaatatacatatagagatatcttattggtacatatatctacaaacatatataaactatatatgtataaactgatacatagaatagaacattcatctgtatctttatatccatttatatctgtaaagatatgtagatacaggctggatgcagtggctcacacctttaatcccagcactttgggaggccgaggagggtggatcacctgaggtcaggagttcaagaccagcctggccaacgtggtgaaacctcatctctactagaaatacaaaaattagccaagcatggtggtgcctgtaatccgagctactcgggaggctgaggcacaagaattgcttgaacccgacaggcagaggttgcagtgagccgagaccgcaccactgcactccagcctgggcaacagagcaagactctgtctcagtaaataaataaataatatattaaaataataataaagtaaatacaggccaggcacagtggctcatgcctgtaatcccagtactgttggaggccaaggcaggaggatcgcttgagcccaggagttgttgaccagcttgggcaacagagtgagaccccatctctttttctttttttagacacagtcccgctctgtcacccaggctggagtgcagtggtgcgatctctgcttgctacaaccttcgcctcccaggttcaagcgattctcctgcctcagcctcccaagtagctgggattacaggcacccgccaccacgcctggctaatttttgtattatcagtagagacggggtttctccatgttggccaggctggtctcgaacttgcgacctcaggtgatccacccgcctcagcctcccaaagcgttgggtttacaggagtgagccactgtgtccggcctcgcggctccattcttgaagtcagcgagactgtgaaccctccggaaggaaaactctggacagacaggttacatcactaatcattgtgtgtgtgtgtgtgtgtgtgtgtgtgtgtgtgtgtgtgtgtgtgtatgtgtatgtttctccagtccaaacaggaaaatacctgcaacgtcaccatagaaggcttggatgccgagaagtgttactctttctgggtcagggtgaaggctatggaggatgtatatgggccagacacatacccaagcgactggtcagaggtgacatgctggcagagaggcgagattcggggtaatgcttgttacacggcagtgtcccatagccttgtcaccaggctggagtaggcatagccactgccttcccgggaggtgggagggagggtgtcctgccttcgaggtgggagggagggtgtcctgccttcctgggaggtgggagggagggtgtcctgccttcgaggtgggagggagggtgtcctatcttcccgggaggtgggagggagggtgtcctatcttcccgggaggtgggagggaggctgtcctgccttcgaggtgggagggagggtgtcctgccttcctgggaggtgggagggagggtgtcctgccttcctaggaggtgggagggagggtgtcctgccttcctgggaggtgggagggagggtgtcctgccttcgaggtgggagggagggtgtcctgtcttcccgggaggtgggagggagggtgtcctatcttcccgggaggtgggagggaggctgtcctgccttcgaggtgggagggagggtgtcctgccttcctgggaggtgggagggagggtgtcctgccttcctaggaggtgggagggagggtgtcctgccttcctgggaggtgggagggagggtgtcctgccttcgaggtgggagggagggtgtcctgccttcctgggaggtgggagggagggtgtcctgccttctaggtgggagggagggtgtcctgccttcctgggaggtgggagggagggtgtcctgccttcgaggtgggagggagggtgtcctgccttcctgggaggtgggagggagggtgtcctgccttctaggtgggagggagggtgtcctgccttcctgggaggtgggagggagggtgtcctgccttcgaggtgggagggagggtgtcctgccttcctgggaggtgggagggagggtgtcctgccttcgaggtgggagggagggtgtcctgccttcctgggaggtgggagggagggtgtcctgccttcctgggaggtgggagggagggtgtcctgccttcctgggaggtgggagggagggtgtcctgccttcctgggaggtgggagggagggtgtcctgccttcctgggaggtgggagggagggtgtcctgccttcctgggaggtgggagggagggtgtcctgccttcctgggaggtgggagggagggtgtcctgccttcgaggtgggagggagggtgtcctgccttcccaggagggtgtgtctgagcaagctcagccttctgtcatcctccagggccccatctgaaagtaattcctctccttgtttcattctcgggctgctttcacttgggagagttttctttcttttgtttttttgagaaacattctcatggtgcccaggctggagtgcagtggcgcgatctcggctccctgcaacatctgtctcccacgttcaatcgattctcccgcctcagcctcccgagtgcctgggattacagtgtacacgccaccacacctgattaaatctttttattttttatttttttatttttatttttttttagagggagtctcagtctgtggtccaggctggagttcagtggcacggtcttggctcactgcaacctccgcctcccgagttcaagtgattctcctgcctcagcctcccaagtagctgggactacaggcacgcaccaccaagcccgcctaatgtttgtatttttagtagggatggcgtttccccatattggccaggctggtctcgaactcctgaccttgtgatccgcccgcctcggcctcccaaagtgctgggattaaaggcgtgagccaccgcgcccggcctttgacgtatgttttcagggggcatgatttaaggagcacagccaccaacacacgaaagcaagctctcatatgctgtaaacacctccagcaaccagaagcctccaaaggctacatgttggacctgcccttacttcctcggggtggctgtgggatgtgttgttgtccagagacacggtgtctctttccaggatattttccataggaatgaaaatttgctgacactaacattcattaaaaaaaaaaaataggtccatctctactaaaaatacaaaaattagcccggtgtggtggcggatgcctgtcatcccagctgctcaggaggctgagacaggagaatcgcttgagtccgggagacggaggttgcagtgagctgagatggagccactgcactccagcctgggcaacagagtgaggttctgcctcaaaaaaaaaaaaaaaaaaaagtaaaagatttgctgacacgaatatttacaaaaaacaaaaacaaaacaaaaaacaaacaacgagaaccaagaaaaaaaaacgaacaccaaaaaatgagggagactggttagggatgagatgtaacatcacgttgaaaacgtacagccgcacgtcatgttgaaaactgacagccgccttttcattttgtttcagatgcctgtgcagagacaccaacgcctcccaaaccaaagctgtccaaatttattttaatttccagcctggccatccttctgatggtgtctctcctccttctgtctttatggaaattatgga

SEQ ID NO: 2844 - DNA, 41089 bp, human
gcaggtggaaggagaggaagcggatgccgtgggggtaagctaagttctttccttctgtggtctttgagcatgtcgagtcacccgggtacatgtttctgctgtgtctgtcgatagaaaagaaagagactgaactggaacataagatttcaaacgttggctcgagccgaagtggggacagcggcccagaagactgagagccaaggaaccttgcatatgagttgtcttctgcctttgttatatgcaggtttttaaaggcaaaattaaaaaaataaaataaaataaaaagagggaggtgttgttggaggacagggagggggcttctgtgaagctgtttgctgggaattctcgttggtttacagaaaaaaacaattgattaatgattggctgtacattgctaagctacagggcgttggggtgtagtatctagcacggaattatcacgtgaattcacagctatctgtggcatccggaagccgtttcgagagatgaacgcggccgggcgtggtggctcacgcctgtaatcccagcactttgggagactgaggcgggtggatcacctgaggtcgacagttcgagaccatcctggccaacatggagaaaccccgtctctactaaaaatacaaaattagccgggcatggtggtggcaggcacctgtaatcccacctactcaggaggctgaggcaggagaatcgtttgaacccgggaggcggagcttgcagtgagctgagattgcaccactgcactccagcctgggcaacaagacgagattctgtctcaaaaaaaagaaaaagaaaaaaaaagagatgaaaagagatgaacgcagagctgaaagggggagggagtgtgatggtgttactagttactagaaaggggtcctgatccagacttcaagaacgggttctgggatcttgcccaagaaagaactggaggcaagttcacattgcaaactgaaagcaagcttattaagatagtaaaggggggccgggcacggtggctcatgcctgtaatcccaacacttttggaggctgaggcgggcggatcacctgagctcaggagttcgagatcagcttggccaacatggcaaaaccacacctttattaaaaatagaaaaaattagctaggtgtggcagtgtgtgcctgtaatcccagctacttgggaggctgaggcaggagaatcgcttgaacccgggaggcggaggttgcagtgagcccagattgcaccgttgcactccagcctgggcaacaagagcaaaactctgtccccaaaaaaagataactaaaagaaaaaagtcgtggggagagatgctccactacaagggtgactgataaaggattcatctttgtcatgactatcttttgcagtaatcaatattgtatatatacatattatatattttttattattattattttgagatcatctggctgtgtcatccaggctggagggcagtggtgcaatcacagctgactgctgtcttgaattcctgggctcaagcaatcctcccatctcggcctcccgagtagctgggtcaaaggcaaatgccaccattcctggcaaatatttgtatttttgtagggacgagggtttcactgtgtttcccgggctggtcttgaactcctagactcaatctatcttcctgccccagcctcccaaagtggtgggatgacaggtgtgggccaccgcgcctggcccaatattatcatttttaaagcaaaacggattctcacactatgaaagcttttgttctgaagatatcaacacatcaggaggtttctgtgtctgttcagtcctcggtctgtttagtaaacagtattgatctgttcacatatcttgcgtcaggaatggctgacctccagggaatgctgcccagcctgtcccagcctccctgttcccagcccctattctagatggagtccctctaagctgggcgtggtgtaatcccaggactttgggaggctgaggtgggcggatcacctgaggtcaggagttcgagaccagcctggccaacagggtgaaaccccatctctactaaaaatacccaaaattagccggggcgtggtggcgggcgcctgtaatcccaatattttggaaggctgaggtgacagaggattgcttgaggccacagcaattccagaccagcccggggcaacatcgtaagattcccccatccctcgtgtataaaaaaaagattaaattattacaaattttaaaaaagacagaaatgaagcatcttaagttaccacccagattggggtactaagagtctggatttggacagcttgttgcgcgttttataggtgtgctaaatcacatttcactctttttgttgagacagagtctcgtgctgtcgcccaggctggagggcagtggcgcgatctctgctcaccgcaacctccgcctcctgggttcaagcaattctcctgcctcagcctcctgagtagctgggattacaggcacctgccaccacgcccggctaatttttgtattttttttttttttttttttttttggagacagcgtcttgctctgtcgcccaggctggagtgcagtggtgcaatctccgctcactgcaacctccacctcccgggttcaagcaattctcctgcattagcctcctgagtagctaggattacaggcacgtgccaccatgcccagctaatttttgaatttatttatttatttttttggagacagtatcttgctctgttgcccaggctggagtgcagtggtgcgatctcggctcactgtaacctccgcctcccgggttcaagtgattctcctgcctcagcctcctgggtagctgggattacaggtgtgtgctaccatgcccggctaatttttgtatttttagtagggatggtgtttcaccatgttggccaggctggtctggaactcctgacttcaaatgatccgctcaccttgacctcccaaagggctgggattacagacatgaaccacggagcccggccggatttcactctttagatttttggtttaaactcgagaagctcttctcgagggctgaaagctcttggtcccctgtaggtttgctgtagatgacagacatgaggcagattgattaataagagaaaagacatgcactttttttttcttttttttttttgagacggagtctcgctctgtcaccgaggctggagtgcactggcatgatctcggctcactgcaacctccaccttccaggttcaactgattctcctgcctcagcctctccagtagctgggattacaggcgtgtgctaccatgcctggctaatttttctatttttagtagagacagggttgttccatattggtcaggctggtctcgaacacctgacctcaggtgatccgcctgcctcggcctcccagtgtgctaggattacaggcgtgaaccactgtacccagccagatttacacatttatagaatgtgtatacacaagattcttcagaatgaggactccaccccacaatgaggttcagaagctagtacaccacattgagactacagaaggataggggattggatcctggtacaaaaaaaaaaaggttatagggttggggggaaagaggaattctattgaggagcaatatataatttctactgcggactgaactctgatttttttctttattttattttattttattttatttttttgagacagcatctcactctgccgcccaggctggagtgcagtggtgcgatctcagctcactgcaacctccacctcctgggttcacccgattttcctgcctcagcctcccgagtagctgcgattacaggcacccgccactacgcccagctaattttctttgtatttttagtagagacggggtttcaccatgttggccaggctggtcttgaactcctgacctcaggtgatccaacctcctcggcctcccaaagtgctgggattatacgcatgagccactgcacctagcttcttctttttctttttttttttctttctttttttcttttttttttttagatggagtctaactttgtcgcccagactggagtacagtggcacaatctcagctcaccacagcctccacctcccaaggtcaagcaattctcctgcctcagcctcccaagtagctgagattacaggcacgtaccactactgcctgagtaatttttgtgtttttagtagagacaacatttcaccaggttggccaggctggtctcgaactcctgacctcaagtgatccacacgcctcagcctcccaaagtgctaggattataggcaccagccaccacaccgggcctctgactttttttatcttgcccaaattcctatctaagaggtctgaggaggcaagccctacaaaccataaattctcatcaaatgggatttattgaaccctgtatatcgtgacttactttccaacctgactctggcaaacgttacaagacagagaaaaaaaacaacatatgttgccccaaaatatgtttcttagttgtattttttttttcttttaagatggtctcattctgtttccaaggctggagtgcagtggtgcaatcttggctccctgcaacctccgtcttctaggttcaagcgattctcctgcctcctcagccttccaaatagctggcgtaatatgcatgagccatcgtgcccagataattgttttttgttttttgttttttttttagtagagatggggtttcactgtgatggccaggctggtcttgaactcctgacctcaggtgatccaaccgcctcggcctcccaaagtgctgggattataggcgtgaaccactgctcccggctggagtacaggggcataatcttggctcactgcagcctctgcttcccaggttcaagtgattctcctgcctcagtctcccgagtagctgggactacaggcgcccgccaccacgcccagctaatttttttttttttttttgtattttttttttttagtagagatggggtttcactgtgtttgccaggatggtctcgatctcctggcctcatgatctgcccgcctcggcctcccgaagtgctgggatgacaggcgtgagtcaccgcgcccggcatgaaagggtttttcattaaaaatccttgttataccgtggagccctgtgttggggtaaaatatcatgatttccctcactctccatcattcttgctttgaatctgagaaggaagcttggcggcctctattttaggatcagccgaaaatttccagaaaggggaaagaaaactcattctgtaaacacaaaaaagaagaagagaaaaaagtataagcggtacagacaaaacgcaaagatgttgcataattttccgtgagtgcaaaatgtcctgtaaaccaaaaaagaggtatctgagacaggtctcagtccatttagaaagttcattttgccgaggttaaggacgcctgcccatgacagagcctcaggaaatcgcgatgacaggtgctgtggatacacagggcacaatttgctttcatacatttttttggcggggagggagctggggatccagtcttgttctgtcacccaggctgcagtgcaatggtgcaatctcagctcactatcactgtaacctccgcctcccgtgttcaagctattctcctgccacagccttctgagtagctgggattataggcacccactaccgcgcccagctaatttttgtatttttagtagagacggggtttcaccatgttggccaggatggtctcgaactcctggcctcaaatgatccacctgcctcggcctcccaaagtgctgggattataggcgtgagccatggcgcccagccctggtatgtaatttttaaaacctttgtagtaccttatttacgaataaaatgcgaggcaggtttgcctaagacagtttccactataacctttcatgattttggggtcctgagacttatttacctttcacagtttacagcaggaaaatccgtggagacagcagatccgagaagcggcgatgtttgcgtagaaccctgtacgtgcttccttcggcctgtcggtaatgtggttggggattttcttttttttaagtgaagtctaaagaactgaaatgttttgctccataatgatgaaccaggatagaagtgagaactcagggcagaagaatctgaatgaggaactgtctgacctatgacaaatttaacatgtcacgttccctctgagacagtacacatcctcctgaagcagcgtgacaaggcacatcctcctgaagggtctccaggcagaagagacgcatgaacctgtcaaaaaaaaaaaaaaaaagagccggccgggcgcagtggctcaagcctgtaatcccagcactgtgggaggctgaggcggggggatcatgaggtcaggagttccagaccagcctggccaacatggtgaaaccccatctctgctaaaaatacaaaaattagccgggtgtagtggcagttgcctctagtcccagctactccggaggccgaggcaggagaatcgcttgaacccaggaggcgtaggttgcagtgagccaagatcgcgccactgcactccagcctgggcaacagagcgacagtccgtcccaaacactgcaaaatatttaaagagatttattctgagccaaatatgagtgagcaagaaggcccagggaaaatagtctaaagagatcctgagaacacgtatccaagctggttgagcggcagtttggttttatatgtttttgtttgtttacttattttactttattttatttatttatttatttattttgagatgaagccttgctcagtctgttaggctggagtgcagtggcgcgatctcggctcactgcaacctccgcctcccgggttcacgccattctcctgcctcagcctcccgagtagctgggactacaggcgcccaccaccatgcccagctaattttttgtatttttagtagagaaggggtttcaccgtgttagccaggatggtctcgatctcctgacttcgtgatccgcccgcctcagcctcccaaagtgttgggattacaggcacccgccaccacgcccggccaatttttgtatttttagtagcgacggggtttcaccatgttggccaggctggtctcaaacttgtgacctcacatgatctgctcacctcggcctcccaaagtgctgggattacaggcgtaagccacagcgtccagctattttattttatttgttttattttttgtgacagagtctcactctgtcgcccaggctggagtgcagtggagcgatctcagctcactgcaacctctgcctccggagctgaagcaattctcccgcctcagcctcccaagtagctggcattacagaggtacgccaccacgcctggctaaattttgtttgtttgtttgtttgtttgtttgtttgtttttgtttttcagtagacacagggtttcactatgttggccaggctggtctcgaactcctgacctcacatgatctgcctgcctcagcctccagaagtactgggattacagccgtgagccacctcacccagccagcagcttggttttatgtttgtttatatatttatttatttatttatttttaatttttggagacggagtcttgctctgttgcctgggctggagtgcagtggcatgatcttggctcacggcaacctctgcctttcgagttccagtgattctcctgcctcagcctcgcgagtagctgggagtacaggcgcccgccatcacacccggctagtatttgtatttttagtagagagagggtttcaccgtattgtccaggctggtcttgaactcctgtcctcaagtgatccacccacctgagcctctcaaagtgctgggattgcaggcgtgagcctctgtggccagccaacagacagttttgcaggaccatttcaaaatatgtcaagtaaatatattttggggtgaaatgtattttaaagtggcatatactgatttcccacagtcttgtctggggaggcatatcctggcctcctagaaagcatacacagtagcagacaggtgtggtggctcacgcctgcaatcccagccctttgggaggccgaggcaggtggatcacaaggtcaggagatcgagaccatcctggccaacatggtgaaatgctatctctactaaaaatacaaaaattagctgggcgtggtggtgcatgcctgtaatcccagctactcgagaggctgaggcaggaggaccacttgaacctggcaggtggaggttgcagtgagctgagatcacgccactgcactccagcctgggagacagagcgaggctccgtctctaaataaataaataaagcttacgcagtagctgagaagacagggaaaagaggtgaagaaatgacagaaagcttagaagtcgctcattataaccccttcctaccccatctcatgcttcccttaaagcataaacgaagggtgcttgtgttacaggaaaggggttcggatccagcccccaagagggggttcttggatctcacgcaagaaagaattcagggcggccgggcgctgtggctcacacctgtaatcccagcaccttgggaggcagaggcgggcggatcacgaggtcaggagttcgagaccagcctgaccaacatggtgaaaccccatctctactaaaaatacaaaaattagccaggtgtggtggtgcgtgcctgtagtcccagctactcgggagacagaggcaagagaatggcgtgaacccgggaggcgatgcttgcagtgagtggagatcatgccactacactccagcctgggcgatagagtaagtccatctcaaaaaaaaaaaaaaaaaaaaaaaattcggggtgagtcagcagtgcaaagccaaagcaaatttattacaaaagtaaaacagtgaaagaatagctactccagaggccgggcgcagtggctcatgcctgtaatcccagcactttgggaggtggaggtgggcagatcacctgaggtcaggagttcgagaccagcctgaccaacatggtgaaaccccatctctactaaaaatacaaaaattagccaggcatggtggtgcgtgcctgtagtcccagctactcgggaggctgaggcagtagaattgcttcaacttgggagacggaggttgcagtgagccgagatggcaccactgcactccagcctgggcaacagaatgagactcagtctcaaaaaaaaaaaaaaaaatttcagggcgagcaagtttattatgaaagtaaaatagtgaaagactaggtactccagaggccaggcgcagtggctcatgcctataatcccagcactttgggagcccgaggcaggtggatcacctgaggtcaggagttcgagaccagcctcgccaacatggtgaaaccccatctctactaaaaatacaaaaattagccaggcatggtggtgcgtgcctgtagtcccagctacttggaggctgaggcagtagaattgcttcaacttgggagacggaggttgcagtgagccaagatggcaccactgcactccagcctgggcgacagaatgagactcagtctcaaaaaaacaaaagatttcagggcgagcaagtttattatgaaagtaaagtagtggaagactagctactccagaggccaggtgcagtggctcatgcctataatcccagcactttgggagcccgaggcaggtggatcacctgaggtcaggatttcgagaccagcctcgccaacatggtgaaaccccatctctactaaaaatacaaaaattagccaggcgtgttggtgcgtgcctgtagtcccagctactcggaggctgaggcagtagaattgcttcaacttgggagacggaggttgcagtgagccgagatggcaccactgcactccagcctgggtgacagaatgagactcagtctaaaaaaaaaaaaaattcagggcaagcaagtttattatgaaagtaaaatagtgaaagactaggtaatccagaggctgggtgcagtggctcatgcctataatcccagcactttgggagcccaaggcatgtggatcacctgaggtcagaagttcgagaccagcctggccaacatggtgaaaccccatctctactaaaaatacaaaaattagccaggcgtgttggtgcgtgcctgtagtcccagctactcggaggctgaggcagtagaatcacttgaacctaggagacagaggttgcagtgagccgagatggcgccactgtactccagcctgggcgacagagtgagactccatctccaaaaaataaataaataagtcaaccaagaaggccgtacgtacagtggctcacacctgtcatcccatcactttgggaggccgaggcagggggattacttgagatcaggagtttgagaccagcctggccaacatggtgaaaccccgtctctactaaaaatacaaaaattagccaggcgtgttggtgcgtgcctgtagtcccagctactcggaggctgaggcagtagaatggcttcaacttgggagacggaggttgcagtgagccgagatggcaccactgcactccagcctgggcgacagagcaagaccgtctacaaaataataataataattaataataataataataactagtgcaagagaagtacacaaatatcccaaacatttagtgactcagcagagggggccagtctcaaggaacaggacttctacacctgttaccaccacctggggagttgtatctgaatctcaaggtcaggcccacccagacagaacatgcatctctagggtgccacaggagagtctgtccagtgcccagaaacacctgcaagacccagaagcaggctccaagaagcggggtgccacagtccagtgggggaagcggccacatccctgtcatgtgggctacagatgagttggggggcaggggcaggagaagaagaaacaggtgtggcctacatgcttttacttcctcttagcaagcgaggttcctcttgcagaggaacggtctgagagacacaaccgttttttttttttgtttgtttgcttttccttgagacagagtctccctctgtcacccaggctggagggcagtggcgcgatctcggctcactgcagcctccacctcctgggttcaagcgattctcctgcctcaacctcccgagtagctgggattacaggcacccaccaccccacccggctaatttttgtatttctagtatagatgaggtttcaccgtattagccaagctggtcccgaactcctgacctcaggcgatccgcctgccttggcctcccaaagtgctgggattacaggcgtgagccactgtgcccggccgagagacgcaatctttcagagaggaggtttggagcaggaacctcagggtggacagatgggtcccaccaggtgcagatgcttgaactaaagatgctacaaaggccgggtgcagtggttcatgcctgtaattccagcagtttgagaagctgaggcaggcagatcatctgaggtcaggagttcgagcccagcctggccaacatggcaaaacagcgtctctactaaaaatgcaaaattagcctggcataatggcgggcgcctataatcccagctacttgggaggccgaggcaggagaatcgcttgaacccgggaggcggaggttgcagtgagccaagattgcaccactgcactccagcctgggtgacaagagtgaaactccgtctcaaaaaaaaaaaaaaaaaaagaagaagaagaaaagaaatacattagtttggtccataaaggcgggacaactcaaagtgggggcttccaggctataaatgaatttaaacattttctggttgacaattggttgagtttgtagctcctcctccttctcttcttcctcctccttctccccccttcctcctcttcctcctcttcctcctcctccttcttcttctcttctttcttcttcttctctttccccttcttcttcttcttcctcctccttctcctcctcctttttcttcttcttccttatgggcttggatagaagtatattgacatggatccaccatttgtagaatcataccgagtagcttcttttctcctccttcctctccttctcctcctcctcctcctccttctcctgctccttctcctcctcctcctcctgctccttctcctcctcctcctccttctcctcctcctcctcctgcttctcctcctcctccttctcctcctcctgcttctcctcctcctccttctcctcctcctccttctcctcctcctccttctcctcctcctcattctcctcctgctccccttctcctcctccttctcctcctcctccttctcctcctgctccccttctcctcctccttctcctcctcctcctcctcctgctcctcctcctccagctccccttctcctcctactcctccttctcctccttctccttctcctccttctcctactcctccttctcctactcctccttctcctactcctccttctcctcttccttcttctcctcctcctgctccttctcctcctcttcctcctactcctccttctcttccttctcctcctcctccttctcctcctcctccttctcctcttcctccttctcctcctcctccttctcctcctcctccctctcctcctcctccgccttctcctactcctccttctcctcctccttcttctcctcctcctgctccttctcctcctcctccttctcctcctgctccttctcctcctcttcctcctactcctccttctcttccttctcctcctcctccttctcctcctcctgcacctttcctcctcctccttctttttccttttttgcataaagaagtatcaaataagagtagtttcactgccctaaacatcctctgaggtccatgtattcatccctccatctgcccaacgccaaccaactccggatctttttactgtttccatgattttgtcttttccacagtgtccaagtgttagaatgactcagtctgcagccatctcaaagtggattctttcccttagtcataagtatttaaacttcattcatgtcgttttatgtactcaccctttttttcttcctcttcttttttttttttttttcactttccttttatagctgttgcaaaagtcaagattttttaaaaaatataaaagagcagggccgggcacggtggctcacgcctgtaatcccagcactttgggaggccgaggcaggtggatcacgaggtcaggagatggagaccatcctggctaacacggtgaaagcctgtttctactaaaaaaaaaaaaaaaaaaaaaaaattagctgggtgtggtggcaggcgcctgtagtcccagctacttgggaagctgaggcaggagaatggtgtgaacctgggatgtggaggttgcagtgagccgagatcgcgccactgcactccagcctgggtgacagagcgtgactttgtctcaaaaaagaaaaaaaaagtacaaaagagcaaaacaaaacaaaagttatgaaaatgaaaacctgagccatcgtttatcttatttccccaaatccactaattattaacagaaagtaaaagctatgaaaaatgaatgaaagtgactgcaatttccttgaagtgtgttagaacctgcctttagtgtcagctatgggttccctcatgaaggtcagctgagccatgacccatgaaccatggaagcttgactctagattgaccatcttgagatgccaaagatgtccacgtcctaatcccatgtgggagacagaataatggccctgcagaccttcccagctggccatgacccctcatttgaccaggtcagcggctgaccaccatcctgggtttgtttccccaaatcacctccctggggtcccctgccaggaatgtcctgggagaggcaaccttctcactgtgtgatattttctctcctgcagctcttcccttctctctgaccagcaccatgcttctcctggtgacaagccttctgctctgtgagttaccacacccagcattcctcctgatcccagagaaatcgggtaagtatggaaacctggctgaaccttctccgcggcccctgtttagatgtcctgcatctggagacccatctggatacctgggtccatctgcatttcatctctaatgtttatgagggacccaataagcaccagccaacccaccagaagctcagagctcctcttgttctcacctccttttctgctgttaattcccatccacccattctacagatgagaaaacggaggctcagatacctccacagtttaacccaacgaccatccaggtagtgatggggccaggatgaggacccatgtctgcatggggccaaagtgttccttccttccttcgttccttcgttccttcgttccttccttccttccttccttccttccttcgttccttccttcgttccttccttccttccttccttccttccctcccttgcttccttctcttcctcctgccctccctctttccatccttccttctctccttccttccatccttctctccctcctgattcatttcttctctttctttctcttccttccttccctccttccctttctctctttcttccttccattgtttccttctttccttccttcttccgtccctcccttctttctttctctttcttccttccctccttccctctctctctttcttccttccattgtttttctttctttccttccttccctccctccctccctctctctctctctttctttctttctttctcctttttttttctccttctttgtttctttcttcctctttcttctttctttctttctttctttccttctttctttttctttcttttcagagtctccctcttgttgcccaggctggagtgcaatggctcaatctcagctcactgcaaactcagcctcccgggttcaagcgattctcctgcctcagcctcccgagtagctgggattacaggcgcctgccaccaggcccagctaatttttttgtatttttagtagagatggggttttgtcatgttggccaggctggtctcaatctcctggcctcaggtgatcccgtgcctcggcctcccaaagtgctaggattacagctatgagccgccacacccagcctcttgtttgttgacttcttaatagcagccattgtgactggcgtggaatgatagctcattgtggttttgatttgcgtttccgggagggaccctcttgactgagggtgtcagggcctctgcttcaggaaagtatttccaggtttttgtgacctggttcagggaagacagacaaagacagctttctgtttctgcaattttctcaaattccttcagctttatattaaactgccaaggttccataatttgggaagtgtgttcagagccacatcactctggataaagagcctttgcctgttctcattcaagcggttttctttctctgtctctcttttttttttttttttttttttttttgagacaggatctcgctctgtctcccaggctggagtgcagtggcgtgatctcggctcactgcagcctcagctttctgggatcaagtatcctcccactccagcctcccaagtagctgggactgcagaaatacaccaccatgccaagctaatttaaattttttttttaattttatagaggagatcttgctatgttgccaagactagtttttgatttttttttttttttgagatggagtcttactctgtcacccaggctggagtgcagtggcgcgatctcggctcactgcagcctcagctttctgggatcaagtatcctcccactccagcctcccaagtagctgggactgcagaaatacaccaccatgccaagctaatttaaatttttttttttttaaattttatagacgagatcttgctatgttgccaagactagtttttgattttttttttttttttttttttgagatggagtcttactctgtctcccaggctggagtgcagtggcgcgatctcggctcattgcaacctccacctcccgggttcaaccgattctcctgcctcagcctcctgagtagctgggattacaggtacccgccaccatgtccacctaatttttttgtatttttagtagagacagggtttcaccacattggccaggctggtctcgaactgctgacctcaggtgatccgcccacctcagcctaccaaagtgctgggattgcaggcatgagccaccgcgcctggccagtttttgatgatttctgcagtaaacatctccatgtggagaaggagcaagctgggaccacagatgtgcaccatcacacctgcctaatttaaatttttaaaaaaaaattttttttaaagagatgcgatcttgctatgttgcccaggcgggatctgaacctactgggctcaagtcagctttttgcctcagcctcccaaggtgctgggattagaggcgtgagccaccacccccagtcttcagatgatttttgaatatttctgcagtagaaatctcctttttcagaaacagccagggggctgtgaaaaggagggaagatggacaagggaggaacagatacctgaggatgtgggacgtcctggggccatgtgggtgacagaggaaaatcagcaggcttcagccctgaacttcacctcccagagccgggtgggaggacagaaaacagggccggccgggcacggtggctcacgcctgttatcccagcacttcgggaggctgaggcaggcggatcacctgaggtcggcagttcgagaccagcctgaccaacatggtgaaacccccatctctactaaaaatacaaaaattagctgggcatggtggtcggcgcctgtcatcccagctactcgggaggctgaggcaggagaatcatttgaacccgggtggtggagcttgcagcttgcagtgacctgagatcacagcactgcactccagcctgggagacaaagccagactccgtctcaaaaaaaaaaaaaaaaaaaaaaaaaaaaaaggaaaagaaaagaggaaattctgaacccagtgcccgctccttgcagatctgcgaacagtggcaccagcctctagtctcaatgtgaggtttgactccaggacgatgaatttaagctgggactgccaagaaaacacaaccttcagcaagtgtttcttaactgacaagaagaacagagtcgtggaacccagggtgagacgaatttcccattctcaacccctgtcctttacacacccctttctgagttaaaagcaacagggccggctgggcgcggcggctcacgcctgtcatcccagcactttgggaggctgaggtgggcggatcacctgaggtcgggagttcaagaccagcctgaccaacatggtgaaaccccgtctctactacaaatacaaaattagccgggcgtgctggtgcatgcctgtagtcccagctactcaggaggctgagggcagaagaattactcgaacccgggaggtggaagttgcagtgagtcgagctcgtgccattgcactccagcctgggtgacagagcgagactctgtctcataaaatgcaataaggccgggtgtggtggctcacgcttgtcatcccagcactctgggaggccgaggcaggtggatcacctgaggtcaggagttcaagaccaggctgaccaacatggtgaaaccccatctctactaaaaatacaaaaattagtcgggcatggtggcaggcatctgtaatcccagctactcgggaggctgaggcaggagaattactgaaactcgggaggcggaggttgcggtgagccgagatggtgccattgcactccagcctgggcaacaagagcaaaactctgtctccaaaaaaaaaaaaaaataataaattcaattaaataaaagcgagagggccacagacacaaacaacacaagtgtggtatttggagaaatgtcacagccataatctcacgggaaccgggaaagtgctgttagctcatgtccacaatgtgtaccagagcctgattccctgaggcagagcctatgttaccgtattttaccccaagagaagagaaatcctggcaaatgcagttggatgtgcccctgggtctgtggtggaagcaggacggagaaaagtaaagtgtcagtcacgttgtcagtgtgtcaccgtcctggttccccaagggattaaggtcagggtttttggaacacaggagacagagacagaagagcggggagaggggagggaaggagggagaaacacagagaaaggatagaaggaggagggagaggaagagagaaatatggatgatcgatagataggtgatagatgatttattgactgataggtgataatagatgattggaagattgataatcaattctataggtagatgctacacggagggatgggtggtcttgctatgttaccccagatgacatactttttttttttttttttttttttgagatggagtttccctcttgttgcccaggctggagtacactggtgtgatcttggctcactgcaacctccacctcctgggttcaagcgattctcctatctcagcctcctgagtagctgggattacaggtgcgtgccaccacgcctggctaatttttgtatttttagtagagacggggtttcaccatgttggccaggctggtctccaactcctgacctcgtgatccaccctccttggcctcccaaagtgctggcattacaggtgtgagccaccgtgtccgacctttattttttgggatggagtctcgctctgtcgcccaggctggagtgcactggcgtgatctcagctccctgcaacctgtgcctcctgggttcaagagattctcctgcctcagcctcctgagtagctgggattacaggtgcccaccaccacacctggctaatttttgtatttttagtagagacggggtttcaccatgttggccaggctgatcttgaactcctgacctcaagtgatccacccgcctcggcctcccagagtgctggcattacaggtgtgagccactatgtccgaccctttttttggggggatggagtctctgtctgtcacccaggctggagtgcactggcgtgatctcagctcactgcaacctgtgcctcctgggttcaagagagtctcctgcctcagcctcccgagtagcagggattacaggtgcctgccaccacacctggctaatttttgtatttttagtagagacggggtttcaccatgttggccaggctggtcttgaactcctgacctcaagtgatccacccgccttggcctcccagagtgctgggattacaggtgtgagccacggcacctggcctctagtctggtactttcagcactgctagagtataagattgagttttcacctgcaagctggtattcagcgtatccactcagagccctcggaggaagcttagggggatgatttcacaaagggaggcaggtgcgtgtcgccaaatccaggtaaaaaccaataccatggccgggcatggtggctcacgcctgtaatcccagcactttgggaggccgaggcgggtggatcacctgaggtcaggagtttgagaccagcctggccaacatggtgaaaccctgtctctactacaaatacacaaattagcagggtgtggtggcgggtgtctgtaatccgagctactcgggaggctgaggcgggagaattgcttgaacctggaaggcggaggttgtagtgagccgagatcacgccactgcactccagcctgggagactgtaggagacagaaggttgtttcctaatcggctctgtctggttgcaattcttcagctcagtaacaacgaatgttcgtgcacatttcgtgaaatttgtctgcatgaaggagtcacatttgaggttcacgtgaatactagtcaaagaggatttcaacagaaactgctttatccaaattcaggtaagcaagacagctcagggatccgtttacagcactggccccaccaccccgccagcatcaaagtacatcccgttgaacttcggagtgaaaattattttgtttctacctcttcccaggaagggagggtaccgctgctcagaatttctcctgtttcatctacaatgcggatttaatgaactgtacctgggcgaggggtccgacggccccccgtgacgtccagtattttttgtacatacgaaactcaaagtaagtgttcacctcatgtgaagaattatgaggaatgcagggatgggagaaaaaatcatgctggttttctttttttcctttttctttttttaagacatggtcttgctctgttgcccaggctgcaatgcaatggtgccacctcggctcactgcaacctcgacctcctgggttcaagcaattttcctgcctcagcttcccaggtagctgggattacaggcgcccgccaccacaccaggccacatctatgtatttagagacagagtcttgctctgtcgcccaggctggagtgtagtgatgtgatctcagctccctgcaacctgcgcctccctccagggttcaagtgattctcctgcctcagcctcccaagtagctgggactacaggtgcactccaccacacctgtctaatttttgtatttttagtagagacagggtttcaccatgctggccaggctggtctccaactcctgacctcaagtgatctgcctgcctcaacctccccaaagtgctgggattacaggcgtgagccactgcacctggcctgtttttttggttgttgttttgttttgtgttttttgttttgttttgtgtttctttttgttttgccttgtgtttttgtgttcttgttttgttttgtgtttctgtgtttttcttttgtttttgtgtttttttggtttcacgtttttgtggtgttttgtgtttttgtgtttttgttttttgtgtttgtttttgttttgttttgtgttttgttttgtgtttgtttttgttttgttttgtggtttttgttttgtgttgtgtttgtttttgttttgtgtttttttgtttgtgttttggtgtttttgttttgtggttttcttttgtgtttgtttttgttttgtgtttttgtgtttttgtttcattttgttttgttttgtgtttttgtgttttgttttgttttgtgtttgtttttgttttgttttgtgtttttgtgtttttgttttgtgttttgtgtttttgtgttttgttttgttttgtgtttttgtgttttgtttttgtgttttgttttgttttgtgtttttgtgttttgttttgtgtttgtttttgttttgttttgtgtttttgtgtttttgttttgtgttttgtgttttgttttgtgtttttgtgttttgttttgttttgtgtttttgttttgttttgtgtttttgatttgtgtttttgtgttttgttttgtgtttgtttttgttttgtgttttgtgtttttatgttttgttttgtgtttgttttcgttttgttttgtgtttttgttttgtgttttgtgtttttgtgggttttttttgttttgtgtttttgttttgtgtttttgtgttttgtgtttttgtgttttgttttgtgtttgtttttgttttgttttgtgtttttgtgttttgttttgttttcctgattgctctctgagcactttctaatctttcaggagaaggagggagatccggtgtccttattacatacaagactcaggaacccatgtgggatgtcacctggataacctgtcaggattaacgtctcgcaattactttctggttaacggaaccagccgagaaattggcatccaattctttgattcacttttggacacaaagaaaataggtgagaataacacatatgattttcctattgtttataggtgaaatggaatttgccttaaaatctgtgtaactgaggccacgtgcggtgtctcacacctgtaatctcagcactttgggaggccgaggcgggccgatcacctgagatcgggtgttcaaaaccagcctgaccaacatggggaaaccccatctctactaaaaatacaaaaattagccgggcatggtggcgcgtgcctgtaatcccagctactcggaaggctgaggagaatcactcaaacctaggaggcggacgttgcaatgaggtgagattgtgccactgcactccagcttgagcgacagagcaagactctgtctcaaaaacaaacaaacaaaaatctgtgtaactttggtgctgtaacaaattagaactgagctgatttaactttcctttttttgagatagagtctcgctctgtcacccaggctggagtgcagtggtgcaatctcagctcactgcaacctctgcctcccaggttcaagcgattcttctgtcttagtctccttagtagcttggattacaggtgcacaccaccacgctcggctaatttttgtatttttagtagaggcagtgtttcaccatcttggccgggctagtctcgaactcctgacctcagatgatccacctgcctcagcctcccaaagtgctgggattacaggcgtcagccactgcacctgacctccctctttacctccttccttctttccttcctccctgcctttctgcctttcttcttttttcttccttccttccttccttccctccctccctcctttccttccttccttcctccttccctcccttcttccttccctccctccctctctccctcccttcttcattccttccttcttcctctccttccttctccttcactcatttcctccttccttcctctttttcttcatttcttcctcaccagcacctcttcgtgtcccagtgccctgctcctggctggcctcttggagccagtcccatatgcccacacgctctcctcttcccaagcccaccgcatcccacccgtggactccttcatcccgttggacgttcccagcctcttcaggcttaggactctcacagaagtgtgactcctgcccaccaagcccatccccacctcccaccctggaacccctgccccagtgggtatctctcctgtacatggtagctgccccacctccacttggacccagtgtagacaggaggagaccctgtaccacctccacctggacccagtgtagacaaagaggtgtccctactccacgtccacctggatccagtgtagacaggaggagactgcaccacctccacctggacccagtgtagtcaaagagatgtccctactccacgtccacctggacccagtgtagacaggaggagaccctgtaccacctccactttacccagtgtagacagaaggagaccctgcaccacctccacctggacccagtgtagacaaagaggtgtccctactccacatttacctggacacagtgtagacaggaggagactgcaccacctccacttggacccagtgtagacaggagaccctgcaccacctccacctggacccagtgtagacaaagaggtgtccctactccacgtccacctggacccagtgtagacaggaggagactgcaccacctccacctggacccagtgtagacaaagaggtgtccctactccacatttacgtggacacagtgtagacaggaggagaccctgccccacctctacctggacccagtgtgaaggcgaccagcccttccacacatgtgggtatttctcgtcaggtgggacgagagactgagaaaagaaataagacacagagacaaagtatagagaaagaacagtgagcccaggggaccggcgctcagcatacggaggacctgcaccggtctctgagttctctcagtatttattgcttactattttcactatcttggcaaggggaatgtggcaggaggacagggtgatagtggggagaaggtcagcaggaagacatatgagcaaaggaatctgtgtcacaaataagttcaagggaagctactatgcctggatgcacacgcaggccagatttatgcttctctccacacaaacatcagtgtagcaaagagtcacagagcagtattgccaccagcatatctcgcctccagccacagggcggttttctcctgtctcagaatagaacgaatgtacgatcgggttttacacggagacattccattcccaggggcaggcaggagacggagggcttcctcttatctcaaccgcgagaggacttcctcctcggcacagaccctttatggatgtcgggctgggggacggtcaggtctttttcccttcccacgaggccatatctcagactgtctcagtggggggaaccctcagacaatacccgggctctctcgggcagaggtccctgcggctttccgcagtgcatggtgtccctggttaatagagaatggagaatggcgatgacttttaccaagcatgctgcctgcaaacctattgttaacaagacacagcacatgtttctgtgagcacagtgttggggctacagttacagcttaacagcatctcaaggcaaaacagtggttcaacatacagatcacaatggagtttcttaccttcctttctacatagacacagtaacagtctgatctttctttttgtttgtttgtttgtttttctgagacagagtctcactctgtcgcccacccaggctggagggcagtggcgggatctcggctcactgcaacctccgcctcccgggttcacgccattctcctgcctcagcctcccgagtagctgggactacaggcacccgccaccacgcccggctaatttttttggatttttagtagagacggggtttcaccgtgttagccaggatggtctcgacctcctgacctcgtgatcctcccgcctcggcctcccaaagtgctgggattacaggcgtgagccaccgcgcccagccccctgatctctctttcttttccctacacagagtagacaaagaggtgtccctactccacatttacctggacccagtgtagacaggaggagaccctgccccacctccacctggacccagcgtagacaaagaggtgtttctactccatatctacctggacccagtgtagatgggaggagaccctgccccatctccacctggacccagtgtagacaaagaggtgtccctagtccacatccacctggaccgagtgtagacaggaggagaccctgccccacctccacctggacccagtgtagacaggagaagactctgcaccacctccacctggacccagtgtagacaggaggagaccctgccccacctccacctggacccagtgtagacaggagaagactctgccccatctccacctggacccagcgtagacaaagaggtgtttctactccatatctacctggacccagtgtagatgggaggagaccctgccccacctccacctggacccagtgtagacaggagaagactgcaccacctccacctggaccgagtgtagacaggaggagaccctgccccacctctacctggacccagtgtagacaggaggagaccctgccccatctccacctggacccagtgtagtcaaagaggtgtccctactccacctccacctggacccagtgtagacaggacctactccacctccacctggacccagtgtagacaggaggagactctgcaccacctccacctggacccagtgtagacaggacctctcgggttcaggggtgtgtcctgcgccctcgttacagaacgattcaaccctcccagcaatgtcaccgtacgttgcaacacgacgcactgcctcgtacggtggaaacagcccaggacctatcagaagctgtcgtacctggactttcagtaccagctggacgtccacagaaaggtcggtgagagctccccggggctgggcaccaggagggaggcgtacgggacacgcccgcacaggagcctgggaatcccggggaagtggcctgggggaaggatgcgtgggtggtgagcggtgactctggggtgaacgcacttcgggtagcggaggaagaggtgaagggtctgtggcctgtggagccaccttgaaagaggttgcagggagggtggacaaggatgatcctgcaaccatggaaccaggaagtggaccgggaggtgtgggggacgatgccacaagcaaggagagcctctgctccacctccagctggacgcagtgtagacagaaggagaccctgccccatgtctacctggacccagtgtagataggaggacacccgaccccacctccacctacacccagtgtagacaggaggagaccctgctccacctccatggagacccagtgtagacaggaggagttcttgtcccacaactacctggacccagtgtagacagggagagagactgcctcacgtccacctcgatccagtgtagacaagaggagatcttgtctcacaacctcctggacccagtgtagacaagaagagaccctgccccatgtccacctcgagccagtgtagacaagaggagatcttgtcccacaaccacctggacccagtgtagacaagaaggagagcctgctccatgtctacctggacgacaggagaacaccctgccccaaggccagtgggacctttctggatgggttacaggaagatatctggccaggaagacttctgtgtttgcagctcctcatcctacctgtcttgtagattcggggtttgtggagggagacctgcctgccactccgcagggactccttcccattcggtgcccacaccaggggagacactgtgtgaaccatctacagtgttttagaaatggaaacagtgagccttgtgttgtgttttgttttgtttctagaatacccagcctggcacggaaaacctactggtaagtgaaaccacagaccctactgacaaccctcagcgtaaccctacggtcccctactcaccacacctagtgtaactctacagtcccctactcatgacccctacagtcccctaccgacgacctccagcgtaaccctacggtcccctactcaccacacctagtgtaactctacagtcccctactcatgacccctacagtcccctactgacgacctccagcgtaaccctacagtcccctactcaccacacctagtgtaaggaggaggagaccctgccccacctccacagagacccagtatagacaggaggagctcttgtcccacaaccacctggaccccgtgtagacaggaagagaccctgccccacgtccacctagcttaatcctacagtcccctactcaccacacctaatgtaactctacagtcccctactcatgacccctacagtcccctaccgatgacctccagcgtaaccctacagtcccctactcaccacatctagtgtaactctacagtcccctactcacgacccccggagtaatcctacagtctcctactcacgacgcctacagttccctattcatgacccctagcgtaaccatacagtcccctacccatgagccctggcataaccctacaatcccctactcaccacacctagcataaacctacagtcccctacccatgacccctggagtaaccctacagtcccctagtcactacacctagtgtaactaaccatacagttccctatccatgacctctggcggaaccctacactcccctactcacaacccctagtgtaaccctacagtctcctacccatgacccctggcggaactgtacagtcccctactcacgacccctacactctcctacccatgacccctggcggaaccctacagtcccctactcacgacccgtacagtctcctacccatgacccctggcagaaccctacagtcccctactcacgacccctacactctcctacccatgacccctggcagaaccgtacagtcccctactcacgacccctacagtctcctacccatgacccctggcggaactgtacagtcccctactcacgacccctacagtctcctacccatgacccctggcggaactgtacagtcccctactcacgacccctacactctcctacccatgacccctggcggaaccctacagtcccctactcacgacccctacagtctcctacccatgacccctggaggaaccctacagtcccctactcacgacccctacagtctcctacccatgacccctggcggaactgtacagtcccctactcacgacccctacagtctcctacccatgacccctggcggaaccctacagtcccctactcacgacccgtacagtctcctacccatgacccctggcagaaccctacagtcccctactcacgacccctacactctcctacccatgacccctggcggaaccgtacagtcccctactcacgacccctacagtctcctacccatgacccctggcggaaccgtacagtcccctactcacgacccctacactctcctacccaagacccctggcggaaccctacagtcccctactcacgacccctacactttcctacccatgacccctggcggaaccctacagtcccctactcacgacccctacactctcctacccatgacccctggcggaaccctacagtcccctactcacgacccctacagtctcctacacatgacccctggcggaaccctacagtcccctactcacgacccctacagtctcctacccatgacccctggaggaaccctacagtcccctactcacgacccctacagtctcctacccatgacccctggcggaactgtacagtcccctactcacgacccctacagtctcctacccatgacccctggcggaaccctacagtcccctactcacgacccgtacagtctcctacccatgacccctggcagaaccctacagtcccctactcacgacccctacactctcctacccataacccctggcggaaccgtacagtcccctactcacgacccctacagtctcctacccatgacccctggcggaaccctacagtcccctactcacgacccctacagtctcctacccatgacccctggaggaaccctacagtcccctactcacgacccctacagtctcctactcatgacccctggagtaaccctacagtcccctactcacgacccctacagtctcctactcatgacccctggagtaaccctacagtcccctattcaggagccgtagtgtgaccctacaatcccctactcacaacccccggtggaaccctacagtcccctacccatgacccctggtggaaccctacagtcccctactcacgacccctacactctcctacccatgacccctggcggaaccctacagtcccctactcacgacccctacagtctcctacccatgacccctggcagaaccctacagtcccctactcacgacccctacactctcctacccatgacccctggcagaaccctacagtcccctactcacgacccctacagtctcctactcatgacccctggagtaaccctacagtcccctattcaggagccgtagtgtgaccctacaatcccctactcacaacccccggtggaaccctacagtcccctacccatgacctctggtggaaccctacagtcccctactcacgacccctacactctcctacccatgacccctggtggaaccctacagtcccctactcacgacccctacactctcctacccatgacctctggtggaaccctacagtcccctactcacgacccctacactctcctacccatgacccctggcggaaccctacagtcccctactcacgacccctacagtctcctacccatgacccctggcagaaccctacagtcccctactcacgacccctacactctcctacccatgacccctggcagaaccctacagtcccctactcacgacccctacagtctcctactcatgacccctggagtaaccctacagtcccctattcaggagccgtagtgtgaccctacaatcccctactcacaacccccggtggaaccctacagtcccctacccatgacctctggtggaaccctacagtcccctactcacgacccctacactctcctacccatgacccctggtggaaccctacagtcccctactcacgacccctacactctcctacccatgacctctggtggaaccctacagtcccctactcacgacccctagtgtaaccccacatgacccccagtgtaaccctatagtcccctacccacgacctatgtctgcctagacccagtgtgatcaggaggagaccccacctcacctccccctagacccagtgtagacaagaaggagagcctgccccacgtctacctggatccagtgtagacaggagaatactctgcccgacatacagttgaaccactcacaaccctagcgtcaccctacagtctccacgaaccctacagtcttggtttatgggactcttagtgccagtgtggcccaggggtggacacggtggatcctgaaccagaggatgcagatctcacacgggtgagggccccctcatagttctcactgggcagggtctgctcttggcctcaaccttcgtgtcccaatggttggaatatttatgctcagcctgttctactgattttcccattttattcctctttcctctacgtgggttaagaatatattctagtgactgtctaaggagattatgtctccctctaaaatgcttttagagtgagtactgttgccgggtatttaccaagtctcgcggccactctgaccctcggtatcctcctctgtccgatgagtatgctagacttggggatcttaatatcccttgctaaactatccgtctgaaggtctgttaatatcagttgttgatcctgaatcatttatttatgtatgtatttatttttgagacggagtctcgctctgtcccccaggctggagtgcagtggtgcgatctcggctcactgcaagctccacctcccagcgattgtcctgcctcagcctccctacagagattctacagtctcagcctgtagctgggactacaggcacccacccccacacctggccaacaatttctgtttcagaaaataaaattttagccaggcacggtggctcacgcctgtcatcccagcaccttgggaggctgaggtgggcggatcacttgaggtcagcagttcaagaccagcctgggcaacatggagaaaccccatctctactaaaaatacaaaacgtacccatgcgtggtggcgggcgcctgtaatcccagctacgtgggaggctgaggcaggagaatggcgtgaacccgggaagcggaggttgcggtgagcccagatcatgccattgcactccagcctgggcgacagagcgagagtgtctcaaataaaataaaataaaagaggccgggcgtggtggctcatgcctgtaatcccagcactttgtgaggccgaggcggtcggatcacgaggtgaggagatcgagaccatcctggccaacatggtgaaaccccgtctccactaaaaatacaacaaaaattagccgggcgtggtggtgggcacctgtagtcccaactactggggaggctgaggcaggagaatggtgtgaaccctggaggtggaggttgtagtgagccaagatcgcgccactgcactgcagcctgggtgacagagggagactccgtctcaaaaaataaataaataaaataaaataaaaaagcttaaagcctacatcacccaaattttcccaacttgtctcccatcgaaatactaacgaggcttgactctgcttagcttcgaagacccgatcagaccaagtgcattcagagtggtagaaaaaaaagaagaaaaagaaaaaaagaaaaggagaaaaaaacttaaaagacaaaagaacgaaaaaaggcaaccttttcctccacacagaagacgcctatctctaactttcttttttcctccaaagattaatgtttctggtgatttggaaaatagatacaactttccaagctctgagcccagagcaaaacacagtgtgaagatcagagctgcagacgtccgcatcttgaattggagctcctggagtgaagccattgaatttggtaagcgttgggcggaggtaagggatgtttgtgccgtctgcggccaccctgcagcaggcacagaggtcaggtgctctgtcctgggcgctgagatcgagttgagcacgtcgctgggagtagtgtcaggctctgagcttatcgctgaggctcaaaagaaggaggtggtctcgtacttggtcccgcaacattgctttgctgatgttttttcaggacggatgagttggctcccttaataaccagagaagggccaggtgcagcggttcacgcctgtaatcccagcaatttgggaggctgaggccggcggatcaccggaggtcaggagtttgagaccagcctggccaacatggtgaaaccccgtctctactaaaaatacaaaattagcccagcattgtggcaggtgcctgtaatcccagctactcgggaggctgaggcaggagaatcacttgaacccaggaggcggaggttgcactgagctgggatcacgccattgcactccagcctgggtgacagcgtgagactccgtctcaaaaaaaaaaagaaaaaaaaatacaaaaactaaccaggattggtggcacattcctgtaatcccagctactcaggaggctgagggcaggagaatgacttgaacccgggaggtggaggttgcagtgagctggggtcacgccattgcactccagcctgggtgacagagtgagactctgtctcaaaaaaaaaaaaaaaaaaaaaaagaaaaagtagaaggaggtggtctcatactcatacggggtcatgcaacattgctttgctggtgtttttttcagggtggatgagctagaatcccttaatagccagagaaggaccccactgatagccctcctaaagtcccacctccctctgctccactgggaaacaatcagtcagtctttgtccggtcaaaccgtcaccattccggctccctggccaaggggaagctctctccctctttttttcttttttttttttttttttttgagacggcgtttcgctcttgtcgcaggctggagtccagtggcgcaatctcggctcactgcaagctccacctcctgggttcacgccattctcctgcctcagcctccccagtagctgggactacaggtgcccatcaccacgcctggctaattttttgtatttttttttttttagtagagacagggtttcactgttttttagccaggatggtctcgatctcctgacctcgtgatccgcccacctcggcctcccaaagtgctgggattacaggcgtgagccaccgtgcccggccctccctcttttttttttttttttttttttagatggcgtttcgctcttgttgcccaggctggagtgcagtggtgccatctcggctcaccgcgatctccgcctcccaggttcaagcaattctccagcctcagtctcccgagtagctgggattacaggcgcccgccaccacacccggctaattttgtatttttagtagagacggggtttcaccatgttggtcaggctgttcttgaactcctgacctcaggtgatctgcccacctcgccctcccaaagtgctgcaatgacaggcgtgagccaccctgcccgtccggggaagctctcttcaaagccaggtctcggctgcccaggagacaggtctatgcttttctctgaagatgattttgagggctccaaattgaaaaggggaaggggcaggatattgagaagtatgcggttttcacctcaacaaagggtacagaagaaaaattgtgagctgcagtgcagtggtgcacctctacctcccagatcacacagacaaaatggggtacagggatgatcagaggtgcattcgtgtctggtgggccggggtgactgcacctgtaagaaattttttttgtttatttattttttgttatttgagacggactctcgctctgtcacccaggctggagtgcaatggcacgatctcagctcactacaacctctgcctcctgggttcaagcgattctcctgcctcagcctcccgagtagctgggattacattagacatgcatcacgcttggccaatttttgtatttttctttttatttatttatttatttattttgagatggagtttcgctgtgtcacccaggctggagttcaatggcacgatcttggctcactgcaacctccgtctcccaggctcaagcgattctcctgcctcagcctcctgagtagctacgattacagacatgcatcatgcttggccattttttaaatatttttatttatttatttattttgagacagggtctcactctgtcacccaggctggagtgcaatggcacgatctcggctcactgcaacctccgcctcccgggttcaagcgattctcctgcctcagcctcccgagtagctgggattacagacatgcatcacgcttggccaatttttgtatttttatttttatttatttatttatttattttgagatggagtttcgctgtgtcacccaggctggagtgcaatggcacgatcttggctcactgcaacctccgtctcccaggctcaagcgattctcctgcctcagcctcctgagtagctgggattacagacatgcatcatgcttggccattttttaaatatttttatttatttatttattttgacacagggtctcactctgtcacccaggctggagtgcaatggcacaatctcggctcactgcaacctccgtctcccaggctcaagcgattctcctgcctcagactcccaggtagataggattacaggcacccaccaccatgcctggctaattttgtattttttttttagcagagatgaggtttcaccatgttagtgaggcttgtctcgaactcctgacctcagatgatgcgcccgcctcggcctcccaaagtgctgggatgacaggtgtgagccaccgtgcctggcccaatttttgtatttttggtagagacggggtttcaccatgttggtcaggctggtctcgaactcccaacctcaggtgatcctcccgtgtcggcctcccaaagtgctgggatgacaggcgtgagccaccgcatccggcccatggtggcaaagttttaacagctcaccagaaatttccttgtgggcaaaacatagggcaggcaggttgctttcatctcagagccatcttagttaagaaccaaaaacagggaggcaggtttgctgggcccagttctcagcttgactgttccctttggctaaatgcatttggacacccgaagagatttaatttcctttcacatgtccgtcaacgattcaccgcagacgcaaacctgtgtgtctctccaggttctgacgacgggaacctcggctctgtgtacatttatgtgctcctaatcgtgggaacccttgtctgtggcatcgtcctcggcttcctctttaaaaggtaacctgtgaaacacctgggcctccccaatgaaaacaggccaggccgggaggaaagcgctttgtccagtctctgtctctgtctctgagaaagagaaacacagccttggccgggcgtgttggctcatgcctgtaatcccagcactctgggaggccgaggcgggtggatcacgaggtcaggagatcgagaccatcctggctaacacagtgaaaccccgtctctactaaaaaattagcccggcgtggtcgcgggcgcctgtagtcccagctactcgggaggctgaggcaggagaatcgcttgaacccgggaggtggaggttgcagtgagccgagattgcaccactgcactccagcctgggcgacagggcgagactccatctcaaaacaaacaaaagaacggagaaaacgggagatcctacaggaatacacagtgatgctcacagggaatctttctagaatcttccctcagcccctcgggcacagggatgggaatggaacaggcagtcagctgtgggcagcttcagggagtctgaagtcactgctgttgaagggctgagctccagaggggaaacgcctgccttgatcccactagccttgaagagcgtggtttctgggttggaggtgggtttttttttgtttgtttgtttttttgttttttgttttgagacagacttttgctcttgttgcccaggctggagtgcagtgttgcaatctcggctcactgcaacctccacctcccgggttcacgccattctcctgcctcagcctcccgagtagctgggattacaggcatgcaccacgatgctcacctaatttttgtatttttagtagagatggggtttcaccacgttggccaggctggtctctaactcttgacctcaggtgatccacccgccttcgcctcccaaagtgctgggattacaggtgtgagccaccatgcctggcctagttccttaagatgtttgtcatttggtgatttttttttgtttttttgagatggagtctcactctgtcacccaggctggagtgcagtggtgcaatctcggctcactgcaacctccacctcccaggttcaagcaattctcctgcctcagcctcctgaatagctgggattacaggcaagcaccacgatactcagctaatttttgtatttttagtagagacggggtttcaccacgttggccaggctggtctcaaacctcaagtgatccacccgcctcggcctcccaaagtgctgggattacaggtgtgagccactgcacccggcctagttccttaagattttcgtcacttggtgattcttagtgaagttttgcatagttgagcgcagacaccccgcacgcagcatccctcggcacagggcgttgatggaaggaactctggtgacccggggttcattctcttcacactttttctctgtgtctcaggttccttaggatacagcggctgttcccgccagttccacagatcaaagacaaactgaatgataaccatgaggtggaagacgaggtaggcaggggtgggcggagcagtgacctgggatggaaggtggggagtggggagcgtgggacacggcctctgggtgtcgaccatcttgcttctccaccagatgggaccgcagcgtcaccaccggtgtggctggaatctgtatcccactcctgggccttctcccgggtcggggtcttctccaaggttggggtcagagtcatctctgtgagctccatcaggagaaactgaggcagggtggtggtcaagaaaaggaggagaagacggtagagagggccaggcacggtggctcatgcctgtcatcccagcactttgggaggttgaggcatgtggatcatctgaggtcagaggttcgagaccagcctggccaacgtggtgaaaccccatctctgctaaaaatacaaaaaattagctgggtgtggtggtgtacgcctgaaatcccagtgactcgggaggctggggcagtagaacggcttgaacccagggggcggaggttgcagtgagccgagatcgcaccactgcactccagcctgggtgacagagcgagactccatctcaaaagaaaaaagaaggtagagaggagaggcagaaatagagacaagagacagaggcagagaaagatggagggagagagatggaggagagagagaggaatgtagaagagaatgaggagacacaaaagagagggaaacaggcagacagactgacagaaacaaaggcagacacacagacagagaaacagagagagggagggagaaaagggagaaggaaagagagagacacgagacacagatggagaaacagagacagataaacaacaaacataaagacccaggcgggggccggtcgcggtgactcacatctgtcatcccagcactttgggaggccgaggcgggtggatcacttgaggtcgggagttcgagaccagcctgaccaacctgaagaaacctcgtctctactaaaattgcaaaaattagccaggtgtggtggcgcacacctgtaatcccacctactctggaggctgaggcaggagaatcacttgaacccaggaggcggaggctgcagtgagccgagatcgcaccattgcactctaacctgggcaacagagcaaaactctctatcaaaaacaaaacaaaacaaaaaaatcatccccagcagggagaggagagagacagagaggaacagaggcacagagaggggagagagacaaagacagagagacacagagaaagacacagaaaaagagagagagagggagaaggagacatagagacagggacaaagagaaaaagacggacagagagagaaacagagagacataggtggacacagagaggggagagagagagagagacagaaagagacagagagcaagggatgggagtggaagagagagacagatggaggaaaaagacagagagggaggcagataaaagacacacagagacaccgagagagacagggaagacagaggagtcggacttagtctcagcgagagcccagagagggtgaacaagggcgaggaaccatgtgacctgcaccctgagaccccattggcgctcctctcccacccacctctctccggctcagggactgcgtcttatgttgcagtaggctggcaggctggaaagtcaggccagggctgatgctgcatcccagaggcagaactgtcctgcattctcagagtgggagatgaaatttttaaaaaggaaataaaactcttgtcggggaacctcagcttttatcctttagacgtttgactgattagaccaggcccactcttctcctttacactttcggctgattgaatgaggcccacccttccccctttacaccttcgactgattagatgaggcccaccattcccctttagaccttcgactgatcagatgaagcccacccttcccctttagaccttcagcttattagataaggcccacccttaccctttagactttcaactgattaaatgaggcccactctccccgtttagacctttgactgattagatgaagcccacgcttctcctttggaccttcaactgattagatgaggcccacccttcccccttcagcctttcgactgattagatgaggcccaccctcccctttataccttcgactgattagatgaggcccaccctcccctttataccttcgactgattagatgaggcccaccctcccctttataccttcgactgattagatgaggcccgtccttcccccatttagatcttcaactgattagatgaggcccacctttccctttttagacctttgactgattagatgaggcctacccttctccctttagacctttgactgattagatgaggcctacccttctccctttagacctttgactgattagatgagacccacccttcccatttagaccttcaactcattagatgaagcccacccttccccccttcccctttagaccttcagcttattaattagacaaggcccaccccctttagaccttcaactgattagatgaggcccacccctcttcagaccttcaactgattagatgaggcccaccccctttagacctttgactgattagataaggcccacccacattctccagtccaatctcttttcctggaaatcagctgattgtggacttgacatctacaaagccccttcgtagcagccgctgagtcatggtttcattcaataactggggactgtagcctagtcacggggacacgtcattggtgccgggtatcagagacgaaggccaagagatgaaagagaaacagagactgaacccaaaagaggcagacacacaggaagatggagatagagacccagagatgggggtggaagaaggtgagagggggaggaaagagagacagagagggagacagagaaaagaggcagagagaccgagagagaggctgaacagcaagaccccagagagggtgactaagggtgagagacttgcgtgacccacatcccaagaccccgtgggtggccctctcccacccacctctctccagctcaggggctgtgtcttcctcccatggggaactccagttgcagcccagggttgcccccagcgccctcttctctgccacataggtaacatcctcctggttgccacttgcacacccccatcctagacctggccatctgtcattccattaccttccacccccacgccagcctcctccccggcccccgctttccactgacccccaggggtcccccacatcgaggtgccaggatgacggcttcaggcttcaaccttcccttctctgagctccatcagctccaggggcttagcacctgctgtaccctgcccaggtttcatgctcacaagctcttccaaagaccaccctgttcatcgtcaactatgaggtcccatgggtggatctgtctcagatctttaccccaggaaaaacccatggccaggtgcagtggctcatgcctgtcatcccagcactttgggaggccgaggcgagtggatcacctcgaggtcaggagtttgagaccagcctggccaacatggtaaaaccccatctccactgaaagtacaaaatttagctggtggcggctaaagggggaaaggtgggcctcatctaatcagtcgaaggtctaaagggggaagagtgggcctcatctgatcagtcaaatttgtggtggcgggcgcctgtaatcccagctactcaggaggctgaggcaggagaatcgcttgaacccgggaggccgaggttgcagtgagctgagatgacaccactgcactccagcctgggcaatagaatgagactccgtctcgagggagaaaaagaaaataaacacagcccactgagtcccaggctgagctcgtgaagatctgacagcctgaaccctcctttttctcagatcatctgggaggaattcaccccagaggaagggaaaggctaccgcgaagaggtcttgaccgtgaaggaaattacctgagacccagagggtgtaggaatggcatggacatctccgcctccgcgacacgggggaactgttttcttgatgatgctgtgaacctttatatcattttctatgtttttatttaaaaacatgacatttggggccaggcgcggtggctcacgcctgtaatcccagcactttgggaggccaaggcaggcggatcacctgaggtcaggagttcaagaccagcctgcccaacatggtgaaaccccatctggactaaaaatgcagaaatttacccaggcacggcggcggacgcccatcatcccagctacttgggaggctgaggcaggagaattgcttgaacccgtgaggcggaggttgtagtgagccaagatcgcaccattgcacaccaacctgcgtgacagagcaagattgcatctcaaaacaaacaataataataaataataaaaacctgatatttggctggg

SEQ ID NO: 2845 - DNA, 41573 bp, human
gagctactcagaagcgggagtctccgagagaagaaaagcaggtggaaggagaggaagcggatgccgtgggggtaagctaagttctttccttctgtggtctttgagcatgtcgagtcacccgggtacatgtttctgctgtgtctgtcgatagaaaagaaagagactgaactggaacataagatttcaaacgttggctcgagccgaagtggggacagcggcccagaagactgagagccaaggaaccttgcatatgagttgtcttctgcctttgttatatgcaggtttttaaaggcaaaattaaaaaaataaaataaaataaaaagagggaggtgttgttggaggacagggagggggcttctgtgaagctgtttgctgggaattctcgttggtttacagaaaaaaacaattgattaatgattggctgtacattgctaagctacagggcgttggggtgtagtatctagcacggaattatcacgtgaattcacagctatctgtggcatccggaagccgtttcgagagatgaacgcggccgggcgtggtggctcacgcctgtaatcccagcactttgggagactgaggcgggtggatcacctgaggtcgacagttcgagaccatcctggccaacatggagaaaccccgtctctactaaaaatacaaaattagccgggcatggtggtggcaggcacctgtaatcccacctactcaggaggctgaggcaggagaatcgtttgaacccgggaggcggagcttgcagtgagctgagattgcaccactgcactccagcctgggcaacaagacgagattctgtctcaaaaaaaagaaaaagaaaaaaaaagagatgaaaagagatgaacgcagagctgaaagggggagggagtgtgatggtgttactagttactagaaaggggtcctgatccagacttcaagaacgggttctgggatcttgcccaagaaagaactggaggcaagttcacattgcaaactgaaagcaagcttattaagatagtaaaggggggccgggcacggtggctcatgcctgtaatcccaacacttttggaggctgaggcgggcggatcacctgagctcaggagttcgagatcagcttggccaacatggcaaaaccacacctttattaaaaatagaaaaaattagctaggtgtggcagtgtgtgcctgtaatcccagctacttgggaggctgaggcaggagaatcgcttgaacccgggaggcggaggttgcagtgagcccagattgcaccgttgcactccagcctgggcaacaagagcaaaactctgtccccaaaaaaagataactaaaagaaaaaagtcgtggggagagatgctccactacaagggtgactgataaaggattcatctttgtcatgactatcttttgcagtaatcaatattgtatatatacatattatatattttttattattattattttgagatcatctggctgtgtcatccaggctggagggcagtggtgcaatcacagctgactgctgtcttgaattcctgggctcaagcaatcctcccatctcggcctcccgagtagctgggtcaaaggcaaatgccaccattcctggcaaatatttgtatttttgtagggacgagggtttcactgtgtttcccgggctggtcttgaactcctagactcaatctatcttcctgccccagcctcccaaagtggtgggatgacaggtgtgggccaccgcgcctggcccaatattatcatttttaaagcaaaacggattctcacactatgaaagcttttgttctgaagatatcaacacatcaggaggtttctgtgtctgttcagtcctcggtctgtttagtaaacagtattgatctgttcacatatcttgcgtcaggaatggctgacctccagggaatgctgcccagcctgtcccagcctccctgttcccagcccctattctagatggagtccctctaagctgggcgtggtgtaatcccaggactttgggaggctgaggtgggcggatcacctgaggtcaggagttcgagaccagcctggccaacagggtgaaaccccatctctactaaaaatacccaaaattagccggggcgtggtggcgggcgcctgtaatcccaatattttggaaggctgaggtgacagaggattgcttgaggccacagcaattccagaccagcccggggcaacatcgtaagattcccccatccctcgtgtataaaaaaaagattaaattattacaaattttaaaaaagacagaaatgaagcatcttaagttaccacccagattggggtactaagagtctggatttggacagcttgttgcgcgttttataggtgtgctaaatcacatttcactctttttgttgagacagagtctcgtgctgtcgcccaggctggagggcagtggcgcgatctctgctcaccgcaacctccgcctcctgggttcaagcaattctcctgcctcagcctcctgagtagctgggattacaggcacctgccaccacgcccggctaatttttgtattttttttttttttttttttttttggagacagcgtcttgctctgtcgcccaggctggagtgcagtggtgcaatctccgctcactgcaacctccacctcccgggttcaagcaattctcctgcattagcctcctgagtagctaggattacaggcacgtgccaccatgcccagctaatttttgaatttatttatttatttttttggagacagtatcttgctctgttgcccaggctggagtgcagtggtgcgatctcggctcactgtaacctccgcctcccgggttcaagtgattctcctgcctcagcctcctgggtagctgggattacaggtgtgtgctaccatgcccggctaatttttgtatttttagtagggatggtgtttcaccatgttggccaggctggtctggaactcctgacttcaaatgatccgctcaccttgacctcccaaagggctgggattacagacatgaaccacggagcccggccggatttcactctttagatttttggtttaaactcgagaagctcttctcgagggctgaaagctcttggtcccctgtaggtttgctgtagatgacagacatgaggcagattgattaataagagaaaagacatgcactttttttttcttttttttttttgagacggagtctcgctctgtcaccgaggctggagtgcactggcatgatctcggctcactgcaacctccaccttccaggttcaactgattctcctgcctcagcctctccagtagctgggattacaggcgtgtgctaccatgcctggctaatttttctatttttagtagagacagggttgttccatattggtcaggctggtctcgaacacctgacctcaggtgatccgcctgcctcggcctcccagtgtgctaggattacaggcgtgaaccactgtacccagccagatttacacatttatagaatgtgtatacacaagattcttcagaatgaggactccaccccacaatgaggttcagaagctagtacaccacattgagactacagaaggataggggattggatcctggtacaaaaaaaaaaaggttatagggttggggggaaagaggaattctattgaggagcaatatataatttctactgcggactgaactctgatttttttctttattttattttattttattttatttttttgagacagcatctcactctgccgcccaggctggagtgcagtggtgcgatctcagctcactgcaacctccacctcctgggttcacccgattttcctgcctcagcctcccgagtagctgcgattacaggcacccgccactacgcccagctaattttctttgtatttttagtagagacggggtttcaccatgttggccaggctggtcttgaactcctgacctcaggtgatccaacctcctcggcctcccaaagtgctgggattatacgcatgagccactgcacctagcttcttctttttctttttttttttctttctttttttcttttttttttttagatggagtctaactttgtcgcccagactggagtacagtggcacaatctcagctcaccacagcctccacctcccaaggtcaagcaattctcctgcctcagcctcccaagtagctgagattacaggcacgtaccactactgcctgagtaatttttgtgtttttagtagagacaacatttcaccaggttggccaggctggtctcgaactcctgacctcaagtgatccacacgcctcagcctcccaaagtgctaggattataggcaccagccaccacaccgggcctctgactttttttatcttgcccaaattcctatctaagaggtctgaggaggcaagccctacaaaccataaattctcatcaaatgggatttattgaaccctgtatatcgtgacttactttccaacctgactctggcaaacgttacaagacagagaaaaaaaacaacatatgttgccccaaaatatgtttcttagttgtattttttttttcttttaagatggtctcattctgtttccaaggctggagtgcagtggtgcaatcttggctccctgcaacctccgtcttctaggttcaagcgattctcctgcctcctcagccttccaaatagctggcgtaatatgcatgagccatcgtgcccagataattgttttttgttttttgttttttttttagtagagatggggtttcactgtgatggccaggctggtcttgaactcctgacctcaggtgatccaaccgcctcggcctcccaaagtgctgggattataggcgtgaaccactgctcccggctggagtacaggggcataatcttggctcactgcagcctctgcttcccaggttcaagtgattctcctgcctcagtctcccgagtagctgggactacaggcgcccgccaccacgcccagctaatttttttttttttttttgtattttttttttttagtagagatggggtttcactgtgtttgccaggatggtctcgatctcctggcctcatgatctgcccgcctcggcctcccgaagtgctgggatgacaggcgtgagtcaccgcgcccggcatgaaagggtttttcattaaaaatccttgttataccgtggagccctgtgttggggtaaaatatcatgatttccctcactctccatcattcttgctttgaatctgagaaggaagcttggcggcctctattttaggatcagccgaaaatttccagaaaggggaaagaaaactcattctgtaaacacaaaaaagaagaagagaaaaaagtataagcggtacagacaaaacgcaaagatgttgcataattttccgtgagtgcaaaatgtcctgtaaaccaaaaaagaggtatctgagacaggtctcagtccatttagaaagttcattttgccgaggttaaggacgcctgcccatgacagagcctcaggaaatcgcgatgacaggtgctgtggatacacagggcacaatttgctttcatacatttttttggcggggagggagctggggatccagtcttgttctgtcacccaggctgcagtgcaatggtgcaatctcagctcactatcactgtaacctccgcctcccgtgttcaagctattctcctgccacagccttctgagtagctgggattataggcacccactaccgcgcccagctaatttttgtatttttagtagagacggggtttcaccatgttggccaggatggtctcgaactcctggcctcaaatgatccacctgcctcggcctcccaaagtgctgggattataggcgtgagccatggcgcccagccctggtatgtaatttttaaaacctttgtagtaccttatttacgaataaaatgcgaggcaggtttgcctaagacagtttccactataacctttcatgattttggggtcctgagacttatttacctttcacagtttacagcaggaaaatccgtggagacagcagatccgagaagcggcgatgtttgcgtagaaccctgtacgtgcttccttcggcctgtcggtaatgtggttggggattttcttttttttaagtgaagtctaaagaactgaaatgttttgctccataatgatgaaccaggatagaagtgagaactcagggcagaagaatctgaatgaggaactgtctgacctatgacaaatttaacatgtcacgttccctctgagacagtacacatcctcctgaagcagcgtgacaaggcacatcctcctgaagggtctccaggcagaagagacgcatgaacctgtcaaaaaaaaaaaaaaaaagagccggccgggcgcagtggctcaagcctgtaatcccagcactgtgggaggctgaggcggggggatcatgaggtcaggagttccagaccagcctggccaacatggtgaaaccccatctctgctaaaaatacaaaaattagccgggtgtagtggcagttgcctctagtcccagctactccggaggccgaggcaggagaatcgcttgaacccaggaggcgtaggttgcagtgagccaagatcgcgccactgcactccagcctgggcaacagagcgacagtccgtcccaaacactgcaaaatatttaaagagatttattctgagccaaatatgagtgagcaagaaggcccagggaaaatagtctaaagagatcctgagaacacgtatccaagctggttgagcggcagtttggttttatatgtttttgtttgtttacttattttactttattttatttatttatttatttattttgagatgaagccttgctcagtctgttaggctggagtgcagtggcgcgatctcggctcactgcaacctccgcctcccgggttcacgccattctcctgcctcagcctcccgagtagctgggactacaggcgcccaccaccatgcccagctaattttttgtatttttagtagagaaggggtttcaccgtgttagccaggatggtctcgatctcctgacttcgtgatccgcccgcctcagcctcccaaagtgttgggattacaggcacccgccaccacgcccggccaatttttgtatttttagtagcgacggggtttcaccatgttggccaggctggtctcaaacttgtgacctcacatgatctgctcacctcggcctcccaaagtgctgggattacaggcgtaagccacagcgtccagctattttattttatttgttttattttttgtgacagagtctcactctgtcgcccaggctggagtgcagtggagcgatctcagctcactgcaacctctgcctccggagctgaagcaattctcccgcctcagcctcccaagtagctggcattacagaggtacgccaccacgcctggctaaattttgtttgtttgtttgtttgtttgtttgtttgtttttgtttttcagtagacacagggtttcactatgttggccaggctggtctcgaactcctgacctcacatgatctgcctgcctcagcctccagaagtactgggattacagccgtgagccacctcacccagccagcagcttggttttatgtttgtttatatatttatttatttatttatttttaatttttggagacggagtcttgctctgttgcctgggctggagtgcagtggcatgatcttggctcacggcaacctctgcctttcgagttccagtgattctcctgcctcagcctcgcgagtagctgggagtacaggcgcccgccatcacacccggctagtatttgtatttttagtagagagagggtttcaccgtattgtccaggctggtcttgaactcctgtcctcaagtgatccacccacctgagcctctcaaagtgctgggattgcaggcgtgagcctctgtggccagccaacagacagttttgcaggaccatttcaaaatatgtcaagtaaatatattttggggtgaaatgtattttaaagtggcatatactgatttcccacagtcttgtctggggaggcatatcctggcctcctagaaagcatacacagtagcagacaggtgtggtggctcacgcctgcaatcccagccctttgggaggccgaggcaggtggatcacaaggtcaggagatcgagaccatcctggccaacatggtgaaatgctatctctactaaaaatacaaaaattagctgggcgtggtggtgcatgcctgtaatcccagctactcgagaggctgaggcaggaggaccacttgaacctggcaggtggaggttgcagtgagctgagatcacgccactgcactccagcctgggagacagagcgaggctccgtctctaaataaataaataaagcttacgcagtagctgagaagacagggaaaagaggtgaagaaatgacagaaagcttagaagtcgctcattataaccccttcctaccccatctcatgcttcccttaaagcataaacgaagggtgcttgtgttacaggaaaggggttcggatccagcccccaagagggggttcttggatctcacgcaagaaagaattcagggcggccgggcgctgtggctcacacctgtaatcccagcaccttgggaggcagaggcgggcggatcacgaggtcaggagttcgagaccagcctgaccaacatggtgaaaccccatctctactaaaaatacaaaaattagccaggtgtggtggtgcgtgcctgtagtcccagctactcgggagacagaggcaagagaatggcgtgaacccgggaggcgatgcttgcagtgagtggagatcatgccactacactccagcctgggcgatagagtaagtccatctcaaaaaaaaaaaaaaaaaaaaaaaattcggggtgagtcagcagtgcaaagccaaagcaaatttattacaaaagtaaaacagtgaaagaatagctactccagaggccgggcgcagtggctcatgcctgtaatcccagcactttgggaggtggaggtgggcagatcacctgaggtcaggagttcgagaccagcctgaccaacatggtgaaaccccatctctactaaaaatacaaaaattagccaggcatggtggtgcgtgcctgtagtcccagctactcgggaggctgaggcagtagaattgcttcaacttgggagacggaggttgcagtgagccgagatggcaccactgcactccagcctgggcaacagaatgagactcagtctcaaaaaaaaaaaaaaaaatttcagggcgagcaagtttattatgaaagtaaaatagtgaaagactaggtactccagaggccaggcgcagtggctcatgcctataatcccagcactttgggagcccgaggcaggtggatcacctgaggtcaggagttcgagaccagcctcgccaacatggtgaaaccccatctctactaaaaatacaaaaattagccaggcatggtggtgcgtgcctgtagtcccagctacttggaggctgaggcagtagaattgcttcaacttgggagacggaggttgcagtgagccaagatggcaccactgcactccagcctgggcgacagaatgagactcagtctcaaaaaaacaaaagatttcagggcgagcaagtttattatgaaagtaaagtagtggaagactagctactccagaggccaggtgcagtggctcatgcctataatcccagcactttgggagcccgaggcaggtggatcacctgaggtcaggatttcgagaccagcctcgccaacatggtgaaaccccatctctactaaaaatacaaaaattagccaggcgtgttggtgcgtgcctgtagtcccagctactcggaggctgaggcagtagaattgcttcaacttgggagacggaggttgcagtgagccgagatggcaccactgcactccagcctgggtgacagaatgagactcagtctaaaaaaaaaaaaaattcagggcaagcaagtttattatgaaagtaaaatagtgaaagactaggtaatccagaggctgggtgcagtggctcatgcctataatcccagcactttgggagcccaaggcatgtggatcacctgaggtcagaagttcgagaccagcctggccaacatggtgaaaccccatctctactaaaaatacaaaaattagccaggcgtgttggtgcgtgcctgtagtcccagctactcggaggctgaggcagtagaatcacttgaacctaggagacagaggttgcagtgagccgagatggcgccactgtactccagcctgggcgacagagtgagactccatctccaaaaaataaataaataagtcaaccaagaaggccgtacgtacagtggctcacacctgtcatcccatcactttgggaggccgaggcagggggattacttgagatcaggagtttgagaccagcctggccaacatggtgaaaccccgtctctactaaaaatacaaaaattagccaggcgtgttggtgcgtgcctgtagtcccagctactcggaggctgaggcagtagaatggcttcaacttgggagacggaggttgcagtgagccgagatggcaccactgcactccagcctgggcgacagagcaagaccgtctacaaaataataataataattaataataataataataactagtgcaagagaagtacacaaatatcccaaacatttagtgactcagcagagggggccagtctcaaggaacaggacttctacacctgttaccaccacctggggagttgtatctgaatctcaaggtcaggcccacccagacagaacatgcatctctagggtgccacaggagagtctgtccagtgcccagaaacacctgcaagacccagaagcaggctccaagaagcggggtgccacagtccagtgggggaagcggccacatccctgtcatgtgggctacagatgagttggggggcaggggcaggagaagaagaaacaggtgtggcctacatgcttttacttcctcttagcaagcgaggttcctcttgcagaggaacggtctgagagacacaaccgttttttttttttgtttgtttgcttttccttgagacagagtctccctctgtcacccaggctggagggcagtggcgcgatctcggctcactgcagcctccacctcctgggttcaagcgattctcctgcctcaacctcccgagtagctgggattacaggcacccaccaccccacccggctaatttttgtatttctagtatagatgaggtttcaccgtattagccaagctggtcccgaactcctgacctcaggcgatccgcctgccttggcctcccaaagtgctgggattacaggcgtgagccactgtgcccggccgagagacgcaatctttcagagaggaggtttggagcaggaacctcagggtggacagatgggtcccaccaggtgcagatgcttgaactaaagatgctacaaaggccgggtgcagtggttcatgcctgtaattccagcagtttgagaagctgaggcaggcagatcatctgaggtcaggagttcgagcccagcctggccaacatggcaaaacagcgtctctactaaaaatgcaaaattagcctggcataatggcgggcgcctataatcccagctacttgggaggccgaggcaggagaatcgcttgaacccgggaggcggaggttgcagtgagccaagattgcaccactgcactccagcctgggtgacaagagtgaaactccgtctcaaaaaaaaaaaaaaaaaaagaagaagaagaaaagaaatacattagtttggtccataaaggcgggacaactcaaagtgggggcttccaggctataaatgaatttaaacattttctggttgacaattggttgagtttgtagctcctcctccttctcttcttcctcctccttctccccccttcctcctcttcctcctcttcctcctcctccttcttcttctcttctttcttcttcttctctttccccttcttcttcttcttcctcctccttctcctcctcctttttcttcttcttccttatgggcttggatagaagtatattgacatggatccaccatttgtagaatcataccgagtagcttcttttctcctccttcctctccttctcctcctcctcctcctccttctcctgctccttctcctcctcctcctcctgctccttctcctcctcctcctccttctcctcctcctcctcctgcttctcctcctcctccttctcctcctcctgcttctcctcctcctccttctcctcctcctccttctcctcctcctccttctcctcctcctcattctcctcctgctccccttctcctcctccttctcctcctcctccttctcctcctgctccccttctcctcctccttctcctcctcctcctcctcctgctcctcctcctccagctccccttctcctcctactcctccttctcctccttctccttctcctccttctcctactcctccttctcctactcctccttctcctactcctccttctcctcttccttcttctcctcctcctgctccttctcctcctcttcctcctactcctccttctcttccttctcctcctcctccttctcctcctcctccttctcctcttcctccttctcctcctcctccttctcctcctcctccctctcctcctcctccgccttctcctactcctccttctcctcctccttcttctcctcctcctgctccttctcctcctcctccttctcctcctgctccttctcctcctcttcctcctactcctccttctcttccttctcctcctcctccttctcctcctcctgcacctttcctcctcctccttctttttccttttttgcataaagaagtatcaaataagagtagtttcactgccctaaacatcctctgaggtccatgtattcatccctccatctgcccaacgccaaccaactccggatctttttactgtttccatgattttgtcttttccacagtgtccaagtgttagaatgactcagtctgcagccatctcaaagtggattctttcccttagtcataagtatttaaacttcattcatgtcgttttatgtactcaccctttttttcttcctcttcttttttttttttttttcactttccttttatagctgttgcaaaagtcaagattttttaaaaaatataaaagagcagggccgggcacggtggctcacgcctgtaatcccagcactttgggaggccgaggcaggtggatcacgaggtcaggagatggagaccatcctggctaacacggtgaaagcctgtttctactaaaaaaaaaaaaaaaaaaaaaaaattagctgggtgtggtggcaggcgcctgtagtcccagctacttgggaagctgaggcaggagaatggtgtgaacctgggatgtggaggttgcagtgagccgagatcgcgccactgcactccagcctgggtgacagagcgtgactttgtctcaaaaaagaaaaaaaaagtacaaaagagcaaaacaaaacaaaagttatgaaaatgaaaacctgagccatcgtttatcttatttccccaaatccactaattattaacagaaagtaaaagctatgaaaaatgaatgaaagtgactgcaatttccttgaagtgtgttagaacctgcctttagtgtcagctatgggttccctcatgaaggtcagctgagccatgacccatgaaccatggaagcttgactctagattgaccatcttgagatgccaaagatgtccacgtcctaatcccatgtgggagacagaataatggccctgcagaccttcccagctggccatgacccctcatttgaccaggtcagcggctgaccaccatcctgggtttgtttccccaaatcacctccctggggtcccctgccaggaatgtcctgggagaggcaaccttctcactgtgtgatattttctctcctgcagctcttcccttctctctgaccagcaccatgcttctcctggtgacaagccttctgctctgtgagttaccacacccagcattcctcctgatcccagagaaatcgggtaagtatggaaacctggctgaaccttctccgcggcccctgtttagatgtcctgcatctggagacccatctggatacctgggtccatctgcatttcatctctaatgtttatgagggacccaataagcaccagccaacccaccagaagctcagagctcctcttgttctcacctccttttctgctgttaattcccatccacccattctacagatgagaaaacggaggctcagatacctccacagtttaacccaacgaccatccaggtagtgatggggccaggatgaggacccatgtctgcatggggccaaagtgttccttccttccttcgttccttcgttccttcgttccttccttccttccttccttccttccttcgttccttccttcgttccttccttccttccttccttccttccctcccttgcttccttctcttcctcctgccctccctctttccatccttccttctctccttccttccatccttctctccctcctgattcatttcttctctttctttctcttccttccttccctccttccctttctctctttcttccttccattgtttccttctttccttccttcttccgtccctcccttctttctttctctttcttccttccctccttccctctctctctttcttccttccattgtttttctttctttccttccttccctccctccctccctctctctctctctttctttctttctttctcctttttttttctccttctttgtttctttcttcctctttcttctttctttctttctttctttccttctttctttttctttcttttcagagtctccctcttgttgcccaggctggagtgcaatggctcaatctcagctcactgcaaactcagcctcccgggttcaagcgattctcctgcctcagcctcccgagtagctgggattacaggcgcctgccaccaggcccagctaatttttttgtatttttagtagagatggggttttgtcatgttggccaggctggtctcaatctcctggcctcaggtgatcccgtgcctcggcctcccaaagtgctaggattacagctatgagccgccacacccagcctcttgtttgttgacttcttaatagcagccattgtgactggcgtggaatgatagctcattgtggttttgatttgcgtttccgggagggaccctcttgactgagggtgtcagggcctctgcttcaggaaagtatttccaggtttttgtgacctggttcagggaagacagacaaagacagctttctgtttctgcaattttctcaaattccttcagctttatattaaactgccaaggttccataatttgggaagtgtgttcagagccacatcactctggataaagagcctttgcctgttctcattcaagcggttttctttctctgtctctcttttttttttttttttttttttttttgagacaggatctcgctctgtctcccaggctggagtgcagtggcgtgatctcggctcactgcagcctcagctttctgggatcaagtatcctcccactccagcctcccaagtagctgggactgcagaaatacaccaccatgccaagctaatttaaattttttttttaattttatagaggagatcttgctatgttgccaagactagtttttgatttttttttttttttgagatggagtcttactctgtcacccaggctggagtgcagtggcgcgatctcggctcactgcagcctcagctttctgggatcaagtatcctcccactccagcctcccaagtagctgggactgcagaaatacaccaccatgccaagctaatttaaatttttttttttttaaattttatagacgagatcttgctatgttgccaagactagtttttgattttttttttttttttttttttgagatggagtcttactctgtctcccaggctggagtgcagtggcgcgatctcggctcattgcaacctccacctcccgggttcaaccgattctcctgcctcagcctcctgagtagctgggattacaggtacccgccaccatgtccacctaatttttttgtatttttagtagagacagggtttcaccacattggccaggctggtctcgaactgctgacctcaggtgatccgcccacctcagcctaccaaagtgctgggattgcaggcatgagccaccgcgcctggccagtttttgatgatttctgcagtaaacatctccatgtggagaaggagcaagctgggaccacagatgtgcaccatcacacctgcctaatttaaatttttaaaaaaaaattttttttaaagagatgcgatcttgctatgttgcccaggcgggatctgaacctactgggctcaagtcagctttttgcctcagcctcccaaggtgctgggattagaggcgtgagccaccacccccagtcttcagatgatttttgaatatttctgcagtagaaatctcctttttcagaaacagccagggggctgtgaaaaggagggaagatggacaagggaggaacagatacctgaggatgtgggacgtcctggggccatgtgggtgacagaggaaaatcagcaggcttcagccctgaacttcacctcccagagccgggtgggaggacagaaaacagggccggccgggcacggtggctcacgcctgttatcccagcacttcgggaggctgaggcaggcggatcacctgaggtcggcagttcgagaccagcctgaccaacatggtgaaacccccatctctactaaaaatacaaaaattagctgggcatggtggtcggcgcctgtcatcccagctactcgggaggctgaggcaggagaatcatttgaacccgggtggtggagcttgcagcttgcagtgacctgagatcacagcactgcactccagcctgggagacaaagccagactccgtctcaaaaaaaaaaaaaaaaaaaaaaaaaaaaaaggaaaagaaaagaggaaattctgaacccagtgcccgctccttgcagatctgcgaacagtggcaccagcctctagtctcaatgtgaggtttgactccaggacgatgaatttaagctgggactgccaagaaaacacaaccttcagcaagtgtttcttaactgacaagaagaacagagtcgtggaacccagggtgagacgaatttcccattctcaacccctgtcctttacacacccctttctgagttaaaagcaacagggccggctgggcgcggcggctcacgcctgtcatcccagcactttgggaggctgaggtgggcggatcacctgaggtcgggagttcaagaccagcctgaccaacatggtgaaaccccgtctctactacaaatacaaaattagccgggcgtgctggtgcatgcctgtagtcccagctactcaggaggctgagggcagaagaattactcgaacccgggaggtggaagttgcagtgagtcgagctcgtgccattgcactccagcctgggtgacagagcgagactctgtctcataaaatgcaataaggccgggtgtggtggctcacgcttgtcatcccagcactctgggaggccgaggcaggtggatcacctgaggtcaggagttcaagaccaggctgaccaacatggtgaaaccccatctctactaaaaatacaaaaattagtcgggcatggtggcaggcatctgtaatcccagctactcgggaggctgaggcaggagaattactgaaactcgggaggcggaggttgcggtgagccgagatggtgccattgcactccagcctgggcaacaagagcaaaactctgtctccaaaaaaaaaaaaaaataataaattcaattaaataaaagcgagagggccacagacacaaacaacacaagtgtggtatttggagaaatgtcacagccataatctcacgggaaccgggaaagtgctgttagctcatgtccacaatgtgtaccagagcctgattccctgaggcagagcctatgttaccgtattttaccccaagagaagagaaatcctggcaaatgcagttggatgtgcccctgggtctgtggtggaagcaggacggagaaaagtaaagtgtcagtcacgttgtcagtgtgtcaccgtcctggttccccaagggattaaggtcagggtttttggaacacaggagacagagacagaagagcggggagaggggagggaaggagggagaaacacagagaaaggatagaaggaggagggagaggaagagagaaatatggatgatcgatagataggtgatagatgatttattgactgataggtgataatagatgattggaagattgataatcaattctataggtagatgctacacggagggatgggtggtcttgctatgttaccccagatgacatactttttttttttttttttttttttgagatggagtttccctcttgttgcccaggctggagtacactggtgtgatcttggctcactgcaacctccacctcctgggttcaagcgattctcctatctcagcctcctgagtagctgggattacaggtgcgtgccaccacgcctggctaatttttgtatttttagtagagacggggtttcaccatgttggccaggctggtctccaactcctgacctcgtgatccaccctccttggcctcccaaagtgctggcattacaggtgtgagccaccgtgtccgacctttattttttgggatggagtctcgctctgtcgcccaggctggagtgcactggcgtgatctcagctccctgcaacctgtgcctcctgggttcaagagattctcctgcctcagcctcctgagtagctgggattacaggtgcccaccaccacacctggctaatttttgtatttttagtagagacggggtttcaccatgttggccaggctgatcttgaactcctgacctcaagtgatccacccgcctcggcctcccagagtgctggcattacaggtgtgagccactatgtccgaccctttttttggggggatggagtctctgtctgtcacccaggctggagtgcactggcgtgatctcagctcactgcaacctgtgcctcctgggttcaagagagtctcctgcctcagcctcccgagtagcagggattacaggtgcctgccaccacacctggctaatttttgtatttttagtagagacggggtttcaccatgttggccaggctggtcttgaactcctgacctcaagtgatccacccgccttggcctcccagagtgctgggattacaggtgtgagccacggcacctggcctctagtctggtactttcagcactgctagagtataagattgagttttcacctgcaagctggtattcagcgtatccactcagagccctcggaggaagcttagggggatgatttcacaaagggaggcaggtgcgtgtcgccaaatccaggtaaaaaccaataccatggccgggcatggtggctcacgcctgtaatcccagcactttgggaggccgaggcgggtggatcacctgaggtcaggagtttgagaccagcctggccaacatggtgaaaccctgtctctactacaaatacacaaattagcagggtgtggtggcgggtgtctgtaatccgagctactcgggaggctgaggcgggagaattgcttgaacctggaaggcggaggttgtagtgagccgagatcacgccactgcactccagcctgggagactgtaggagacagaaggttgtttcctaatcggctctgtctggttgcaattcttcagctcagtaacaacgaatgttcgtgcacatttcgtgaaatttgtctgcatgaaggagtcacatttgaggttcacgtgaatactagtcaaagaggatttcaacagaaactgctttatccaaattcaggtaagcaagacagctcagggatccgtttacagcactggccccaccaccccgccagcatcaaagtacatcccgttgaacttcggagtgaaaattattttgtttctacctcttcccaggaagggagggtaccgctgctcagaatttctcctgtttcatctacaatgcggatttaatgaactgtacctgggcgaggggtccgacggccccccgtgacgtccagtattttttgtacatacgaaactcaaagtaagtgttcacctcatgtgaagaattatgaggaatgcagggatgggagaaaaaatcatgctggttttctttttttcctttttctttttttaagacatggtcttgctctgttgcccaggctgcaatgcaatggtgccacctcggctcactgcaacctcgacctcctgggttcaagcaattttcctgcctcagcttcccaggtagctgggattacaggcgcccgccaccacaccaggccacatctatgtatttagagacagagtcttgctctgtcgcccaggctggagtgtagtgatgtgatctcagctccctgcaacctgcgcctccctccagggttcaagtgattctcctgcctcagcctcccaagtagctgggactacaggtgcactccaccacacctgtctaatttttgtatttttagtagagacagggtttcaccatgctggccaggctggtctccaactcctgacctcaagtgatctgcctgcctcaacctccccaaagtgctgggattacaggcgtgagccactgcacctggcctgtttttttggttgttgttttgttttgtgttttttgttttgttttgtgtttctttttgttttgccttgtgtttttgtgttcttgttttgttttgtgtttctgtgtttttcttttgtttttgtgtttttttggtttcacgtttttgtggtgttttgtgtttttgtgtttttgttttttgtgtttgtttttgttttgttttgtgttttgttttgtgtttgtttttgttttgttttgtggtttttgttttgtgttgtgtttgtttttgttttgtgtttttttgtttgtgttttggtgtttttgttttgtggttttcttttgtgtttgtttttgttttgtgtttttgtgtttttgtttcattttgttttgttttgtgtttttgtgttttgttttgttttgtgtttgtttttgttttgttttgtgtttttgtgtttttgttttgtgttttgtgtttttgtgttttgttttgttttgtgtttttgtgttttgtttttgtgttttgttttgttttgtgtttttgtgttttgttttgtgtttgtttttgttttgttttgtgtttttgtgtttttgttttgtgttttgtgttttgttttgtgtttttgtgttttgttttgttttgtgtttttgttttgttttgtgtttttgatttgtgtttttgtgttttgttttgtgtttgtttttgttttgtgttttgtgtttttatgttttgttttgtgtttgttttcgttttgttttgtgtttttgttttgtgttttgtgtttttgtgggttttttttgttttgtgtttttgttttgtgtttttgtgttttgtgtttttgtgttttgttttgtgtttgtttttgttttgttttgtgtttttgtgttttgttttgttttcctgattgctctctgagcactttctaatctttcaggagaaggagggagatccggtgtccttattacatacaagactcaggaacccatgtgggatgtcacctggataacctgtcaggattaacgtctcgcaattactttctggttaacggaaccagccgagaaattggcatccaattctttgattcacttttggacacaaagaaaataggtgagaataacacatatgattttcctattgtttataggtgaaatggaatttgccttaaaatctgtgtaactgaggccacgtgcggtgtctcacacctgtaatctcagcactttgggaggccgaggcgggccgatcacctgagatcgggtgttcaaaaccagcctgaccaacatggggaaaccccatctctactaaaaatacaaaaattagccgggcatggtggcgcgtgcctgtaatcccagctactcggaaggctgaggagaatcactcaaacctaggaggcggacgttgcaatgaggtgagattgtgccactgcactccagcttgagcgacagagcaagactctgtctcaaaaacaaacaaacaaaaatctgtgtaactttggtgctgtaacaaattagaactgagctgatttaactttcctttttttgagatagagtctcgctctgtcacccaggctggagtgcagtggtgcaatctcagctcactgcaacctctgcctcccaggttcaagcgattcttctgtcttagtctccttagtagcttggattacaggtgcacaccaccacgctcggctaatttttgtatttttagtagaggcagtgtttcaccatcttggccgggctagtctcgaactcctgacctcagatgatccacctgcctcagcctcccaaagtgctgggattacaggcgtcagccactgcacctgacctccctctttacctccttccttctttccttcctccctgcctttctgcctttcttcttttttcttccttccttccttccttccctccctccctcctttccttccttccttcctccttccctcccttcttccttccctccctccctctctccctcccttcttcattccttccttcttcctctccttccttctccttcactcatttcctccttccttcctctttttcttcatttcttcctcaccagcacctcttcgtgtcccagtgccctgctcctggctggcctcttggagccagtcccatatgcccacacgctctcctcttcccaagcccaccgcatcccacccgtggactccttcatcccgttggacgttcccagcctcttcaggcttaggactctcacagaagtgtgactcctgcccaccaagcccatccccacctcccaccctggaacccctgccccagtgggtatctctcctgtacatggtagctgccccacctccacttggacccagtgtagacaggaggagaccctgtaccacctccacctggacccagtgtagacaaagaggtgtccctactccacgtccacctggatccagtgtagacaggaggagactgcaccacctccacctggacccagtgtagtcaaagagatgtccctactccacgtccacctggacccagtgtagacaggaggagaccctgtaccacctccactttacccagtgtagacagaaggagaccctgcaccacctccacctggacccagtgtagacaaagaggtgtccctactccacatttacctggacacagtgtagacaggaggagactgcaccacctccacttggacccagtgtagacaggagaccctgcaccacctccacctggacccagtgtagacaaagaggtgtccctactccacgtccacctggacccagtgtagacaggaggagactgcaccacctccacctggacccagtgtagacaaagaggtgtccctactccacatttacgtggacacagtgtagacaggaggagaccctgccccacctctacctggacccagtgtgaaggcgaccagcccttccacacatgtgggtatttctcgtcaggtgggacgagagactgagaaaagaaataagacacagagacaaagtatagagaaagaacagtgagcccaggggaccggcgctcagcatacggaggacctgcaccggtctctgagttctctcagtatttattgcttactattttcactatcttggcaaggggaatgtggcaggaggacagggtgatagtggggagaaggtcagcaggaagacatatgagcaaaggaatctgtgtcacaaataagttcaagggaagctactatgcctggatgcacacgcaggccagatttatgcttctctccacacaaacatcagtgtagcaaagagtcacagagcagtattgccaccagcatatctcgcctccagccacagggcggttttctcctgtctcagaatagaacgaatgtacgatcgggttttacacggagacattccattcccaggggcaggcaggagacggagggcttcctcttatctcaaccgcgagaggacttcctcctcggcacagaccctttatggatgtcgggctgggggacggtcaggtctttttcccttcccacgaggccatatctcagactgtctcagtggggggaaccctcagacaatacccgggctctctcgggcagaggtccctgcggctttccgcagtgcatggtgtccctggttaatagagaatggagaatggcgatgacttttaccaagcatgctgcctgcaaacctattgttaacaagacacagcacatgtttctgtgagcacagtgttggggctacagttacagcttaacagcatctcaaggcaaaacagtggttcaacatacagatcacaatggagtttcttaccttcctttctacatagacacagtaacagtctgatctttctttttgtttgtttgtttgtttttctgagacagagtctcactctgtcgcccacccaggctggagggcagtggcgggatctcggctcactgcaacctccgcctcccgggttcacgccattctcctgcctcagcctcccgagtagctgggactacaggcacccgccaccacgcccggctaatttttttggatttttagtagagacggggtttcaccgtgttagccaggatggtctcgacctcctgacctcgtgatcctcccgcctcggcctcccaaagtgctgggattacaggcgtgagccaccgcgcccagccccctgatctctctttcttttccctacacagagtagacaaagaggtgtccctactccacatttacctggacccagtgtagacaggaggagaccctgccccacctccacctggacccagcgtagacaaagaggtgtttctactccatatctacctggacccagtgtagatgggaggagaccctgccccatctccacctggacccagtgtagacaaagaggtgtccctagtccacatccacctggaccgagtgtagacaggaggagaccctgccccacctccacctggacccagtgtagacaggagaagactctgcaccacctccacctggacccagtgtagacaggaggagaccctgccccacctccacctggacccagtgtagacaggagaagactctgccccatctccacctggacccagcgtagacaaagaggtgtttctactccatatctacctggacccagtgtagatgggaggagaccctgccccacctccacctggacccagtgtagacaggagaagactgcaccacctccacctggaccgagtgtagacaggaggagaccctgccccacctctacctggacccagtgtagacaggaggagaccctgccccatctccacctggacccagtgtagtcaaagaggtgtccctactccacctccacctggacccagtgtagacaggacctactccacctccacctggacccagtgtagacaggaggagactctgcaccacctccacctggacccagtgtagacaggacctctcgggttcaggggtgtgtcctgcgccctcgttacagaacgattcaaccctcccagcaatgtcaccgtacgttgcaacacgacgcactgcctcgtacggtggaaacagcccaggacctatcagaagctgtcgtacctggactttcagtaccagctggacgtccacagaaaggtcggtgagagctccccggggctgggcaccaggagggaggcgtacgggacacgcccgcacaggagcctgggaatcccggggaagtggcctgggggaaggatgcgtgggtggtgagcggtgactctggggtgaacgcacttcgggtagcggaggaagaggtgaagggtctgtggcctgtggagccaccttgaaagaggttgcagggagggtggacaaggatgatcctgcaaccatggaaccaggaagtggaccgggaggtgtgggggacgatgccacaagcaaggagagcctctgctccacctccagctggacgcagtgtagacagaaggagaccctgccccatgtctacctggacccagtgtagataggaggacacccgaccccacctccacctacacccagtgtagacaggaggagaccctgctccacctccatggagacccagtgtagacaggaggagttcttgtcccacaactacctggacccagtgtagacagggagagagactgcctcacgtccacctcgatccagtgtagacaagaggagatcttgtctcacaacctcctggacccagtgtagacaagaagagaccctgccccatgtccacctcgagccagtgtagacaagaggagatcttgtcccacaaccacctggacccagtgtagacaagaaggagagcctgctccatgtctacctggacgacaggagaacaccctgccccaaggccagtgggacctttctggatgggttacaggaagatatctggccaggaagacttctgtgtttgcagctcctcatcctacctgtcttgtagattcggggtttgtggagggagacctgcctgccactccgcagggactccttcccattcggtgcccacaccaggggagacactgtgtgaaccatctacagtgttttagaaatggaaacagtgagccttgtgttgtgttttgttttgtttctagaatacccagcctggcacggaaaacctactggtaagtgaaaccacagaccctactgacaaccctcagcgtaaccctacggtcccctactcaccacacctagtgtaactctacagtcccctactcatgacccctacagtcccctaccgacgacctccagcgtaaccctacggtcccctactcaccacacctagtgtaactctacagtcccctactcatgacccctacagtcccctactgacgacctccagcgtaaccctacagtcccctactcaccacacctagtgtaaggaggaggagaccctgccccacctccacagagacccagtatagacaggaggagctcttgtcccacaaccacctggaccccgtgtagacaggaagagaccctgccccacgtccacctagcttaatcctacagtcccctactcaccacacctaatgtaactctacagtcccctactcatgacccctacagtcccctaccgatgacctccagcgtaaccctacagtcccctactcaccacatctagtgtaactctacagtcccctactcacgacccccggagtaatcctacagtctcctactcacgacgcctacagttccctattcatgacccctagcgtaaccatacagtcccctacccatgagccctggcataaccctacaatcccctactcaccacacctagcataaacctacagtcccctacccatgacccctggagtaaccctacagtcccctagtcactacacctagtgtaactaaccatacagttccctatccatgacctctggcggaaccctacactcccctactcacaacccctagtgtaaccctacagtctcctacccatgacccctggcggaactgtacagtcccctactcacgacccctacactctcctacccatgacccctggcggaaccctacagtcccctactcacgacccgtacagtctcctacccatgacccctggcagaaccctacagtcccctactcacgacccctacactctcctacccatgacccctggcagaaccgtacagtcccctactcacgacccctacagtctcctacccatgacccctggcggaactgtacagtcccctactcacgacccctacagtctcctacccatgacccctggcggaactgtacagtcccctactcacgacccctacactctcctacccatgacccctggcggaaccctacagtcccctactcacgacccctacagtctcctacccatgacccctggaggaaccctacagtcccctactcacgacccctacagtctcctacccatgacccctggcggaactgtacagtcccctactcacgacccctacagtctcctacccatgacccctggcggaaccctacagtcccctactcacgacccgtacagtctcctacccatgacccctggcagaaccctacagtcccctactcacgacccctacactctcctacccatgacccctggcggaaccgtacagtcccctactcacgacccctacagtctcctacccatgacccctggcggaaccgtacagtcccctactcacgacccctacactctcctacccaagacccctggcggaaccctacagtcccctactcacgacccctacactttcctacccatgacccctggcggaaccctacagtcccctactcacgacccctacactctcctacccatgacccctggcggaaccctacagtcccctactcacgacccctacagtctcctacacatgacccctggcggaaccctacagtcccctactcacgacccctacagtctcctacccatgacccctggaggaaccctacagtcccctactcacgacccctacagtctcctacccatgacccctggcggaactgtacagtcccctactcacgacccctacagtctcctacccatgacccctggcggaaccctacagtcccctactcacgacccgtacagtctcctacccatgacccctggcagaaccctacagtcccctactcacgacccctacactctcctacccataacccctggcggaaccgtacagtcccctactcacgacccctacagtctcctacccatgacccctggcggaaccctacagtcccctactcacgacccctacagtctcctacccatgacccctggaggaaccctacagtcccctactcacgacccctacagtctcctactcatgacccctggagtaaccctacagtcccctactcacgacccctacagtctcctactcatgacccctggagtaaccctacagtcccctattcaggagccgtagtgtgaccctacaatcccctactcacaacccccggtggaaccctacagtcccctacccatgacccctggtggaaccctacagtcccctactcacgacccctacactctcctacccatgacccctggcggaaccctacagtcccctactcacgacccctacagtctcctacccatgacccctggcagaaccctacagtcccctactcacgacccctacactctcctacccatgacccctggcagaaccctacagtcccctactcacgacccctacagtctcctactcatgacccctggagtaaccctacagtcccctattcaggagccgtagtgtgaccctacaatcccctactcacaacccccggtggaaccctacagtcccctacccatgacctctggtggaaccctacagtcccctactcacgacccctacactctcctacccatgacccctggtggaaccctacagtcccctactcacgacccctacactctcctacccatgacctctggtggaaccctacagtcccctactcacgacccctacactctcctacccatgacccctggcggaaccctacagtcccctactcacgacccctacagtctcctacccatgacccctggcagaaccctacagtcccctactcacgacccctacactctcctacccatgacccctggcagaaccctacagtcccctactcacgacccctacagtctcctactcatgacccctggagtaaccctacagtcccctattcaggagccgtagtgtgaccctacaatcccctactcacaacccccggtggaaccctacagtcccctacccatgacctctggtggaaccctacagtcccctactcacgacccctacactctcctacccatgacccctggtggaaccctacagtcccctactcacgacccctacactctcctacccatgacctctggtggaaccctacagtcccctactcacgacccctagtgtaaccccacatgacccccagtgtaaccctatagtcccctacccacgacctatgtctgcctagacccagtgtgatcaggaggagaccccacctcacctccccctagacccagtgtagacaagaaggagagcctgccccacgtctacctggatccagtgtagacaggagaatactctgcccgacatacagttgaaccactcacaaccctagcgtcaccctacagtctccacgaaccctacagtcttggtttatgggactcttagtgccagtgtggcccaggggtggacacggtggatcctgaaccagaggatgcagatctcacacgggtgagggccccctcatagttctcactgggcagggtctgctcttggcctcaaccttcgtgtcccaatggttggaatatttatgctcagcctgttctactgattttcccattttattcctctttcctctacgtgggttaagaatatattctagtgactgtctaaggagattatgtctccctctaaaatgcttttagagtgagtactgttgccgggtatttaccaagtctcgcggccactctgaccctcggtatcctcctctgtccgatgagtatgctagacttggggatcttaatatcccttgctaaactatccgtctgaaggtctgttaatatcagttgttgatcctgaatcatttatttatgtatgtatttatttttgagacggagtctcgctctgtcccccaggctggagtgcagtggtgcgatctcggctcactgcaagctccacctcccagcgattgtcctgcctcagcctccctacagagattctacagtctcagcctgtagctgggactacaggcacccacccccacacctggccaacaatttctgtttcagaaaataaaattttagccaggcacggtggctcacgcctgtcatcccagcaccttgggaggctgaggtgggcggatcacttgaggtcagcagttcaagaccagcctgggcaacatggagaaaccccatctctactaaaaatacaaaacgtacccatgcgtggtggcgggcgcctgtaatcccagctacgtgggaggctgaggcaggagaatggcgtgaacccgggaagcggaggttgcggtgagcccagatcatgccattgcactccagcctgggcgacagagcgagagtgtctcaaataaaataaaataaaagaggccgggcgtggtggctcatgcctgtaatcccagcactttgtgaggccgaggcggtcggatcacgaggtgaggagatcgagaccatcctggccaacatggtgaaaccccgtctccactaaaaatacaacaaaaattagccgggcgtggtggtgggcacctgtagtcccaactactggggaggctgaggcaggagaatggtgtgaaccctggaggtggaggttgtagtgagccaagatcgcgccactgcactgcagcctgggtgacagagggagactccgtctcaaaaaataaataaataaaataaaataaaaaagcttaaagcctacatcacccaaattttcccaacttgtctcccatcgaaatactaacgaggcttgactctgcttagcttcgaagacccgatcagaccaagtgcattcagagtggtagaaaaaaaagaagaaaaagaaaaaaagaaaaggagaaaaaaacttaaaagacaaaagaacgaaaaaaggcaaccttttcctccacacagaagacgcctatctctaactttcttttttcctccaaagattaatgtttctggtgatttggaaaatagatacaactttccaagctctgagcccagagcaaaacacagtgtgaagatcagagctgcagacgtccgcatcttgaattggagctcctggagtgaagccattgaatttggtaagcgttgggcggaggtaagggatgtttgtgccgtctgcggccaccctgcagcaggcacagaggtcaggtgctctgtcctgggcgctgagatcgagttgagcacgtcgctgggagtagtgtcaggctctgagcttatcgctgaggctcaaaagaaggaggtggtctcgtacttggtcccgcaacattgctttgctgatgttttttcaggacggatgagttggctcccttaataaccagagaagggccaggtgcagcggttcacgcctgtaatcccagcaatttgggaggctgaggccggcggatcaccggaggtcaggagtttgagaccagcctggccaacatggtgaaaccccgtctctactaaaaatacaaaattagcccagcattgtggcaggtgcctgtaatcccagctactcgggaggctgaggcaggagaatcacttgaacccaggaggcggaggttgcactgagctgggatcacgccattgcactccagcctgggtgacagcgtgagactccgtctcaaaaaaaaaaagaaaaaaaaatacaaaaactaaccaggattggtggcacattcctgtaatcccagctactcaggaggctgagggcaggagaatgacttgaacccgggaggtggaggttgcagtgagctggggtcacgccattgcactccagcctgggtgacagagtgagactctgtctcaaaaaaaaaaaaaaaaaaaaaaagaaaaagtagaaggaggtggtctcatactcatacggggtcatgcaacattgctttgctggtgtttttttcagggtggatgagctagaatcccttaatagccagagaaggaccccactgatagccctcctaaagtcccacctccctctgctccactgggaaacaatcagtcagtctttgtccggtcaaaccgtcaccattccggctccctggccaaggggaagctctctccctctttttttcttttttttttttttttttttgagacggcgtttcgctcttgtcgcaggctggagtccagtggcgcaatctcggctcactgcaagctccacctcctgggttcacgccattctcctgcctcagcctccccagtagctgggactacaggtgcccatcaccacgcctggctaattttttgtatttttttttttttagtagagacagggtttcactgttttttagccaggatggtctcgatctcctgacctcgtgatccgcccacctcggcctcccaaagtgctgggattacaggcgtgagccaccgtgcccggccctccctcttttttttttttttttttttttagatggcgtttcgctcttgttgcccaggctggagtgcagtggtgccatctcggctcaccgcgatctccgcctcccaggttcaagcaattctccagcctcagtctcccgagtagctgggattacaggcgcccgccaccacacccggctaattttgtatttttagtagagacggggtttcaccatgttggtcaggctgttcttgaactcctgacctcaggtgatctgcccacctcgccctcccaaagtgctgcaatgacaggcgtgagccaccctgcccgtccggggaagctctcttcaaagccaggtctcggctgcccaggagacaggtctatgcttttctctgaagatgattttgagggctccaaattgaaaaggggaaggggcaggatattgagaagtatgcggttttcacctcaacaaagggtacagaagaaaaattgtgagctgcagtgcagtggtgcacctctacctcccagatcacacagacaaaatggggtacagggatgatcagaggtgcattcgtgtctggtgggccggggtgactgcacctgtaagaaattttttttgtttatttattttttgttatttgagacggactctcgctctgtcacccaggctggagtgcaatggcacgatctcagctcactacaacctctgcctcctgggttcaagcgattctcctgcctcagcctcccgagtagctgggattacattagacatgcatcacgcttggccaatttttgtatttttctttttatttatttatttatttattttgagatggagtttcgctgtgtcacccaggctggagttcaatggcacgatcttggctcactgcaacctccgtctcccaggctcaagcgattctcctgcctcagcctcctgagtagctacgattacagacatgcatcatgcttggccattttttaaatatttttatttatttatttattttgagacagggtctcactctgtcacccaggctggagtgcaatggcacgatctcggctcactgcaacctccgcctcccgggttcaagcgattctcctgcctcagcctcccgagtagctgggattacagacatgcatcacgcttggccaatttttgtatttttatttttatttatttatttatttattttgagatggagtttcgctgtgtcacccaggctggagtgcaatggcacgatcttggctcactgcaacctccgtctcccaggctcaagcgattctcctgcctcagcctcctgagtagctgggattacagacatgcatcatgcttggccattttttaaatatttttatttatttatttattttgacacagggtctcactctgtcacccaggctggagtgcaatggcacaatctcggctcactgcaacctccgtctcccaggctcaagcgattctcctgcctcagactcccaggtagataggattacaggcacccaccaccatgcctggctaattttgtattttttttttagcagagatgaggtttcaccatgttagtgaggcttgtctcgaactcctgacctcagatgatgcgcccgcctcggcctcccaaagtgctgggatgacaggtgtgagccaccgtgcctggcccaatttttgtatttttggtagagacggggtttcaccatgttggtcaggctggtctcgaactcccaacctcaggtgatcctcccgtgtcggcctcccaaagtgctgggatgacaggcgtgagccaccgcatccggcccatggtggcaaagttttaacagctcaccagaaatttccttgtgggcaaaacatagggcaggcaggttgctttcatctcagagccatcttagttaagaaccaaaaacagggaggcaggtttgctgggcccagttctcagcttgactgttccctttggctaaatgcatttggacacccgaagagatttaatttcctttcacatgtccgtcaacgattcaccgcagacgcaaacctgtgtgtctctccaggttctgacgacgggaacctcggctctgtgtacatttatgtgctcctaatcgtgggaacccttgtctgtggcatcgtcctcggcttcctctttaaaaggtaacctgtgaaacacctgggcctccccaatgaaaacaggccaggccgggaggaaagcgctttgtccagtctctgtctctgtctctgagaaagagaaacacagccttggccgggcgtgttggctcatgcctgtaatcccagcactctgggaggccgaggcgggtggatcacgaggtcaggagatcgagaccatcctggctaacacagtgaaaccccgtctctactaaaaaattagcccggcgtggtcgcgggcgcctgtagtcccagctactcgggaggctgaggcaggagaatcgcttgaacccgggaggtggaggttgcagtgagccgagattgcaccactgcactccagcctgggcgacagggcgagactccatctcaaaacaaacaaaagaacggagaaaacgggagatcctacaggaatacacagtgatgctcacagggaatctttctagaatcttccctcagcccctcgggcacagggatgggaatggaacaggcagtcagctgtgggcagcttcagggagtctgaagtcactgctgttgaagggctgagctccagaggggaaacgcctgccttgatcccactagccttgaagagcgtggtttctgggttggaggtgggtttttttttgtttgtttgtttttttgttttttgttttgagacagacttttgctcttgttgcccaggctggagtgcagtgttgcaatctcggctcactgcaacctccacctcccgggttcacgccattctcctgcctcagcctcccgagtagctgggattacaggcatgcaccacgatgctcacctaatttttgtatttttagtagagatggggtttcaccacgttggccaggctggtctctaactcttgacctcaggtgatccacccgccttcgcctcccaaagtgctgggattacaggtgtgagccaccatgcctggcctagttccttaagatgtttgtcatttggtgatttttttttgtttttttgagatggagtctcactctgtcacccaggctggagtgcagtggtgcaatctcggctcactgcaacctccacctcccaggttcaagcaattctcctgcctcagcctcctgaatagctgggattacaggcaagcaccacgatactcagctaatttttgtatttttagtagagacggggtttcaccacgttggccaggctggtctcaaacctcaagtgatccacccgcctcggcctcccaaagtgctgggattacaggtgtgagccactgcacccggcctagttccttaagattttcgtcacttggtgattcttagtgaagttttgcatagttgagcgcagacaccccgcacgcagcatccctcggcacagggcgttgatggaaggaactctggtgacccggggttcattctcttcacactttttctctgtgtctcaggttccttaggatacagcggctgttcccgccagttccacagatcaaagacaaactgaatgataaccatgaggtggaagacgaggtaggcaggggtgggcggagcagtgacctgggatggaaggtggggagtggggagcgtgggacacggcctctgggtgtcgaccatcttgcttctccaccagatgggaccgcagcgtcaccaccggtgtggctggaatctgtatcccactcctgggccttctcccgggtcggggtcttctccaaggttggggtcagagtcatctctgtgagctccatcaggagaaactgaggcagggtggtggtcaagaaaaggaggagaagacggtagagagggccaggcacggtggctcatgcctgtcatcccagcactttgggaggttgaggcatgtggatcatctgaggtcagaggttcgagaccagcctggccaacgtggtgaaaccccatctctgctaaaaatacaaaaaattagctgggtgtggtggtgtacgcctgaaatcccagtgactcgggaggctggggcagtagaacggcttgaacccagggggcggaggttgcagtgagccgagatcgcaccactgcactccagcctgggtgacagagcgagactccatctcaaaagaaaaaagaaggtagagaggagaggcagaaatagagacaagagacagaggcagagaaagatggagggagagagatggaggagagagagaggaatgtagaagagaatgaggagacacaaaagagagggaaacaggcagacagactgacagaaacaaaggcagacacacagacagagaaacagagagagggagggagaaaagggagaaggaaagagagagacacgagacacagatggagaaacagagacagataaacaacaaacataaagacccaggcgggggccggtcgcggtgactcacatctgtcatcccagcactttgggaggccgaggcgggtggatcacttgaggtcgggagttcgagaccagcctgaccaacctgaagaaacctcgtctctactaaaattgcaaaaattagccaggtgtggtggcgcacacctgtaatcccacctactctggaggctgaggcaggagaatcacttgaacccaggaggcggaggctgcagtgagccgagatcgcaccattgcactctaacctgggcaacagagcaaaactctctatcaaaaacaaaacaaaacaaaaaaatcatccccagcagggagaggagagagacagagaggaacagaggcacagagaggggagagagacaaagacagagagacacagagaaagacacagaaaaagagagagagagggagaaggagacatagagacagggacaaagagaaaaagacggacagagagagaaacagagagacataggtggacacagagaggggagagagagagagagacagaaagagacagagagcaagggatgggagtggaagagagagacagatggaggaaaaagacagagagggaggcagataaaagacacacagagacaccgagagagacagggaagacagaggagtcggacttagtctcagcgagagcccagagagggtgaacaagggcgaggaaccatgtgacctgcaccctgagaccccattggcgctcctctcccacccacctctctccggctcagggactgcgtcttatgttgcagtaggctggcaggctggaaagtcaggccagggctgatgctgcatcccagaggcagaactgtcctgcattctcagagtgggagatgaaatttttaaaaaggaaataaaactcttgtcggggaacctcagcttttatcctttagacgtttgactgattagaccaggcccactcttctcctttacactttcggctgattgaatgaggcccacccttccccctttacaccttcgactgattagatgaggcccaccattcccctttagaccttcgactgatcagatgaagcccacccttcccctttagaccttcagcttattagataaggcccacccttaccctttagactttcaactgattaaatgaggcccactctccccgtttagacctttgactgattagatgaagcccacgcttctcctttggaccttcaactgattagatgaggcccacccttcccccttcagcctttcgactgattagatgaggcccaccctcccctttataccttcgactgattagatgaggcccaccctcccctttataccttcgactgattagatgaggcccaccctcccctttataccttcgactgattagatgaggcccgtccttcccccatttagatcttcaactgattagatgaggcccacctttccctttttagacctttgactgattagatgaggcctacccttctccctttagacctttgactgattagatgaggcctacccttctccctttagacctttgactgattagatgagacccacccttcccatttagaccttcaactcattagatgaagcccacccttccccccttcccctttagaccttcagcttattaattagacaaggcccaccccctttagaccttcaactgattagatgaggcccacccctcttcagaccttcaactgattagatgaggcccaccccctttagacctttgactgattagataaggcccacccacattctccagtccaatctcttttcctggaaatcagctgattgtggacttgacatctacaaagccccttcgtagcagccgctgagtcatggtttcattcaataactggggactgtagcctagtcacggggacacgtcattggtgccgggtatcagagacgaaggccaagagatgaaagagaaacagagactgaacccaaaagaggcagacacacaggaagatggagatagagacccagagatgggggtggaagaaggtgagagggggaggaaagagagacagagagggagacagagaaaagaggcagagagaccgagagagaggctgaacagcaagaccccagagagggtgactaagggtgagagacttgcgtgacccacatcccaagaccccgtgggtggccctctcccacccacctctctccagctcaggggctgtgtcttcctcccatggggaactccagttgcagcccagggttgcccccagcgccctcttctctgccacataggtaacatcctcctggttgccacttgcacacccccatcctagacctggccatctgtcattccattaccttccacccccacgccagcctcctccccggcccccgctttccactgacccccaggggtcccccacatcgaggtgccaggatgacggcttcaggcttcaaccttcccttctctgagctccatcagctccaggggcttagcacctgctgtaccctgcccaggtttcatgctcacaagctcttccaaagaccaccctgttcatcgtcaactatgaggtcccatgggtggatctgtctcagatctttaccccaggaaaaacccatggccaggtgcagtggctcatgcctgtcatcccagcactttgggaggccgaggcgagtggatcacctcgaggtcaggagtttgagaccagcctggccaacatggtaaaaccccatctccactgaaagtacaaaatttagctggtggcggctaaagggggaaaggtgggcctcatctaatcagtcgaaggtctaaagggggaagagtgggcctcatctgatcagtcaaatttgtggtggcgggcgcctgtaatcccagctactcaggaggctgaggcaggagaatcgcttgaacccgggaggccgaggttgcagtgagctgagatgacaccactgcactccagcctgggcaatagaatgagactccgtctcgagggagaaaaagaaaataaacacagcccactgagtcccaggctgagctcgtgaagatctgacagcctgaaccctcctttttctcagatcatctgggaggaattcaccccagaggaagggaaaggctaccgcgaagaggtcttgaccgtgaaggaaattacctgagacccagagggtgtaggaatggcatggacatctccgcctccgcgacacgggggaactgttttcttgatgatgctgtgaacctttatatcattttctatgtttttatttaaaaacatgacatttggggccaggcgcggtggctcacgcctgtaatcccagcactttgggaggccaaggcaggcggatcacctgaggtcaggagttcaagaccagcctgcccaacatggtgaaaccccatctggactaaaaatgcagaaatttacccaggcacggcggcggacgcccatcatcccagctacttgggaggctgaggcaggagaattgcttgaacccgtgaggcggaggttgtagtgagccaagatcgcaccattgcacaccaacctgcgtgacagagcaagattgcatctcaaaacaaacaataataataaataataaaaacctgatatttggctgggcgccgtggctcatgcctgtaatcctaacactttggaggattgctggagacaggagtttaagaccagtctgggcaacatagcaagaccctgtctctacaaaaaaggcaaaaattagctgggcgtggtggcttgtgcctgtagtgccagctatctgggaggctgaggcgggaggatcacttgagttcaagctgacagtaagctatgattgcaccgttgcactccagcctgggtaacaaactaagaccccatctctctgtctcaaaaaaagtgatacttcgcaaagatgcttagactccaagaagcttttgcatctctttccaacccaactactgaggtactgtgtagcctcctccttgaataactaacctggtgagctgagattgcgccattgcaatccagcctgggcaacaagagcaaaactccatcacatttaaaaaaaaaaaaaaa

SEQ ID NO: 2846 - DNA, 25577 bp, human
gaagcgggagtctccgagagaagaaaagcaggtggaaggagaggaagcggatgccgtgggggtaagctaagttctttccttctgtggtctttgagcatgtcgagtcacccgggtacatgtttctgctgtgtctgtcgatagaaaagaaagagactgaactggaacataagatttcaaacgttggctcgagccgaagtggggacagcggcccagaagactgagagccaaggaaccttgcatatgagttgtcttctgcctttgttatatgcaggtttttaaaggcaaaattaaaaaaataaaataaaataaaaagagggaggtgttgttggaggacagggagggggcttctgtgaagctgtttgctgggaattctcgttggtttacagaaaaaaacaattgattaatgattggctgtacattgctaagctacagggcgttggggtgtagtatctagcacggaattatcacgtgaattcacagctatctgtggcatccggaagccgtttcgagagatgaacgcggccgggcgtggtggctcacgcctgtaatcccagcactttgggagactgaggcgggtggatcacctgaggtcgacagttcgagaccatcctggccaacatggagaaaccccgtctctactaaaaatacaaaattagccgggcatggtggtggcaggcacctgtaatcccacctactcaggaggctgaggcaggagaatcgtttgaacccgggaggcggagcttgcagtgagctgagattgcaccactgcactccagcctgggcaacaagacgagattctgtctcaaaaaaaagaaaaagaaaaaaaaagagatgaaaagagatgaacgcagagctgaaagggggagggagtgtgatggtgttactagttactagaaaggggtcctgatccagacttcaagaacgggttctgggatcttgcccaagaaagaactggaggcaagttcacattgcaaactgaaagcaagcttattaagatagtaaaggggggccgggcacggtggctcatgcctgtaatcccaacacttttggaggctgaggcgggcggatcacctgagctcaggagttcgagatcagcttggccaacatggcaaaaccacacctttattaaaaatagaaaaaattagctaggtgtggcagtgtgtgcctgtaatcccagctacttgggaggctgaggcaggagaatcgcttgaacccgggaggcggaggttgcagtgagcccagattgcaccgttgcactccagcctgggcaacaagagcaaaactctgtccccaaaaaaagataactaaaagaaaaaagtcgtggggagagatgctccactacaagggtgactgataaaggattcatctttgtcatgactatcttttgcagtaatcaatattgtatatatacatattatatattttttattattattattttgagatcatctggctgtgtcatccaggctggagggcagtggtgcaatcacagctgactgctgtcttgaattcctgggctcaagcaatcctcccatctcggcctcccgagtagctgggtcaaaggcaaatgccaccattcctggcaaatatttgtatttttgtagggacgagggtttcactgtgtttcccgggctggtcttgaactcctagactcaatctatcttcctgccccagcctcccaaagtggtgggatgacaggtgtgggccaccgcgcctggcccaatattatcatttttaaagcaaaacggattctcacactatgaaagcttttgttctgaagatatcaacacatcaggaggtttctgtgtctgttcagtcctcggtctgtttagtaaacagtattgatctgttcacatatcttgcgtcaggaatggctgacctccagggaatgctgcccagcctgtcccagcctccctgttcccagcccctattctagatggagtccctctaagctgggcgtggtgtaatcccaggactttgggaggctgaggtgggcggatcacctgaggtcaggagttcgagaccagcctggccaacagggtgaaaccccatctctactaaaaatacccaaaattagccggggcgtggtggcgggcgcctgtaatcccaatattttggaaggctgaggtgacagaggattgcttgaggccacagcaattccagaccagcccggggcaacatcgtaagattcccccatccctcgtgtataaaaaaaagattaaattattacaaattttaaaaaagacagaaatgaagcatcttaagttaccacccagattggggtactaagagtctggatttggacagcttgttgcgcgttttataggtgtgctaaatcacatttcactctttttgttgagacagagtctcgtgctgtcgcccaggctggagggcagtggcgcgatctctgctcaccgcaacctccgcctcctgggttcaagcaattctcctgcctcagcctcctgagtagctgggattacaggcacctgccaccacgcccggctaatttttgtattttttttttttttttttttttttggagacagcgtcttgctctgtcgcccaggctggagtgcagtggtgcaatctccgctcactgcaacctccacctcccgggttcaagcaattctcctgcattagcctcctgagtagctaggattacaggcacgtgccaccatgcccagctaatttttgaatttatttatttatttttttggagacagtatcttgctctgttgcccaggctggagtgcagtggtgcgatctcggctcactgtaacctccgcctcccgggttcaagtgattctcctgcctcagcctcctgggtagctgggattacaggtgtgtgctaccatgcccggctaatttttgtatttttagtagggatggtgtttcaccatgttggccaggctggtctggaactcctgacttcaaatgatccgctcaccttgacctcccaaagggctgggattacagacatgaaccacggagcccggccggatttcactctttagatttttggtttaaactcgagaagctcttctcgagggctgaaagctcttggtcccctgtaggtttgctgtagatgacagacatgaggcagattgattaataagagaaaagacatgcactttttttttcttttttttttttgagacggagtctcgctctgtcaccgaggctggagtgcactggcatgatctcggctcactgcaacctccaccttccaggttcaactgattctcctgcctcagcctctccagtagctgggattacaggcgtgtgctaccatgcctggctaatttttctatttttagtagagacagggttgttccatattggtcaggctggtctcgaacacctgacctcaggtgatccgcctgcctcggcctcccagtgtgctaggattacaggcgtgaaccactgtacccagccagatttacacatttatagaatgtgtatacacaagattcttcagaatgaggactccaccccacaatgaggttcagaagctagtacaccacattgagactacagaaggataggggattggatcctggtacaaaaaaaaaaaggttatagggttggggggaaagaggaattctattgaggagcaatatataatttctactgcggactgaactctgatttttttctttattttattttattttattttatttttttgagacagcatctcactctgccgcccaggctggagtgcagtggtgcgatctcagctcactgcaacctccacctcctgggttcacccgattttcctgcctcagcctcccgagtagctgcgattacaggcacccgccactacgcccagctaattttctttgtatttttagtagagacggggtttcaccatgttggccaggctggtcttgaactcctgacctcaggtgatccaacctcctcggcctcccaaagtgctgggattatacgcatgagccactgcacctagcttcttctttttctttttttttttctttctttttttcttttttttttttagatggagtctaactttgtcgcccagactggagtacagtggcacaatctcagctcaccacagcctccacctcccaaggtcaagcaattctcctgcctcagcctcccaagtagctgagattacaggcacgtaccactactgcctgagtaatttttgtgtttttagtagagacaacatttcaccaggttggccaggctggtctcgaactcctgacctcaagtgatccacacgcctcagcctcccaaagtgctaggattataggcaccagccaccacaccgggcctctgactttttttatcttgcccaaattcctatctaagaggtctgaggaggcaagccctacaaaccataaattctcatcaaatgggatttattgaaccctgtatatcgtgacttactttccaacctgactctggcaaacgttacaagacagagaaaaaaaacaacatatgttgccccaaaatatgtttcttagttgtattttttttttcttttaagatggtctcattctgtttccaaggctggagtgcagtggtgcaatcttggctccctgcaacctccgtcttctaggttcaagcgattctcctgcctcctcagccttccaaatagctggcgtaatatgcatgagccatcgtgcccagataattgttttttgttttttgttttttttttagtagagatggggtttcactgtgatggccaggctggtcttgaactcctgacctcaggtgatccaaccgcctcggcctcccaaagtgctgggattataggcgtgaaccactgctcccggctggagtacaggggcataatcttggctcactgcagcctctgcttcccaggttcaagtgattctcctgcctcagtctcccgagtagctgggactacaggcgcccgccaccacgcccagctaatttttttttttttttttgtattttttttttttagtagagatggggtttcactgtgtttgccaggatggtctcgatctcctggcctcatgatctgcccgcctcggcctcccgaagtgctgggatgacaggcgtgagtcaccgcgcccggcatgaaagggtttttcattaaaaatccttgttataccgtggagccctgtgttggggtaaaatatcatgatttccctcactctccatcattcttgctttgaatctgagaaggaagcttggcggcctctattttaggatcagccgaaaatttccagaaaggggaaagaaaactcattctgtaaacacaaaaaagaagaagagaaaaaagtataagcggtacagacaaaacgcaaagatgttgcataattttccgtgagtgcaaaatgtcctgtaaaccaaaaaagaggtatctgagacaggtctcagtccatttagaaagttcattttgccgaggttaaggacgcctgcccatgacagagcctcaggaaatcgcgatgacaggtgctgtggatacacagggcacaatttgctttcatacatttttttggcggggagggagctggggatccagtcttgttctgtcacccaggctgcagtgcaatggtgcaatctcagctcactatcactgtaacctccgcctcccgtgttcaagctattctcctgccacagccttctgagtagctgggattataggcacccactaccgcgcccagctaatttttgtatttttagtagagacggggtttcaccatgttggccaggatggtctcgaactcctggcctcaaatgatccacctgcctcggcctcccaaagtgctgggattataggcgtgagccatggcgcccagccctggtatgtaatttttaaaacctttgtagtaccttatttacgaataaaatgcgaggcaggtttgcctaagacagtttccactataacctttcatgattttggggtcctgagacttatttacctttcacagtttacagcaggaaaatccgtggagacagcagatccgagaagcggcgatgtttgcgtagaaccctgtacgtgcttccttcggcctgtcggtaatgtggttggggattttcttttttttaagtgaagtctaaagaactgaaatgttttgctccataatgatgaaccaggatagaagtgagaactcagggcagaagaatctgaatgaggaactgtctgacctatgacaaatttaacatgtcacgttccctctgagacagtacacatcctcctgaagcagcgtgacaaggcacatcctcctgaagggtctccaggcagaagagacgcatgaacctgtcaaaaaaaaaaaaaaaaagagccggccgggcgcagtggctcaagcctgtaatcccagcactgtgggaggctgaggcggggggatcatgaggtcaggagttccagaccagcctggccaacatggtgaaaccccatctctgctaaaaatacaaaaattagccgggtgtagtggcagttgcctctagtcccagctactccggaggccgaggcaggagaatcgcttgaacccaggaggcgtaggttgcagtgagccaagatcgcgccactgcactccagcctgggcaacagagcgacagtccgtcccaaacactgcaaaatatttaaagagatttattctgagccaaatatgagtgagcaagaaggcccagggaaaatagtctaaagagatcctgagaacacgtatccaagctggttgagcggcagtttggttttatatgtttttgtttgtttacttattttactttattttatttatttatttatttattttgagatgaagccttgctcagtctgttaggctggagtgcagtggcgcgatctcggctcactgcaacctccgcctcccgggttcacgccattctcctgcctcagcctcccgagtagctgggactacaggcgcccaccaccatgcccagctaattttttgtatttttagtagagaaggggtttcaccgtgttagccaggatggtctcgatctcctgacttcgtgatccgcccgcctcagcctcccaaagtgttgggattacaggcacccgccaccacgcccggccaatttttgtatttttagtagcgacggggtttcaccatgttggccaggctggtctcaaacttgtgacctcacatgatctgctcacctcggcctcccaaagtgctgggattacaggcgtaagccacagcgtccagctattttattttatttgttttattttttgtgacagagtctcactctgtcgcccaggctggagtgcagtggagcgatctcagctcactgcaacctctgcctccggagctgaagcaattctcccgcctcagcctcccaagtagctggcattacagaggtacgccaccacgcctggctaaattttgtttgtttgtttgtttgtttgtttgtttgtttttgtttttcagtagacacagggtttcactatgttggccaggctggtctcgaactcctgacctcacatgatctgcctgcctcagcctccagaagtactgggattacagccgtgagccacctcacccagccagcagcttggttttatgtttgtttatatatttatttatttatttatttttaatttttggagacggagtcttgctctgttgcctgggctggagtgcagtggcatgatcttggctcacggcaacctctgcctttcgagttccagtgattctcctgcctcagcctcgcgagtagctgggagtacaggcgcccgccatcacacccggctagtatttgtatttttagtagagagagggtttcaccgtattgtccaggctggtcttgaactcctgtcctcaagtgatccacccacctgagcctctcaaagtgctgggattgcaggcgtgagcctctgtggccagccaacagacagttttgcaggaccatttcaaaatatgtcaagtaaatatattttggggtgaaatgtattttaaagtggcatatactgatttcccacagtcttgtctggggaggcatatcctggcctcctagaaagcatacacagtagcagacaggtgtggtggctcacgcctgcaatcccagccctttgggaggccgaggcaggtggatcacaaggtcaggagatcgagaccatcctggccaacatggtgaaatgctatctctactaaaaatacaaaaattagctgggcgtggtggtgcatgcctgtaatcccagctactcgagaggctgaggcaggaggaccacttgaacctggcaggtggaggttgcagtgagctgagatcacgccactgcactccagcctgggagacagagcgaggctccgtctctaaataaataaataaagcttacgcagtagctgagaagacagggaaaagaggtgaagaaatgacagaaagcttagaagtcgctcattataaccccttcctaccccatctcatgcttcccttaaagcataaacgaagggtgcttgtgttacaggaaaggggttcggatccagcccccaagagggggttcttggatctcacgcaagaaagaattcagggcggccgggcgctgtggctcacacctgtaatcccagcaccttgggaggcagaggcgggcggatcacgaggtcaggagttcgagaccagcctgaccaacatggtgaaaccccatctctactaaaaatacaaaaattagccaggtgtggtggtgcgtgcctgtagtcccagctactcgggagacagaggcaagagaatggcgtgaacccgggaggcgatgcttgcagtgagtggagatcatgccactacactccagcctgggcgatagagtaagtccatctcaaaaaaaaaaaaaaaaaaaaaaaattcggggtgagtcagcagtgcaaagccaaagcaaatttattacaaaagtaaaacagtgaaagaatagctactccagaggccgggcgcagtggctcatgcctgtaatcccagcactttgggaggtggaggtgggcagatcacctgaggtcaggagttcgagaccagcctgaccaacatggtgaaaccccatctctactaaaaatacaaaaattagccaggcatggtggtgcgtgcctgtagtcccagctactcgggaggctgaggcagtagaattgcttcaacttgggagacggaggttgcagtgagccgagatggcaccactgcactccagcctgggcaacagaatgagactcagtctcaaaaaaaaaaaaaaaaatttcagggcgagcaagtttattatgaaagtaaaatagtgaaagactaggtactccagaggccaggcgcagtggctcatgcctataatcccagcactttgggagcccgaggcaggtggatcacctgaggtcaggagttcgagaccagcctcgccaacatggtgaaaccccatctctactaaaaatacaaaaattagccaggcatggtggtgcgtgcctgtagtcccagctacttggaggctgaggcagtagaattgcttcaacttgggagacggaggttgcagtgagccaagatggcaccactgcactccagcctgggcgacagaatgagactcagtctcaaaaaaacaaaagatttcagggcgagcaagtttattatgaaagtaaagtagtggaagactagctactccagaggccaggtgcagtggctcatgcctataatcccagcactttgggagcccgaggcaggtggatcacctgaggtcaggatttcgagaccagcctcgccaacatggtgaaaccccatctctactaaaaatacaaaaattagccaggcgtgttggtgcgtgcctgtagtcccagctactcggaggctgaggcagtagaattgcttcaacttgggagacggaggttgcagtgagccgagatggcaccactgcactccagcctgggtgacagaatgagactcagtctaaaaaaaaaaaaaattcagggcaagcaagtttattatgaaagtaaaatagtgaaagactaggtaatccagaggctgggtgcagtggctcatgcctataatcccagcactttgggagcccaaggcatgtggatcacctgaggtcagaagttcgagaccagcctggccaacatggtgaaaccccatctctactaaaaatacaaaaattagccaggcgtgttggtgcgtgcctgtagtcccagctactcggaggctgaggcagtagaatcacttgaacctaggagacagaggttgcagtgagccgagatggcgccactgtactccagcctgggcgacagagtgagactccatctccaaaaaataaataaataagtcaaccaagaaggccgtacgtacagtggctcacacctgtcatcccatcactttgggaggccgaggcagggggattacttgagatcaggagtttgagaccagcctggccaacatggtgaaaccccgtctctactaaaaatacaaaaattagccaggcgtgttggtgcgtgcctgtagtcccagctactcggaggctgaggcagtagaatggcttcaacttgggagacggaggttgcagtgagccgagatggcaccactgcactccagcctgggcgacagagcaagaccgtctacaaaataataataataattaataataataataataactagtgcaagagaagtacacaaatatcccaaacatttagtgactcagcagagggggccagtctcaaggaacaggacttctacacctgttaccaccacctggggagttgtatctgaatctcaaggtcaggcccacccagacagaacatgcatctctagggtgccacaggagagtctgtccagtgcccagaaacacctgcaagacccagaagcaggctccaagaagcggggtgccacagtccagtgggggaagcggccacatccctgtcatgtgggctacagatgagttggggggcaggggcaggagaagaagaaacaggtgtggcctacatgcttttacttcctcttagcaagcgaggttcctcttgcagaggaacggtctgagagacacaaccgttttttttttttgtttgtttgcttttccttgagacagagtctccctctgtcacccaggctggagggcagtggcgcgatctcggctcactgcagcctccacctcctgggttcaagcgattctcctgcctcaacctcccgagtagctgggattacaggcacccaccaccccacccggctaatttttgtatttctagtatagatgaggtttcaccgtattagccaagctggtcccgaactcctgacctcaggcgatccgcctgccttggcctcccaaagtgctgggattacaggcgtgagccactgtgcccggccgagagacgcaatctttcagagaggaggtttggagcaggaacctcagggtggacagatgggtcccaccaggtgcagatgcttgaactaaagatgctacaaaggccgggtgcagtggttcatgcctgtaattccagcagtttgagaagctgaggcaggcagatcatctgaggtcaggagttcgagcccagcctggccaacatggcaaaacagcgtctctactaaaaatgcaaaattagcctggcataatggcgggcgcctataatcccagctacttgggaggccgaggcaggagaatcgcttgaacccgggaggcggaggttgcagtgagccaagattgcaccactgcactccagcctgggtgacaagagtgaaactccgtctcaaaaaaaaaaaaaaaaaaagaagaagaagaaaagaaatacattagtttggtccataaaggcgggacaactcaaagtgggggcttccaggctataaatgaatttaaacattttctggttgacaattggttgagtttgtagctcctcctccttctcttcttcctcctccttctccccccttcctcctcttcctcctcttcctcctcctccttcttcttctcttctttcttcttcttctctttccccttcttcttcttcttcctcctccttctcctcctcctttttcttcttcttccttatgggcttggatagaagtatattgacatggatccaccatttgtagaatcataccgagtagcttcttttctcctccttcctctccttctcctcctcctcctcctccttctcctgctccttctcctcctcctcctcctgctccttctcctcctcctcctccttctcctcctcctcctcctgcttctcctcctcctccttctcctcctcctgcttctcctcctcctccttctcctcctcctccttctcctcctcctccttctcctcctcctcattctcctcctgctccccttctcctcctccttctcctcctcctccttctcctcctgctccccttctcctcctccttctcctcctcctcctcctcctgctcctcctcctccagctccccttctcctcctactcctccttctcctccttctccttctcctccttctcctactcctccttctcctactcctccttctcctactcctccttctcctcttccttcttctcctcctcctgctccttctcctcctcttcctcctactcctccttctcttccttctcctcctcctccttctcctcctcctccttctcctcttcctccttctcctcctcctccttctcctcctcctccctctcctcctcctccgccttctcctactcctccttctcctcctccttcttctcctcctcctgctccttctcctcctcctccttctcctcctgctccttctcctcctcttcctcctactcctccttctcttccttctcctcctcctccttctcctcctcctgcacctttcctcctcctccttctttttccttttttgcataaagaagtatcaaataagagtagtttcactgccctaaacatcctctgaggtccatgtattcatccctccatctgcccaacgccaaccaactccggatctttttactgtttccatgattttgtcttttccacagtgtccaagtgttagaatgactcagtctgcagccatctcaaagtggattctttcccttagtcataagtatttaaacttcattcatgtcgttttatgtactcaccctttttttcttcctcttcttttttttttttttttcactttccttttatagctgttgcaaaagtcaagattttttaaaaaatataaaagagcagggccgggcacggtggctcacgcctgtaatcccagcactttgggaggccgaggcaggtggatcacgaggtcaggagatggagaccatcctggctaacacggtgaaagcctgtttctactaaaaaaaaaaaaaaaaaaaaaaaattagctgggtgtggtggcaggcgcctgtagtcccagctacttgggaagctgaggcaggagaatggtgtgaacctgggatgtggaggttgcagtgagccgagatcgcgccactgcactccagcctgggtgacagagcgtgactttgtctcaaaaaagaaaaaaaaagtacaaaagagcaaaacaaaacaaaagttatgaaaatgaaaacctgagccatcgtttatcttatttccccaaatccactaattattaacagaaagtaaaagctatgaaaaatgaatgaaagtgactgcaatttccttgaagtgtgttagaacctgcctttagtgtcagctatgggttccctcatgaaggtcagctgagccatgacccatgaaccatggaagcttgactctagattgaccatcttgagatgccaaagatgtccacgtcctaatcccatgtgggagacagaataatggccctgcagaccttcccagctggccatgacccctcatttgaccaggtcagcggctgaccaccatcctgggtttgtttccccaaatcacctccctggggtcccctgccaggaatgtcctgggagaggcaaccttctcactgtgtgatattttctctcctgcagctcttcccttctctctgaccagcaccatgcttctcctggtgacaagccttctgctctgtgagttaccacacccagcattcctcctgatcccagagaaatcgggtaagtatggaaacctggctgaaccttctccgcggcccctgtttagatgtcctgcatctggagacccatctggatacctgggtccatctgcatttcatctctaatgtttatgagggacccaataagcaccagccaacccaccagaagctcagagctcctcttgttctcacctccttttctgctgttaattcccatccacccattctacagatgagaaaacggaggctcagatacctccacagtttaacccaacgaccatccaggtagtgatggggccaggatgaggacccatgtctgcatggggccaaagtgttccttccttccttcgttccttcgttccttcgttccttccttccttccttccttccttccttcgttccttccttcgttccttccttccttccttccttccttccctcccttgcttccttctcttcctcctgccctccctctttccatccttccttctctccttccttccatccttctctccctcctgattcatttcttctctttctttctcttccttccttccctccttccctttctctctttcttccttccattgtttccttctttccttccttcttccgtccctcccttctttctttctctttcttccttccctccttccctctctctctttcttccttccattgtttttctttctttccttccttccctccctccctccctctctctctctctttctttctttctttctcctttttttttctccttctttgtttctttcttcctctttcttctttctttctttctttctttccttctttctttttctttcttttcagagtctccctcttgttgcccaggctggagtgcaatggctcaatctcagctcactgcaaactcagcctcccgggttcaagcgattctcctgcctcagcctcccgagtagctgggattacaggcgcctgccaccaggcccagctaatttttttgtatttttagtagagatggggttttgtcatgttggccaggctggtctcaatctcctggcctcaggtgatcccgtgcctcggcctcccaaagtgctaggattacagctatgagccgccacacccagcctcttgtttgttgacttcttaatagcagccattgtgactggcgtggaatgatagctcattgtggttttgatttgcgtttccgggagggaccctcttgactgagggtgtcagggcctctgcttcaggaaagtatttccaggtttttgtgacctggttcagggaagacagacaaagacagctttctgtttctgcaattttctcaaattccttcagctttatattaaactgccaaggttccataatttgggaagtgtgttcagagccacatcactctggataaagagcctttgcctgttctcattcaagcggttttctttctctgtctctcttttttttttttttttttttttttttgagacaggatctcgctctgtctcccaggctggagtgcagtggcgtgatctcggctcactgcagcctcagctttctgggatcaagtatcctcccactccagcctcccaagtagctgggactgcagaaatacaccaccatgccaagctaatttaaattttttttttaattttatagaggagatcttgctatgttgccaagactagtttttgatttttttttttttttgagatggagtcttactctgtcacccaggctggagtgcagtggcgcgatctcggctcactgcagcctcagctttctgggatcaagtatcctcccactccagcctcccaagtagctgggactgcagaaatacaccaccatgccaagctaatttaaatttttttttttttaaattttatagacgagatcttgctatgttgccaagactagtttttgattttttttttttttttttttttgagatggagtcttactctgtctcccaggctggagtgcagtggcgcgatctcggctcattgcaacctccacctcccgggttcaaccgattctcctgcctcagcctcctgagtagctgggattacaggtacccgccaccatgtccacctaatttttttgtatttttagtagagacagggtttcaccacattggccaggctggtctcgaactgctgacctcaggtgatccgcccacctcagcctaccaaagtgctgggattgcaggcatgagccaccgcgcctggccagtttttgatgatttctgcagtaaacatctccatgtggagaaggagcaagctgggaccacagatgtgcaccatcacacctgcctaatttaaatttttaaaaaaaaattttttttaaagagatgcgatcttgctatgttgcccaggcgggatctgaacctactgggctcaagtcagctttttgcctcagcctcccaaggtgctgggattagaggcgtgagccaccacccccagtcttcagatgatttttgaatatttctgcagtagaaatctcctttttcagaaacagccagggggctgtgaaaaggagggaagatggacaagggaggaacagatacctgaggatgtgggacgtcctggggccatgtgggtgacagaggaaaatcagcaggcttcagccctgaacttcacctcccagagccgggtgggaggacagaaaacagggccggccgggcacggtggctcacgcctgttatcccagcacttcgggaggctgaggcaggcggatcacctgaggtcggcagttcgagaccagcctgaccaacatggtgaaacccccatctctactaaaaatacaaaaattagctgggcatggtggtcggcgcctgtcatcccagctactcgggaggctgaggcaggagaatcatttgaacccgggtggtggagcttgcagcttgcagtgacctgagatcacagcactgcactccagcctgggagacaaagccagactccgtctcaaaaaaaaaaaaaaaaaaaaaaaaaaaaaaggaaaagaaaagaggaaattctgaacccagtgcccgctccttgcagatctgcgaacagtggcaccagcctctagtctcaatgtgaggtttgactccaggacgatgaatttaagctgggactgccaagaaaacacaaccttcagcaagtgtttcttaactgacaagaagaacagagtcgtggaacccagggtgagacgaatttcccattctcaacccctgtcctttacacacccctttctgagttaaaagcaacagggccggctgggcgcggcggctcacgcctgtcatcccagcactttgggaggctgaggtgggcggatcacctgaggtcgggagttcaagaccagcctgaccaacatggtgaaaccccgtctctactacaaatacaaaattagccgggcgtgctggtgcatgcctgtagtcccagctactcaggaggctgagggcagaagaattactcgaacccgggaggtggaagttgcagtgagtcgagctcgtgccattgcactccagcctgggtgacagagcgagactctgtctcataaaatgcaataaggccgggtgtggtggctcacgcttgtcatcccagcactctgggaggccgaggcaggtggatcacctgaggtcaggagttcaagaccaggctgaccaacatggtgaaaccccatctctactaaaaatacaaaaattagtcgggcatggtggcaggcatctgtaatcccagctactcgggaggctgaggcaggagaattactgaaactcgggaggcggaggttgcggtgagccgagatggtgccattgcactccagcctgggcaacaagagcaaaactctgtctccaaaaaaaaaaaaaaataataaattcaattaaataaaagcgagagggccacagacacaaacaacacaagtgtggtatttggagaaatgtcacagccataatctcacgggaaccgggaaagtgctgttagctcatgtccacaatgtgtaccagagcctgattccctgaggcagagcctatgttaccgtattttaccccaagagaagagaaatcctggcaaatgcagttggatgtgcccctgggtctgtggtggaagcaggacggagaaaagtaaagtgtcagtcacgttgtcagtgtgtcaccgtcctggttccccaagggattaaggtcagggtttttggaacacaggagacagagacagaagagcggggagaggggagggaaggagggagaaacacagagaaaggatagaaggaggagggagaggaagagagaaatatggatgatcgatagataggtgatagatgatttattgactgataggtgataatagatgattggaagattgataatcaattctataggtagatgctacacggagggatgggtggtcttgctatgttaccccagatgacatactttttttttttttttttttttttgagatggagtttccctcttgttgcccaggctggagtacactggtgtgatcttggctcactgcaacctccacctcctgggttcaagcgattctcctatctcagcctcctgagtagctgggattacaggtgcgtgccaccacgcctggctaatttttgtatttttagtagagacggggtttcaccatgttggccaggctggtctccaactcctgacctcgtgatccaccctccttggcctcccaaagtgctggcattacaggtgtgagccaccgtgtccgacctttattttttgggatggagtctcgctctgtcgcccaggctggagtgcactggcgtgatctcagctccctgcaacctgtgcctcctgggttcaagagattctcctgcctcagcctcctgagtagctgggattacaggtgcccaccaccacacctggctaatttttgtatttttagtagagacggggtttcaccatgttggccaggctgatcttgaactcctgacctcaagtgatccacccgcctcggcctcccagagtgctggcattacaggtgtgagccactatgtccgaccctttttttggggggatggagtctctgtctgtcacccaggctggagtgcactggcgtgatctcagctcactgcaacctgtgcctcctgggttcaagagagtctcctgcctcagcctcccgagtagcagggattacaggtgcctgccaccacacctggctaatttttgtatttttagtagagacggggtttcaccatgttggccaggctggtcttgaactcctgacctcaagtgatccacccgccttggcctcccagagtgctgggattacaggtgtgagccacggcacctggcctctagtctggtactttcagcactgctagagtataagattgagttttcacctgcaagctggtattcagcgtatccactcagagccctcggaggaagcttagggggatgatttcacaaagggaggcaggtgcgtgtcgccaaatccaggtaaaaaccaataccatggccgggcatggtggctcacgcctgtaatcccagcactttgggaggccgaggcgggtggatcacctgaggtcaggagtttgagaccagcctggccaacatggtgaaaccctgtctctactacaaatacacaaattagcagggtgtggtggcgggtgtctgtaatccgagctactcgggaggctgaggcgggagaattgcttgaacctggaaggcggaggttgtagtgagccgagatcacgccactgcactccagcctgggagactgtaggagacagaaggttgtttcctaatcggctctgtctggttgcaattcttcagctcagtaacaacgaatgttcgtgcacatttcgtgaaatttgtctgcatgaaggagtcacatttgaggttcacgtgaatactagtcaaagaggatttcaacagaaactgctttatccaaattcaggtaagcaagacagctcagggatccgtttacagcactggccccaccaccccgccagcatcaaagtacatcccgttgaacttcggagtgaaaattattttgtttctacctcttcccaggaagggagggtaccgctgctcagaatttctcctgtttcatctacaatgcggatttaatgaactgtacctgggcgaggggtccgacggccccccgtgacgtccagtattttttgtacatacgaaactcaaagtaagtgttcacctcatgtgaagaattatgaggaatgcagggatgggagaaaaaatcatgctggttttctttttttcctttttctttttttaagacatggtcttgctctgttgcccaggctgcaatgcaatggtgccacctcggctcactgcaacctcgacctcctgggttcaagcaattttcctgcctcagcttcccaggtagctgggattacaggcgcccgccaccacaccaggccacatctatgtatttagagacagagtcttgctctgtcgcccaggctggagtgtagtgatgtgatctcagctccctgcaacctgcgcctccctccagggttcaagtgattctcctgcctcagcctcccaagtagctgggactacaggtgcactccaccacacctgtctaatttttgtatttttagtagagacagggtttcaccatgctggccaggctggtctccaactcctgacctcaagtgatctgcctgcctcaacctccccaaagtgctgggattacaggcgtgagccactgcacctggcctgtttttttggttgttgttttgttttgtgttttttgttttgttttgtgtttctttttgttttgccttgtgtttttgtgttcttgttttgttttgtgtttctgtgtttttcttttgtttttgtgtttttttggtttcacgtttttgtggtgttttgtgtttttgtgtttttgttttttgtgtttgtttttgttttgttttgtgttttgttttgtgtttgtttttgttttgttttgtggtttttgttttgtgttgtgtttgtttttgttttgtgtttttttgtttgtgttttggtgtttttgttttgtggttttcttttgtgtttgtttttgttttgtgtttttgtgtttttgtttcattttgttttgttttgtgtttttgtgttttgttttgttttgtgtttgtttttgttttgttttgtgtttttgtgtttttgttttgtgttttgtgtttttgtgttttgttttgttttgtgtttttgtgttttgtttttgtgttttgttttgttttgtgtttttgtgttttgttttgtgtttgtttttgttttgttttgtgtttttgtgtttttgttttgtgttttgtgttttgttttgtgtttttgtgttttgttttgttttgtgtttttgttttgttttgtgtttttgatttgtgtttttgtgttttgttttgtgtttgtttttgttttgtgttttgtgtttttatgttttgttttgtgtttgttttcgttttgttttgtgtttttgttttgtgttttgtgtttttgtgggttttttttgttttgtgtttttgttttgtgtttttgtgttttgtgtttttgtgttttgttttgtgtttgtttttgttttgttttgtgtttttgtgttttgttttgttttcctgattgctctctgagcactttctaatctttcaggagaaggagggagatccggtgtccttattacatacaagactcaggaacccatgtgggatgtcacctggataacctgtcaggattaacgtctcgcaattactttctggttaacggaaccagccgagaaattggcatccaattctttgattcacttttggacacaaagaaaataggtgagaataacacatatgattttcctattgtttataggtgaaatggaatttgccttaaaatctgtgtaactgaggccacgtgcggtgtctcacacctgtaatctcagcactttgggaggccgaggcgggccgatcacctgagatcgggtgttcaaaaccagcctgaccaacatggggaaaccccatctctactaaaaatacaaaaattagccgggcatggtggcgcgtgcctgtaatcccagctactcggaaggctgaggagaatcactcaaacctaggaggcggacgttgcaatgaggtgagattgtgccactgcactccagcttgagcgacagagcaagactctgtctcaaaaacaaacaaacaaaaatctgtgtaactttggtgctgtaacaaattagaactgagctgatttaactttcctttttttgagatagagtctcgctctgtcacccaggctggagtgcagtggtgcaatctcagctcactgcaacctctgcctcccaggttcaagcgattcttctgtcttagtctccttagtagcttggattacaggtgcacaccaccacgctcggctaatttttgtatttttagtagaggcagtgtttcaccatcttggccgggctagtctcgaactcctgacctcagatgatccacctgcctcagcctcccaaagtgctgggattacaggcgtcagccactgcacctgacctccctctttacctccttccttctttccttcctccctgcctttctgcctttcttcttttttcttccttccttccttccttccctccctccctcctttccttccttccttcctccttccctcccttcttccttccctccctccctctctccctcccttcttcattccttccttcttcctctccttccttctccttcactcatttcctccttccttcctctttttcttcatttcttcctcaccagcacctcttcgtgtcccagtgccctgctcctggctggcctcttggagccagtcccatatgcccacacgctctcctcttcccaagcccaccgcatcccacccgtggactccttcatcccgttggacgttcccagcctcttcaggcttaggactctcacagaagtgtgactcctgcccaccaagcccatccccacctcccaccctggaacccctgccccagtgggtatctctcctgtacatggtagctgccccacctccacttggacccagtgtagacaggaggagaccctgtaccacctccacctggacccagtgtagacaaagaggtgtccctactccacgtccacctggatccagtgtagacaggaggagactgcaccacctccacctggacccagtgtagtcaaagagatgtccctactccacgtccacctggacccagtgtagacaggaggagaccctgtaccacctccactttacccagtgtagacagaaggagaccctgcaccacctccacctggacccagtgtagacaaagaggtgtccctactccacatttacctggacacagtgtagacaggaggagactgcaccacctccacttggacccagtgtagacaggagaccctgcaccacctccacctggacccagtgtagacaaagaggtgtccctactccacgtccacctggacccagtgtagacaggaggagactgcaccacctccacctggacccagtgtagacaaagaggtgtccctactccacatttacgtggacacagtgtagacaggaggagaccctgccccacctctacctggacccagtgtgaaggcgaccagcccttccacacatgtgggtatttctcgtcaggtgggacgagagactgagaaaagaaataagacacagagacaaagtatagagaaagaacagtgagcccaggggaccggcgctcagcatacggaggacctgcaccggtctctgagttctctcagtatttattgcttactattttcactatcttggcaaggggaatgtggcaggaggacagggtgatagtggggagaaggtcagcaggaagacatatgagcaaaggaatctgtgtcacaaataagttcaagggaagctactatgcctggatgcacacgcaggccagatttatgcttctctccacacaaacatcagtgtagcaaagagtcacagagcagtattgccaccagcatatctcgcctccagccacagggcggttttctcctgtctcagaatagaacgaatgtacgatcgggttttacacggagacattccattcccaggggcaggcaggagacggagggcttcctcttatctcaaccgcgagaggacttcctcctcggcacagaccctttatggatgtcgggctgggggacggtcaggtctttttcccttcccacgaggccatatctcagactgtctcagtggggggaaccctcagacaatacccgggctctctcgggcagaggtccctgcggctttccgcagtgcatggtgtccctggttaatagagaatggagaatggcgatgacttttaccaagcatgctgcctgcaaacctattgttaacaagacacagcacatgtttctgtgagcacagtgttggggctacagttacagcttaacagcatctcaaggcaaaacagtggttcaacatacagatcacaatggagtttcttaccttcctttctacatagacacagtaacagtctgatctttctttttgtttgtttgtttgtttttctgagacagagtctcactctgtcgcccacccaggctggagggcagtggcgggatctcggctcactgcaacctccgcctcccgggttcacgccattctcctgcctcagcctcccgagtagctgggactacaggcacccgccaccacgcccggctaatttttttggatttttagtagagacggggtttcaccgtgttagccaggatggtctcgacctcctgacctcgtgatcctcccgcctcggcctcccaaagtgctgggattacaggcgtgagccaccgcgcccagccccctgatctctctttcttttccctacacagagtagacaaagaggtgtccctactccacatttacctggacccagtgtagacaggaggagaccctgccccacctccacctggacccagcgtagacaaagaggtgtttctactccatatctacctggacccagtgtagatgggaggagaccctgccccatctccacctggacccagtgtagacaaagaggtgtccctagtccacatccacctggaccgagtgtagacaggaggagaccctgccccacctccacctggacccagtgtagacaggagaagactctgcaccacctccacctggacccagtgtagacaggaggagaccctgccccacctccacctggacccagtgtagacaggagaagactctgccccatctccacctggacccagcgtagacaaagaggtgtttctactccatatctacctggacccagtgtagatgggaggagaccctgccccacctccacctggacccagtgtagacaggagaagactgcaccacctccacctggaccgagtgtagacaggaggagaccctgccccacctctacctggacccagtgtagacaggaggagaccctgccccatctccacctggacccagtgtagtcaaagaggtgtccctactccacctccacctggacccagtgtagacaggacctactccacctccacctggacccagtgtagacaggaggagactctgcaccacctccacctggacccagtgtagacaggacctctcgggttcaggggtgtgtcctgcgccctcgttacagaacgattcaaccctcccagcaatgtcaccgtacgttgcaacacgacgcactgcctcgtacggtggaaa

SEQ ID NO: 2847 - DNA, 41135 bp, human
tctgaagggagctactcagaagcgggagtctccgagagaagaaaagcaggtggaaggagaggaagcggatgccgtgggggtaagctaagttctttccttctgtggtctttgagcatgtcgagtcacccgggtacatgtttctgctgtgtctgtcgatagaaaagaaagagactgaactggaacataagatttcaaacgttggctcgagccgaagtggggacagcggcccagaagactgagagccaaggaaccttgcatatgagttgtcttctgcctttgttatatgcaggtttttaaaggcaaaattaaaaaaataaaataaaataaaaagagggaggtgttgttggaggacagggagggggcttctgtgaagctgtttgctgggaattctcgttggtttacagaaaaaaacaattgattaatgattggctgtacattgctaagctacagggcgttggggtgtagtatctagcacggaattatcacgtgaattcacagctatctgtggcatccggaagccgtttcgagagatgaacgcggccgggcgtggtggctcacgcctgtaatcccagcactttgggagactgaggcgggtggatcacctgaggtcgacagttcgagaccatcctggccaacatggagaaaccccgtctctactaaaaatacaaaattagccgggcatggtggtggcaggcacctgtaatcccacctactcaggaggctgaggcaggagaatcgtttgaacccgggaggcggagcttgcagtgagctgagattgcaccactgcactccagcctgggcaacaagacgagattctgtctcaaaaaaaagaaaaagaaaaaaaaagagatgaaaagagatgaacgcagagctgaaagggggagggagtgtgatggtgttactagttactagaaaggggtcctgatccagacttcaagaacgggttctgggatcttgcccaagaaagaactggaggcaagttcacattgcaaactgaaagcaagcttattaagatagtaaaggggggccgggcacggtggctcatgcctgtaatcccaacacttttggaggctgaggcgggcggatcacctgagctcaggagttcgagatcagcttggccaacatggcaaaaccacacctttattaaaaatagaaaaaattagctaggtgtggcagtgtgtgcctgtaatcccagctacttgggaggctgaggcaggagaatcgcttgaacccgggaggcggaggttgcagtgagcccagattgcaccgttgcactccagcctgggcaacaagagcaaaactctgtccccaaaaaaagataactaaaagaaaaaagtcgtggggagagatgctccactacaagggtgactgataaaggattcatctttgtcatgactatcttttgcagtaatcaatattgtatatatacatattatatattttttattattattattttgagatcatctggctgtgtcatccaggctggagggcagtggtgcaatcacagctgactgctgtcttgaattcctgggctcaagcaatcctcccatctcggcctcccgagtagctgggtcaaaggcaaatgccaccattcctggcaaatatttgtatttttgtagggacgagggtttcactgtgtttcccgggctggtcttgaactcctagactcaatctatcttcctgccccagcctcccaaagtggtgggatgacaggtgtgggccaccgcgcctggcccaatattatcatttttaaagcaaaacggattctcacactatgaaagcttttgttctgaagatatcaacacatcaggaggtttctgtgtctgttcagtcctcggtctgtttagtaaacagtattgatctgttcacatatcttgcgtcaggaatggctgacctccagggaatgctgcccagcctgtcccagcctccctgttcccagcccctattctagatggagtccctctaagctgggcgtggtgtaatcccaggactttgggaggctgaggtgggcggatcacctgaggtcaggagttcgagaccagcctggccaacagggtgaaaccccatctctactaaaaatacccaaaattagccggggcgtggtggcgggcgcctgtaatcccaatattttggaaggctgaggtgacagaggattgcttgaggccacagcaattccagaccagcccggggcaacatcgtaagattcccccatccctcgtgtataaaaaaaagattaaattattacaaattttaaaaaagacagaaatgaagcatcttaagttaccacccagattggggtactaagagtctggatttggacagcttgttgcgcgttttataggtgtgctaaatcacatttcactctttttgttgagacagagtctcgtgctgtcgcccaggctggagggcagtggcgcgatctctgctcaccgcaacctccgcctcctgggttcaagcaattctcctgcctcagcctcctgagtagctgggattacaggcacctgccaccacgcccggctaatttttgtattttttttttttttttttttttttggagacagcgtcttgctctgtcgcccaggctggagtgcagtggtgcaatctccgctcactgcaacctccacctcccgggttcaagcaattctcctgcattagcctcctgagtagctaggattacaggcacgtgccaccatgcccagctaatttttgaatttatttatttatttttttggagacagtatcttgctctgttgcccaggctggagtgcagtggtgcgatctcggctcactgtaacctccgcctcccgggttcaagtgattctcctgcctcagcctcctgggtagctgggattacaggtgtgtgctaccatgcccggctaatttttgtatttttagtagggatggtgtttcaccatgttggccaggctggtctggaactcctgacttcaaatgatccgctcaccttgacctcccaaagggctgggattacagacatgaaccacggagcccggccggatttcactctttagatttttggtttaaactcgagaagctcttctcgagggctgaaagctcttggtcccctgtaggtttgctgtagatgacagacatgaggcagattgattaataagagaaaagacatgcactttttttttcttttttttttttgagacggagtctcgctctgtcaccgaggctggagtgcactggcatgatctcggctcactgcaacctccaccttccaggttcaactgattctcctgcctcagcctctccagtagctgggattacaggcgtgtgctaccatgcctggctaatttttctatttttagtagagacagggttgttccatattggtcaggctggtctcgaacacctgacctcaggtgatccgcctgcctcggcctcccagtgtgctaggattacaggcgtgaaccactgtacccagccagatttacacatttatagaatgtgtatacacaagattcttcagaatgaggactccaccccacaatgaggttcagaagctagtacaccacattgagactacagaaggataggggattggatcctggtacaaaaaaaaaaaggttatagggttggggggaaagaggaattctattgaggagcaatatataatttctactgcggactgaactctgatttttttctttattttattttattttattttatttttttgagacagcatctcactctgccgcccaggctggagtgcagtggtgcgatctcagctcactgcaacctccacctcctgggttcacccgattttcctgcctcagcctcccgagtagctgcgattacaggcacccgccactacgcccagctaattttctttgtatttttagtagagacggggtttcaccatgttggccaggctggtcttgaactcctgacctcaggtgatccaacctcctcggcctcccaaagtgctgggattatacgcatgagccactgcacctagcttcttctttttctttttttttttctttctttttttcttttttttttttagatggagtctaactttgtcgcccagactggagtacagtggcacaatctcagctcaccacagcctccacctcccaaggtcaagcaattctcctgcctcagcctcccaagtagctgagattacaggcacgtaccactactgcctgagtaatttttgtgtttttagtagagacaacatttcaccaggttggccaggctggtctcgaactcctgacctcaagtgatccacacgcctcagcctcccaaagtgctaggattataggcaccagccaccacaccgggcctctgactttttttatcttgcccaaattcctatctaagaggtctgaggaggcaagccctacaaaccataaattctcatcaaatgggatttattgaaccctgtatatcgtgacttactttccaacctgactctggcaaacgttacaagacagagaaaaaaaacaacatatgttgccccaaaatatgtttcttagttgtattttttttttcttttaagatggtctcattctgtttccaaggctggagtgcagtggtgcaatcttggctccctgcaacctccgtcttctaggttcaagcgattctcctgcctcctcagccttccaaatagctggcgtaatatgcatgagccatcgtgcccagataattgttttttgttttttgttttttttttagtagagatggggtttcactgtgatggccaggctggtcttgaactcctgacctcaggtgatccaaccgcctcggcctcccaaagtgctgggattataggcgtgaaccactgctcccggctggagtacaggggcataatcttggctcactgcagcctctgcttcccaggttcaagtgattctcctgcctcagtctcccgagtagctgggactacaggcgcccgccaccacgcccagctaatttttttttttttttttgtattttttttttttagtagagatggggtttcactgtgtttgccaggatggtctcgatctcctggcctcatgatctgcccgcctcggcctcccgaagtgctgggatgacaggcgtgagtcaccgcgcccggcatgaaagggtttttcattaaaaatccttgttataccgtggagccctgtgttggggtaaaatatcatgatttccctcactctccatcattcttgctttgaatctgagaaggaagcttggcggcctctattttaggatcagccgaaaatttccagaaaggggaaagaaaactcattctgtaaacacaaaaaagaagaagagaaaaaagtataagcggtacagacaaaacgcaaagatgttgcataattttccgtgagtgcaaaatgtcctgtaaaccaaaaaagaggtatctgagacaggtctcagtccatttagaaagttcattttgccgaggttaaggacgcctgcccatgacagagcctcaggaaatcgcgatgacaggtgctgtggatacacagggcacaatttgctttcatacatttttttggcggggagggagctggggatccagtcttgttctgtcacccaggctgcagtgcaatggtgcaatctcagctcactatcactgtaacctccgcctcccgtgttcaagctattctcctgccacagccttctgagtagctgggattataggcacccactaccgcgcccagctaatttttgtatttttagtagagacggggtttcaccatgttggccaggatggtctcgaactcctggcctcaaatgatccacctgcctcggcctcccaaagtgctgggattataggcgtgagccatggcgcccagccctggtatgtaatttttaaaacctttgtagtaccttatttacgaataaaatgcgaggcaggtttgcctaagacagtttccactataacctttcatgattttggggtcctgagacttatttacctttcacagtttacagcaggaaaatccgtggagacagcagatccgagaagcggcgatgtttgcgtagaaccctgtacgtgcttccttcggcctgtcggtaatgtggttggggattttcttttttttaagtgaagtctaaagaactgaaatgttttgctccataatgatgaaccaggatagaagtgagaactcagggcagaagaatctgaatgaggaactgtctgacctatgacaaatttaacatgtcacgttccctctgagacagtacacatcctcctgaagcagcgtgacaaggcacatcctcctgaagggtctccaggcagaagagacgcatgaacctgtcaaaaaaaaaaaaaaaaagagccggccgggcgcagtggctcaagcctgtaatcccagcactgtgggaggctgaggcggggggatcatgaggtcaggagttccagaccagcctggccaacatggtgaaaccccatctctgctaaaaatacaaaaattagccgggtgtagtggcagttgcctctagtcccagctactccggaggccgaggcaggagaatcgcttgaacccaggaggcgtaggttgcagtgagccaagatcgcgccactgcactccagcctgggcaacagagcgacagtccgtcccaaacactgcaaaatatttaaagagatttattctgagccaaatatgagtgagcaagaaggcccagggaaaatagtctaaagagatcctgagaacacgtatccaagctggttgagcggcagtttggttttatatgtttttgtttgtttacttattttactttattttatttatttatttatttattttgagatgaagccttgctcagtctgttaggctggagtgcagtggcgcgatctcggctcactgcaacctccgcctcccgggttcacgccattctcctgcctcagcctcccgagtagctgggactacaggcgcccaccaccatgcccagctaattttttgtatttttagtagagaaggggtttcaccgtgttagccaggatggtctcgatctcctgacttcgtgatccgcccgcctcagcctcccaaagtgttgggattacaggcacccgccaccacgcccggccaatttttgtatttttagtagcgacggggtttcaccatgttggccaggctggtctcaaacttgtgacctcacatgatctgctcacctcggcctcccaaagtgctgggattacaggcgtaagccacagcgtccagctattttattttatttgttttattttttgtgacagagtctcactctgtcgcccaggctggagtgcagtggagcgatctcagctcactgcaacctctgcctccggagctgaagcaattctcccgcctcagcctcccaagtagctggcattacagaggtacgccaccacgcctggctaaattttgtttgtttgtttgtttgtttgtttgtttgtttttgtttttcagtagacacagggtttcactatgttggccaggctggtctcgaactcctgacctcacatgatctgcctgcctcagcctccagaagtactgggattacagccgtgagccacctcacccagccagcagcttggttttatgtttgtttatatatttatttatttatttatttttaatttttggagacggagtcttgctctgttgcctgggctggagtgcagtggcatgatcttggctcacggcaacctctgcctttcgagttccagtgattctcctgcctcagcctcgcgagtagctgggagtacaggcgcccgccatcacacccggctagtatttgtatttttagtagagagagggtttcaccgtattgtccaggctggtcttgaactcctgtcctcaagtgatccacccacctgagcctctcaaagtgctgggattgcaggcgtgagcctctgtggccagccaacagacagttttgcaggaccatttcaaaatatgtcaagtaaatatattttggggtgaaatgtattttaaagtggcatatactgatttcccacagtcttgtctggggaggcatatcctggcctcctagaaagcatacacagtagcagacaggtgtggtggctcacgcctgcaatcccagccctttgggaggccgaggcaggtggatcacaaggtcaggagatcgagaccatcctggccaacatggtgaaatgctatctctactaaaaatacaaaaattagctgggcgtggtggtgcatgcctgtaatcccagctactcgagaggctgaggcaggaggaccacttgaacctggcaggtggaggttgcagtgagctgagatcacgccactgcactccagcctgggagacagagcgaggctccgtctctaaataaataaataaagcttacgcagtagctgagaagacagggaaaagaggtgaagaaatgacagaaagcttagaagtcgctcattataaccccttcctaccccatctcatgcttcccttaaagcataaacgaagggtgcttgtgttacaggaaaggggttcggatccagcccccaagagggggttcttggatctcacgcaagaaagaattcagggcggccgggcgctgtggctcacacctgtaatcccagcaccttgggaggcagaggcgggcggatcacgaggtcaggagttcgagaccagcctgaccaacatggtgaaaccccatctctactaaaaatacaaaaattagccaggtgtggtggtgcgtgcctgtagtcccagctactcgggagacagaggcaagagaatggcgtgaacccgggaggcgatgcttgcagtgagtggagatcatgccactacactccagcctgggcgatagagtaagtccatctcaaaaaaaaaaaaaaaaaaaaaaaattcggggtgagtcagcagtgcaaagccaaagcaaatttattacaaaagtaaaacagtgaaagaatagctactccagaggccgggcgcagtggctcatgcctgtaatcccagcactttgggaggtggaggtgggcagatcacctgaggtcaggagttcgagaccagcctgaccaacatggtgaaaccccatctctactaaaaatacaaaaattagccaggcatggtggtgcgtgcctgtagtcccagctactcgggaggctgaggcagtagaattgcttcaacttgggagacggaggttgcagtgagccgagatggcaccactgcactccagcctgggcaacagaatgagactcagtctcaaaaaaaaaaaaaaaaatttcagggcgagcaagtttattatgaaagtaaaatagtgaaagactaggtactccagaggccaggcgcagtggctcatgcctataatcccagcactttgggagcccgaggcaggtggatcacctgaggtcaggagttcgagaccagcctcgccaacatggtgaaaccccatctctactaaaaatacaaaaattagccaggcatggtggtgcgtgcctgtagtcccagctacttggaggctgaggcagtagaattgcttcaacttgggagacggaggttgcagtgagccaagatggcaccactgcactccagcctgggcgacagaatgagactcagtctcaaaaaaacaaaagatttcagggcgagcaagtttattatgaaagtaaagtagtggaagactagctactccagaggccaggtgcagtggctcatgcctataatcccagcactttgggagcccgaggcaggtggatcacctgaggtcaggatttcgagaccagcctcgccaacatggtgaaaccccatctctactaaaaatacaaaaattagccaggcgtgttggtgcgtgcctgtagtcccagctactcggaggctgaggcagtagaattgcttcaacttgggagacggaggttgcagtgagccgagatggcaccactgcactccagcctgggtgacagaatgagactcagtctaaaaaaaaaaaaaattcagggcaagcaagtttattatgaaagtaaaatagtgaaagactaggtaatccagaggctgggtgcagtggctcatgcctataatcccagcactttgggagcccaaggcatgtggatcacctgaggtcagaagttcgagaccagcctggccaacatggtgaaaccccatctctactaaaaatacaaaaattagccaggcgtgttggtgcgtgcctgtagtcccagctactcggaggctgaggcagtagaatcacttgaacctaggagacagaggttgcagtgagccgagatggcgccactgtactccagcctgggcgacagagtgagactccatctccaaaaaataaataaataagtcaaccaagaaggccgtacgtacagtggctcacacctgtcatcccatcactttgggaggccgaggcagggggattacttgagatcaggagtttgagaccagcctggccaacatggtgaaaccccgtctctactaaaaatacaaaaattagccaggcgtgttggtgcgtgcctgtagtcccagctactcggaggctgaggcagtagaatggcttcaacttgggagacggaggttgcagtgagccgagatggcaccactgcactccagcctgggcgacagagcaagaccgtctacaaaataataataataattaataataataataataactagtgcaagagaagtacacaaatatcccaaacatttagtgactcagcagagggggccagtctcaaggaacaggacttctacacctgttaccaccacctggggagttgtatctgaatctcaaggtcaggcccacccagacagaacatgcatctctagggtgccacaggagagtctgtccagtgcccagaaacacctgcaagacccagaagcaggctccaagaagcggggtgccacagtccagtgggggaagcggccacatccctgtcatgtgggctacagatgagttggggggcaggggcaggagaagaagaaacaggtgtggcctacatgcttttacttcctcttagcaagcgaggttcctcttgcagaggaacggtctgagagacacaaccgttttttttttttgtttgtttgcttttccttgagacagagtctccctctgtcacccaggctggagggcagtggcgcgatctcggctcactgcagcctccacctcctgggttcaagcgattctcctgcctcaacctcccgagtagctgggattacaggcacccaccaccccacccggctaatttttgtatttctagtatagatgaggtttcaccgtattagccaagctggtcccgaactcctgacctcaggcgatccgcctgccttggcctcccaaagtgctgggattacaggcgtgagccactgtgcccggccgagagacgcaatctttcagagaggaggtttggagcaggaacctcagggtggacagatgggtcccaccaggtgcagatgcttgaactaaagatgctacaaaggccgggtgcagtggttcatgcctgtaattccagcagtttgagaagctgaggcaggcagatcatctgaggtcaggagttcgagcccagcctggccaacatggcaaaacagcgtctctactaaaaatgcaaaattagcctggcataatggcgggcgcctataatcccagctacttgggaggccgaggcaggagaatcgcttgaacccgggaggcggaggttgcagtgagccaagattgcaccactgcactccagcctgggtgacaagagtgaaactccgtctcaaaaaaaaaaaaaaaaaaagaagaagaagaaaagaaatacattagtttggtccataaaggcgggacaactcaaagtgggggcttccaggctataaatgaatttaaacattttctggttgacaattggttgagtttgtagctcctcctccttctcttcttcctcctccttctccccccttcctcctcttcctcctcttcctcctcctccttcttcttctcttctttcttcttcttctctttccccttcttcttcttcttcctcctccttctcctcctcctttttcttcttcttccttatgggcttggatagaagtatattgacatggatccaccatttgtagaatcataccgagtagcttcttttctcctccttcctctccttctcctcctcctcctcctccttctcctgctccttctcctcctcctcctcctgctccttctcctcctcctcctccttctcctcctcctcctcctgcttctcctcctcctccttctcctcctcctgcttctcctcctcctccttctcctcctcctccttctcctcctcctccttctcctcctcctcattctcctcctgctccccttctcctcctccttctcctcctcctccttctcctcctgctccccttctcctcctccttctcctcctcctcctcctcctgctcctcctcctccagctccccttctcctcctactcctccttctcctccttctccttctcctccttctcctactcctccttctcctactcctccttctcctactcctccttctcctcttccttcttctcctcctcctgctccttctcctcctcttcctcctactcctccttctcttccttctcctcctcctccttctcctcctcctccttctcctcttcctccttctcctcctcctccttctcctcctcctccctctcctcctcctccgccttctcctactcctccttctcctcctccttcttctcctcctcctgctccttctcctcctcctccttctcctcctgctccttctcctcctcttcctcctactcctccttctcttccttctcctcctcctccttctcctcctcctgcacctttcctcctcctccttctttttccttttttgcataaagaagtatcaaataagagtagtttcactgccctaaacatcctctgaggtccatgtattcatccctccatctgcccaacgccaaccaactccggatctttttactgtttccatgattttgtcttttccacagtgtccaagtgttagaatgactcagtctgcagccatctcaaagtggattctttcccttagtcataagtatttaaacttcattcatgtcgttttatgtactcaccctttttttcttcctcttcttttttttttttttttcactttccttttatagctgttgcaaaagtcaagattttttaaaaaatataaaagagcagggccgggcacggtggctcacgcctgtaatcccagcactttgggaggccgaggcaggtggatcacgaggtcaggagatggagaccatcctggctaacacggtgaaagcctgtttctactaaaaaaaaaaaaaaaaaaaaaaaattagctgggtgtggtggcaggcgcctgtagtcccagctacttgggaagctgaggcaggagaatggtgtgaacctgggatgtggaggttgcagtgagccgagatcgcgccactgcactccagcctgggtgacagagcgtgactttgtctcaaaaaagaaaaaaaaagtacaaaagagcaaaacaaaacaaaagttatgaaaatgaaaacctgagccatcgtttatcttatttccccaaatccactaattattaacagaaagtaaaagctatgaaaaatgaatgaaagtgactgcaatttccttgaagtgtgttagaacctgcctttagtgtcagctatgggttccctcatgaaggtcagctgagccatgacccatgaaccatggaagcttgactctagattgaccatcttgagatgccaaagatgtccacgtcctaatcccatgtgggagacagaataatggccctgcagaccttcccagctggccatgacccctcatttgaccaggtcagcggctgaccaccatcctgggtttgtttccccaaatcacctccctggggtcccctgccaggaatgtcctgggagaggcaaccttctcactgtgtgatattttctctcctgcagctcttcccttctctctgaccagcaccatgcttctcctggtgacaagccttctgctctgtgagttaccacacccagcattcctcctgatcccagagaaatcgggtaagtatggaaacctggctgaaccttctccgcggcccctgtttagatgtcctgcatctggagacccatctggatacctgggtccatctgcatttcatctctaatgtttatgagggacccaataagcaccagccaacccaccagaagctcagagctcctcttgttctcacctccttttctgctgttaattcccatccacccattctacagatgagaaaacggaggctcagatacctccacagtttaacccaacgaccatccaggtagtgatggggccaggatgaggacccatgtctgcatggggccaaagtgttccttccttccttcgttccttcgttccttcgttccttccttccttccttccttccttccttcgttccttccttcgttccttccttccttccttccttccttccctcccttgcttccttctcttcctcctgccctccctctttccatccttccttctctccttccttccatccttctctccctcctgattcatttcttctctttctttctcttccttccttccctccttccctttctctctttcttccttccattgtttccttctttccttccttcttccgtccctcccttctttctttctctttcttccttccctccttccctctctctctttcttccttccattgtttttctttctttccttccttccctccctccctccctctctctctctctttctttctttctttctcctttttttttctccttctttgtttctttcttcctctttcttctttctttctttctttctttccttctttctttttctttcttttcagagtctccctcttgttgcccaggctggagtgcaatggctcaatctcagctcactgcaaactcagcctcccgggttcaagcgattctcctgcctcagcctcccgagtagctgggattacaggcgcctgccaccaggcccagctaatttttttgtatttttagtagagatggggttttgtcatgttggccaggctggtctcaatctcctggcctcaggtgatcccgtgcctcggcctcccaaagtgctaggattacagctatgagccgccacacccagcctcttgtttgttgacttcttaatagcagccattgtgactggcgtggaatgatagctcattgtggttttgatttgcgtttccgggagggaccctcttgactgagggtgtcagggcctctgcttcaggaaagtatttccaggtttttgtgacctggttcagggaagacagacaaagacagctttctgtttctgcaattttctcaaattccttcagctttatattaaactgccaaggttccataatttgggaagtgtgttcagagccacatcactctggataaagagcctttgcctgttctcattcaagcggttttctttctctgtctctcttttttttttttttttttttttttttgagacaggatctcgctctgtctcccaggctggagtgcagtggcgtgatctcggctcactgcagcctcagctttctgggatcaagtatcctcccactccagcctcccaagtagctgggactgcagaaatacaccaccatgccaagctaatttaaattttttttttaattttatagaggagatcttgctatgttgccaagactagtttttgatttttttttttttttgagatggagtcttactctgtcacccaggctggagtgcagtggcgcgatctcggctcactgcagcctcagctttctgggatcaagtatcctcccactccagcctcccaagtagctgggactgcagaaatacaccaccatgccaagctaatttaaatttttttttttttaaattttatagacgagatcttgctatgttgccaagactagtttttgattttttttttttttttttttttgagatggagtcttactctgtctcccaggctggagtgcagtggcgcgatctcggctcattgcaacctccacctcccgggttcaaccgattctcctgcctcagcctcctgagtagctgggattacaggtacccgccaccatgtccacctaatttttttgtatttttagtagagacagggtttcaccacattggccaggctggtctcgaactgctgacctcaggtgatccgcccacctcagcctaccaaagtgctgggattgcaggcatgagccaccgcgcctggccagtttttgatgatttctgcagtaaacatctccatgtggagaaggagcaagctgggaccacagatgtgcaccatcacacctgcctaatttaaatttttaaaaaaaaattttttttaaagagatgcgatcttgctatgttgcccaggcgggatctgaacctactgggctcaagtcagctttttgcctcagcctcccaaggtgctgggattagaggcgtgagccaccacccccagtcttcagatgatttttgaatatttctgcagtagaaatctcctttttcagaaacagccagggggctgtgaaaaggagggaagatggacaagggaggaacagatacctgaggatgtgggacgtcctggggccatgtgggtgacagaggaaaatcagcaggcttcagccctgaacttcacctcccagagccgggtgggaggacagaaaacagggccggccgggcacggtggctcacgcctgttatcccagcacttcgggaggctgaggcaggcggatcacctgaggtcggcagttcgagaccagcctgaccaacatggtgaaacccccatctctactaaaaatacaaaaattagctgggcatggtggtcggcgcctgtcatcccagctactcgggaggctgaggcaggagaatcatttgaacccgggtggtggagcttgcagcttgcagtgacctgagatcacagcactgcactccagcctgggagacaaagccagactccgtctcaaaaaaaaaaaaaaaaaaaaaaaaaaaaaaggaaaagaaaagaggaaattctgaacccagtgcccgctccttgcagatctgcgaacagtggcaccagcctctagtctcaatgtgaggtttgactccaggacgatgaatttaagctgggactgccaagaaaacacaaccttcagcaagtgtttcttaactgacaagaagaacagagtcgtggaacccagggtgagacgaatttcccattctcaacccctgtcctttacacacccctttctgagttaaaagcaacagggccggctgggcgcggcggctcacgcctgtcatcccagcactttgggaggctgaggtgggcggatcacctgaggtcgggagttcaagaccagcctgaccaacatggtgaaaccccgtctctactacaaatacaaaattagccgggcgtgctggtgcatgcctgtagtcccagctactcaggaggctgagggcagaagaattactcgaacccgggaggtggaagttgcagtgagtcgagctcgtgccattgcactccagcctgggtgacagagcgagactctgtctcataaaatgcaataaggccgggtgtggtggctcacgcttgtcatcccagcactctgggaggccgaggcaggtggatcacctgaggtcaggagttcaagaccaggctgaccaacatggtgaaaccccatctctactaaaaatacaaaaattagtcgggcatggtggcaggcatctgtaatcccagctactcgggaggctgaggcaggagaattactgaaactcgggaggcggaggttgcggtgagccgagatggtgccattgcactccagcctgggcaacaagagcaaaactctgtctccaaaaaaaaaaaaaaataataaattcaattaaataaaagcgagagggccacagacacaaacaacacaagtgtggtatttggagaaatgtcacagccataatctcacgggaaccgggaaagtgctgttagctcatgtccacaatgtgtaccagagcctgattccctgaggcagagcctatgttaccgtattttaccccaagagaagagaaatcctggcaaatgcagttggatgtgcccctgggtctgtggtggaagcaggacggagaaaagtaaagtgtcagtcacgttgtcagtgtgtcaccgtcctggttccccaagggattaaggtcagggtttttggaacacaggagacagagacagaagagcggggagaggggagggaaggagggagaaacacagagaaaggatagaaggaggagggagaggaagagagaaatatggatgatcgatagataggtgatagatgatttattgactgataggtgataatagatgattggaagattgataatcaattctataggtagatgctacacggagggatgggtggtcttgctatgttaccccagatgacatactttttttttttttttttttttttgagatggagtttccctcttgttgcccaggctggagtacactggtgtgatcttggctcactgcaacctccacctcctgggttcaagcgattctcctatctcagcctcctgagtagctgggattacaggtgcgtgccaccacgcctggctaatttttgtatttttagtagagacggggtttcaccatgttggccaggctggtctccaactcctgacctcgtgatccaccctccttggcctcccaaagtgctggcattacaggtgtgagccaccgtgtccgacctttattttttgggatggagtctcgctctgtcgcccaggctggagtgcactggcgtgatctcagctccctgcaacctgtgcctcctgggttcaagagattctcctgcctcagcctcctgagtagctgggattacaggtgcccaccaccacacctggctaatttttgtatttttagtagagacggggtttcaccatgttggccaggctgatcttgaactcctgacctcaagtgatccacccgcctcggcctcccagagtgctggcattacaggtgtgagccactatgtccgaccctttttttggggggatggagtctctgtctgtcacccaggctggagtgcactggcgtgatctcagctcactgcaacctgtgcctcctgggttcaagagagtctcctgcctcagcctcccgagtagcagggattacaggtgcctgccaccacacctggctaatttttgtatttttagtagagacggggtttcaccatgttggccaggctggtcttgaactcctgacctcaagtgatccacccgccttggcctcccagagtgctgggattacaggtgtgagccacggcacctggcctctagtctggtactttcagcactgctagagtataagattgagttttcacctgcaagctggtattcagcgtatccactcagagccctcggaggaagcttagggggatgatttcacaaagggaggcaggtgcgtgtcgccaaatccaggtaaaaaccaataccatggccgggcatggtggctcacgcctgtaatcccagcactttgggaggccgaggcgggtggatcacctgaggtcaggagtttgagaccagcctggccaacatggtgaaaccctgtctctactacaaatacacaaattagcagggtgtggtggcgggtgtctgtaatccgagctactcgggaggctgaggcgggagaattgcttgaacctggaaggcggaggttgtagtgagccgagatcacgccactgcactccagcctgggagactgtaggagacagaaggttgtttcctaatcggctctgtctggttgcaattcttcagctcagtaacaacgaatgttcgtgcacatttcgtgaaatttgtctgcatgaaggagtcacatttgaggttcacgtgaatactagtcaaagaggatttcaacagaaactgctttatccaaattcaggtaagcaagacagctcagggatccgtttacagcactggccccaccaccccgccagcatcaaagtacatcccgttgaacttcggagtgaaaattattttgtttctacctcttcccaggaagggagggtaccgctgctcagaatttctcctgtttcatctacaatgcggatttaatgaactgtacctgggcgaggggtccgacggccccccgtgacgtccagtattttttgtacatacgaaactcaaagtaagtgttcacctcatgtgaagaattatgaggaatgcagggatgggagaaaaaatcatgctggttttctttttttcctttttctttttttaagacatggtcttgctctgttgcccaggctgcaatgcaatggtgccacctcggctcactgcaacctcgacctcctgggttcaagcaattttcctgcctcagcttcccaggtagctgggattacaggcgcccgccaccacaccaggccacatctatgtatttagagacagagtcttgctctgtcgcccaggctggagtgtagtgatgtgatctcagctccctgcaacctgcgcctccctccagggttcaagtgattctcctgcctcagcctcccaagtagctgggactacaggtgcactccaccacacctgtctaatttttgtatttttagtagagacagggtttcaccatgctggccaggctggtctccaactcctgacctcaagtgatctgcctgcctcaacctccccaaagtgctgggattacaggcgtgagccactgcacctggcctgtttttttggttgttgttttgttttgtgttttttgttttgttttgtgtttctttttgttttgccttgtgtttttgtgttcttgttttgttttgtgtttctgtgtttttcttttgtttttgtgtttttttggtttcacgtttttgtggtgttttgtgtttttgtgtttttgttttttgtgtttgtttttgttttgttttgtgttttgttttgtgtttgtttttgttttgttttgtggtttttgttttgtgttgtgtttgtttttgttttgtgtttttttgtttgtgttttggtgtttttgttttgtggttttcttttgtgtttgtttttgttttgtgtttttgtgtttttgtttcattttgttttgttttgtgtttttgtgttttgttttgttttgtgtttgtttttgttttgttttgtgtttttgtgtttttgttttgtgttttgtgtttttgtgttttgttttgttttgtgtttttgtgttttgtttttgtgttttgttttgttttgtgtttttgtgttttgttttgtgtttgtttttgttttgttttgtgtttttgtgtttttgttttgtgttttgtgttttgttttgtgtttttgtgttttgttttgttttgtgtttttgttttgttttgtgtttttgatttgtgtttttgtgttttgttttgtgtttgtttttgttttgtgttttgtgtttttatgttttgttttgtgtttgttttcgttttgttttgtgtttttgttttgtgttttgtgtttttgtgggttttttttgttttgtgtttttgttttgtgtttttgtgttttgtgtttttgtgttttgttttgtgtttgtttttgttttgttttgtgtttttgtgttttgttttgttttcctgattgctctctgagcactttctaatctttcaggagaaggagggagatccggtgtccttattacatacaagactcaggaacccatgtgggatgtcacctggataacctgtcaggattaacgtctcgcaattactttctggttaacggaaccagccgagaaattggcatccaattctttgattcacttttggacacaaagaaaataggtgagaataacacatatgattttcctattgtttataggtgaaatggaatttgccttaaaatctgtgtaactgaggccacgtgcggtgtctcacacctgtaatctcagcactttgggaggccgaggcgggccgatcacctgagatcgggtgttcaaaaccagcctgaccaacatggggaaaccccatctctactaaaaatacaaaaattagccgggcatggtggcgcgtgcctgtaatcccagctactcggaaggctgaggagaatcactcaaacctaggaggcggacgttgcaatgaggtgagattgtgccactgcactccagcttgagcgacagagcaagactctgtctcaaaaacaaacaaacaaaaatctgtgtaactttggtgctgtaacaaattagaactgagctgatttaactttcctttttttgagatagagtctcgctctgtcacccaggctggagtgcagtggtgcaatctcagctcactgcaacctctgcctcccaggttcaagcgattcttctgtcttagtctccttagtagcttggattacaggtgcacaccaccacgctcggctaatttttgtatttttagtagaggcagtgtttcaccatcttggccgggctagtctcgaactcctgacctcagatgatccacctgcctcagcctcccaaagtgctgggattacaggcgtcagccactgcacctgacctccctctttacctccttccttctttccttcctccctgcctttctgcctttcttcttttttcttccttccttccttccttccctccctccctcctttccttccttccttcctccttccctcccttcttccttccctccctccctctctccctcccttcttcattccttccttcttcctctccttccttctccttcactcatttcctccttccttcctctttttcttcatttcttcctcaccagcacctcttcgtgtcccagtgccctgctcctggctggcctcttggagccagtcccatatgcccacacgctctcctcttcccaagcccaccgcatcccacccgtggactccttcatcccgttggacgttcccagcctcttcaggcttaggactctcacagaagtgtgactcctgcccaccaagcccatccccacctcccaccctggaacccctgccccagtgggtatctctcctgtacatggtagctgccccacctccacttggacccagtgtagacaggaggagaccctgtaccacctccacctggacccagtgtagacaaagaggtgtccctactccacgtccacctggatccagtgtagacaggaggagactgcaccacctccacctggacccagtgtagtcaaagagatgtccctactccacgtccacctggacccagtgtagacaggaggagaccctgtaccacctccactttacccagtgtagacagaaggagaccctgcaccacctccacctggacccagtgtagacaaagaggtgtccctactccacatttacctggacacagtgtagacaggaggagactgcaccacctccacttggacccagtgtagacaggagaccctgcaccacctccacctggacccagtgtagacaaagaggtgtccctactccacgtccacctggacccagtgtagacaggaggagactgcaccacctccacctggacccagtgtagacaaagaggtgtccctactccacatttacgtggacacagtgtagacaggaggagaccctgccccacctctacctggacccagtgtgaaggcgaccagcccttccacacatgtgggtatttctcgtcaggtgggacgagagactgagaaaagaaataagacacagagacaaagtatagagaaagaacagtgagcccaggggaccggcgctcagcatacggaggacctgcaccggtctctgagttctctcagtatttattgcttactattttcactatcttggcaaggggaatgtggcaggaggacagggtgatagtggggagaaggtcagcaggaagacatatgagcaaaggaatctgtgtcacaaataagttcaagggaagctactatgcctggatgcacacgcaggccagatttatgcttctctccacacaaacatcagtgtagcaaagagtcacagagcagtattgccaccagcatatctcgcctccagccacagggcggttttctcctgtctcagaatagaacgaatgtacgatcgggttttacacggagacattccattcccaggggcaggcaggagacggagggcttcctcttatctcaaccgcgagaggacttcctcctcggcacagaccctttatggatgtcgggctgggggacggtcaggtctttttcccttcccacgaggccatatctcagactgtctcagtggggggaaccctcagacaatacccgggctctctcgggcagaggtccctgcggctttccgcagtgcatggtgtccctggttaatagagaatggagaatggcgatgacttttaccaagcatgctgcctgcaaacctattgttaacaagacacagcacatgtttctgtgagcacagtgttggggctacagttacagcttaacagcatctcaaggcaaaacagtggttcaacatacagatcacaatggagtttcttaccttcctttctacatagacacagtaacagtctgatctttctttttgtttgtttgtttgtttttctgagacagagtctcactctgtcgcccacccaggctggagggcagtggcgggatctcggctcactgcaacctccgcctcccgggttcacgccattctcctgcctcagcctcccgagtagctgggactacaggcacccgccaccacgcccggctaatttttttggatttttagtagagacggggtttcaccgtgttagccaggatggtctcgacctcctgacctcgtgatcctcccgcctcggcctcccaaagtgctgggattacaggcgtgagccaccgcgcccagccccctgatctctctttcttttccctacacagagtagacaaagaggtgtccctactccacatttacctggacccagtgtagacaggaggagaccctgccccacctccacctggacccagcgtagacaaagaggtgtttctactccatatctacctggacccagtgtagatgggaggagaccctgccccatctccacctggacccagtgtagacaaagaggtgtccctagtccacatccacctggaccgagtgtagacaggaggagaccctgccccacctccacctggacccagtgtagacaggagaagactctgcaccacctccacctggacccagtgtagacaggaggagaccctgccccacctccacctggacccagtgtagacaggagaagactctgccccatctccacctggacccagcgtagacaaagaggtgtttctactccatatctacctggacccagtgtagatgggaggagaccctgccccacctccacctggacccagtgtagacaggagaagactgcaccacctccacctggaccgagtgtagacaggaggagaccctgccccacctctacctggacccagtgtagacaggaggagaccctgccccatctccacctggacccagtgtagtcaaagaggtgtccctactccacctccacctggacccagtgtagacaggacctactccacctccacctggacccagtgtagacaggaggagactctgcaccacctccacctggacccagtgtagacaggacctctcgggttcaggggtgtgtcctgcgccctcgttacagaacgattcaaccctcccagcaatgtcaccgtacgttgcaacacgacgcactgcctcgtacggtggaaacagcccaggacctatcagaagctgtcgtacctggactttcagtaccagctggacgtccacagaaaggtcggtgagagctccccggggctgggcaccaggagggaggcgtacgggacacgcccgcacaggagcctgggaatcccggggaagtggcctgggggaaggatgcgtgggtggtgagcggtgactctggggtgaacgcacttcgggtagcggaggaagaggtgaagggtctgtggcctgtggagccaccttgaaagaggttgcagggagggtggacaaggatgatcctgcaaccatggaaccaggaagtggaccgggaggtgtgggggacgatgccacaagcaaggagagcctctgctccacctccagctggacgcagtgtagacagaaggagaccctgccccatgtctacctggacccagtgtagataggaggacacccgaccccacctccacctacacccagtgtagacaggaggagaccctgctccacctccatggagacccagtgtagacaggaggagttcttgtcccacaactacctggacccagtgtagacagggagagagactgcctcacgtccacctcgatccagtgtagacaagaggagatcttgtctcacaacctcctggacccagtgtagacaagaagagaccctgccccatgtccacctcgagccagtgtagacaagaggagatcttgtcccacaaccacctggacccagtgtagacaagaaggagagcctgctccatgtctacctggacgacaggagaacaccctgccccaaggccagtgggacctttctggatgggttacaggaagatatctggccaggaagacttctgtgtttgcagctcctcatcctacctgtcttgtagattcggggtttgtggagggagacctgcctgccactccgcagggactccttcccattcggtgcccacaccaggggagacactgtgtgaaccatctacagtgttttagaaatggaaacagtgagccttgtgttgtgttttgttttgtttctagaatacccagcctggcacggaaaacctactggtaagtgaaaccacagaccctactgacaaccctcagcgtaaccctacggtcccctactcaccacacctagtgtaactctacagtcccctactcatgacccctacagtcccctaccgacgacctccagcgtaaccctacggtcccctactcaccacacctagtgtaactctacagtcccctactcatgacccctacagtcccctactgacgacctccagcgtaaccctacagtcccctactcaccacacctagtgtaaggaggaggagaccctgccccacctccacagagacccagtatagacaggaggagctcttgtcccacaaccacctggaccccgtgtagacaggaagagaccctgccccacgtccacctagcttaatcctacagtcccctactcaccacacctaatgtaactctacagtcccctactcatgacccctacagtcccctaccgatgacctccagcgtaaccctacagtcccctactcaccacatctagtgtaactctacagtcccctactcacgacccccggagtaatcctacagtctcctactcacgacgcctacagttccctattcatgacccctagcgtaaccatacagtcccctacccatgagccctggcataaccctacaatcccctactcaccacacctagcataaacctacagtcccctacccatgacccctggagtaaccctacagtcccctagtcactacacctagtgtaactaaccatacagttccctatccatgacctctggcggaaccctacactcccctactcacaacccctagtgtaaccctacagtctcctacccatgacccctggcggaactgtacagtcccctactcacgacccctacactctcctacccatgacccctggcggaaccctacagtcccctactcacgacccgtacagtctcctacccatgacccctggcagaaccctacagtcccctactcacgacccctacactctcctacccatgacccctggcagaaccgtacagtcccctactcacgacccctacagtctcctacccatgacccctggcggaactgtacagtcccctactcacgacccctacagtctcctacccatgacccctggcggaactgtacagtcccctactcacgacccctacactctcctacccatgacccctggcggaaccctacagtcccctactcacgacccctacagtctcctacccatgacccctggaggaaccctacagtcccctactcacgacccctacagtctcctacccatgacccctggcggaactgtacagtcccctactcacgacccctacagtctcctacccatgacccctggcggaaccctacagtcccctactcacgacccgtacagtctcctacccatgacccctggcagaaccctacagtcccctactcacgacccctacactctcctacccatgacccctggcggaaccgtacagtcccctactcacgacccctacagtctcctacccatgacccctggcggaaccgtacagtcccctactcacgacccctacactctcctacccaagacccctggcggaaccctacagtcccctactcacgacccctacactttcctacccatgacccctggcggaaccctacagtcccctactcacgacccctacactctcctacccatgacccctggcggaaccctacagtcccctactcacgacccctacagtctcctacacatgacccctggcggaaccctacagtcccctactcacgacccctacagtctcctacccatgacccctggaggaaccctacagtcccctactcacgacccctacagtctcctacccatgacccctggcggaactgtacagtcccctactcacgacccctacagtctcctacccatgacccctggcggaaccctacagtcccctactcacgacccgtacagtctcctacccatgacccctggcagaaccctacagtcccctactcacgacccctacactctcctacccataacccctggcggaaccgtacagtcccctactcacgacccctacagtctcctacccatgacccctggcggaaccctacagtcccctactcacgacccctacagtctcctacccatgacccctggaggaaccctacagtcccctactcacgacccctacagtctcctactcatgacccctggagtaaccctacagtcccctactcacgacccctacagtctcctactcatgacccctggagtaaccctacagtcccctattcaggagccgtagtgtgaccctacaatcccctactcacaacccccggtggaaccctacagtcccctacccatgacccctggtggaaccctacagtcccctactcacgacccctacactctcctacccatgacccctggcggaaccctacagtcccctactcacgacccctacagtctcctacccatgacccctggcagaaccctacagtcccctactcacgacccctacactctcctacccatgacccctggcagaaccctacagtcccctactcacgacccctacagtctcctactcatgacccctggagtaaccctacagtcccctattcaggagccgtagtgtgaccctacaatcccctactcacaacccccggtggaaccctacagtcccctacccatgacctctggtggaaccctacagtcccctactcacgacccctacactctcctacccatgacccctggtggaaccctacagtcccctactcacgacccctacactctcctacccatgacctctggtggaaccctacagtcccctactcacgacccctacactctcctacccatgacccctggcggaaccctacagtcccctactcacgacccctacagtctcctacccatgacccctggcagaaccctacagtcccctactcacgacccctacactctcctacccatgacccctggcagaaccctacagtcccctactcacgacccctacagtctcctactcatgacccctggagtaaccctacagtcccctattcaggagccgtagtgtgaccctacaatcccctactcacaacccccggtggaaccctacagtcccctacccatgacctctggtggaaccctacagtcccctactcacgacccctacactctcctacccatgacccctggtggaaccctacagtcccctactcacgacccctacactctcctacccatgacctctggtggaaccctacagtcccctactcacgacccctagtgtaaccccacatgacccccagtgtaaccctatagtcccctacccacgacctatgtctgcctagacccagtgtgatcaggaggagaccccacctcacctccccctagacccagtgtagacaagaaggagagcctgccccacgtctacctggatccagtgtagacaggagaatactctgcccgacatacagttgaaccactcacaaccctagcgtcaccctacagtctccacgaaccctacagtcttggtttatgggactcttagtgccagtgtggcccaggggtggacacggtggatcctgaaccagaggatgcagatctcacacgggtgagggccccctcatagttctcactgggcagggtctgctcttggcctcaaccttcgtgtcccaatggttggaatatttatgctcagcctgttctactgattttcccattttattcctctttcctctacgtgggttaagaatatattctagtgactgtctaaggagattatgtctccctctaaaatgcttttagagtgagtactgttgccgggtatttaccaagtctcgcggccactctgaccctcggtatcctcctctgtccgatgagtatgctagacttggggatcttaatatcccttgctaaactatccgtctgaaggtctgttaatatcagttgttgatcctgaatcatttatttatgtatgtatttatttttgagacggagtctcgctctgtcccccaggctggagtgcagtggtgcgatctcggctcactgcaagctccacctcccagcgattgtcctgcctcagcctccctacagagattctacagtctcagcctgtagctgggactacaggcacccacccccacacctggccaacaatttctgtttcagaaaataaaattttagccaggcacggtggctcacgcctgtcatcccagcaccttgggaggctgaggtgggcggatcacttgaggtcagcagttcaagaccagcctgggcaacatggagaaaccccatctctactaaaaatacaaaacgtacccatgcgtggtggcgggcgcctgtaatcccagctacgtgggaggctgaggcaggagaatggcgtgaacccgggaagcggaggttgcggtgagcccagatcatgccattgcactccagcctgggcgacagagcgagagtgtctcaaataaaataaaataaaagaggccgggcgtggtggctcatgcctgtaatcccagcactttgtgaggccgaggcggtcggatcacgaggtgaggagatcgagaccatcctggccaacatggtgaaaccccgtctccactaaaaatacaacaaaaattagccgggcgtggtggtgggcacctgtagtcccaactactggggaggctgaggcaggagaatggtgtgaaccctggaggtggaggttgtagtgagccaagatcgcgccactgcactgcagcctgggtgacagagggagactccgtctcaaaaaataaataaataaaataaaataaaaaagcttaaagcctacatcacccaaattttcccaacttgtctcccatcgaaatactaacgaggcttgactctgcttagcttcgaagacccgatcagaccaagtgcattcagagtggtagaaaaaaaagaagaaaaagaaaaaaagaaaaggagaaaaaaacttaaaagacaaaagaacgaaaaaaggcaaccttttcctccacacagaagacgcctatctctaactttcttttttcctccaaagattaatgtttctggtgatttggaaaatagatacaactttccaagctctgagcccagagcaaaacacagtgtgaagatcagagctgcagacgtccgcatcttgaattggagctcctggagtgaagccattgaatttggtaagcgttgggcggaggtaagggatgtttgtgccgtctgcggccaccctgcagcaggcacagaggtcaggtgctctgtcctgggcgctgagatcgagttgagcacgtcgctgggagtagtgtcaggctctgagcttatcgctgaggctcaaaagaaggaggtggtctcgtacttggtcccgcaacattgctttgctgatgttttttcaggacggatgagttggctcccttaataaccagagaagggccaggtgcagcggttcacgcctgtaatcccagcaatttgggaggctgaggccggcggatcaccggaggtcaggagtttgagaccagcctggccaacatggtgaaaccccgtctctactaaaaatacaaaattagcccagcattgtggcaggtgcctgtaatcccagctactcgggaggctgaggcaggagaatcacttgaacccaggaggcggaggttgcactgagctgggatcacgccattgcactccagcctgggtgacagcgtgagactccgtctcaaaaaaaaaaagaaaaaaaaatacaaaaactaaccaggattggtggcacattcctgtaatcccagctactcaggaggctgagggcaggagaatgacttgaacccgggaggtggaggttgcagtgagctggggtcacgccattgcactccagcctgggtgacagagtgagactctgtctcaaaaaaaaaaaaaaaaaaaaaaagaaaaagtagaaggaggtggtctcatactcatacggggtcatgcaacattgctttgctggtgtttttttcagggtggatgagctagaatcccttaatagccagagaaggaccccactgatagccctcctaaagtcccacctccctctgctccactgggaaacaatcagtcagtctttgtccggtcaaaccgtcaccattccggctccctggccaaggggaagctctctccctctttttttcttttttttttttttttttttgagacggcgtttcgctcttgtcgcaggctggagtccagtggcgcaatctcggctcactgcaagctccacctcctgggttcacgccattctcctgcctcagcctccccagtagctgggactacaggtgcccatcaccacgcctggctaattttttgtatttttttttttttagtagagacagggtttcactgttttttagccaggatggtctcgatctcctgacctcgtgatccgcccacctcggcctcccaaagtgctgggattacaggcgtgagccaccgtgcccggccctccctcttttttttttttttttttttttagatggcgtttcgctcttgttgcccaggctggagtgcagtggtgccatctcggctcaccgcgatctccgcctcccaggttcaagcaattctccagcctcagtctcccgagtagctgggattacaggcgcccgccaccacacccggctaattttgtatttttagtagagacggggtttcaccatgttggtcaggctgttcttgaactcctgacctcaggtgatctgcccacctcgccctcccaaagtgctgcaatgacaggcgtgagccaccctgcccgtccggggaagctctcttcaaagccaggtctcggctgcccaggagacaggtctatgcttttctctgaagatgattttgagggctccaaattgaaaaggggaaggggcaggatattgagaagtatgcggttttcacctcaacaaagggtacagaagaaaaattgtgagctgcagtgcagtggtgcacctctacctcccagatcacacagacaaaatggggtacagggatgatcagaggtgcattcgtgtctggtgggccggggtgactgcacctgtaagaaattttttttgtttatttattttttgttatttgagacggactctcgctctgtcacccaggctggagtgcaatggcacgatctcagctcactacaacctctgcctcctgggttcaagcgattctcctgcctcagcctcccgagtagctgggattacattagacatgcatcacgcttggccaatttttgtatttttctttttatttatttatttatttattttgagatggagtttcgctgtgtcacccaggctggagttcaatggcacgatcttggctcactgcaacctccgtctcccaggctcaagcgattctcctgcctcagcctcctgagtagctacgattacagacatgcatcatgcttggccattttttaaatatttttatttatttatttattttgagacagggtctcactctgtcacccaggctggagtgcaatggcacgatctcggctcactgcaacctccgcctcccgggttcaagcgattctcctgcctcagcctcccgagtagctgggattacagacatgcatcacgcttggccaatttttgtatttttatttttatttatttatttatttattttgagatggagtttcgctgtgtcacccaggctggagtgcaatggcacgatcttggctcactgcaacctccgtctcccaggctcaagcgattctcctgcctcagcctcctgagtagctgggattacagacatgcatcatgcttggccattttttaaatatttttatttatttatttattttgacacagggtctcactctgtcacccaggctggagtgcaatggcacaatctcggctcactgcaacctccgtctcccaggctcaagcgattctcctgcctcagactcccaggtagataggattacaggcacccaccaccatgcctggctaattttgtattttttttttagcagagatgaggtttcaccatgttagtgaggcttgtctcgaactcctgacctcagatgatgcgcccgcctcggcctcccaaagtgctgggatgacaggtgtgagccaccgtgcctggcccaatttttgtatttttggtagagacggggtttcaccatgttggtcaggctggtctcgaactcccaacctcaggtgatcctcccgtgtcggcctcccaaagtgctgggatgacaggcgtgagccaccgcatccggcccatggtggcaaagttttaacagctcaccagaaatttccttgtgggcaaaacatagggcaggcaggttgctttcatctcagagccatcttagttaagaaccaaaaacagggaggcaggtttgctgggcccagttctcagcttgactgttccctttggctaaatgcatttggacacccgaagagatttaatttcctttcacatgtccgtcaacgattcaccgcagacgcaaacctgtgtgtctctccaggttctgacgacgggaacctcggctctgtgtacatttatgtgctcctaatcgtgggaacccttgtctgtggcatcgtcctcggcttcctctttaaaaggtaacctgtgaaacacctgggcctccccaatgaaaacaggccaggccgggaggaaagcgctttgtccagtctctgtctctgtctctgagaaagagaaacacagccttggccgggcgtgttggctcatgcctgtaatcccagcactctgggaggccgaggcgggtggatcacgaggtcaggagatcgagaccatcctggctaacacagtgaaaccccgtctctactaaaaaattagcccggcgtggtcgcgggcgcctgtagtcccagctactcgggaggctgaggcaggagaatcgcttgaacccgggaggtggaggttgcagtgagccgagattgcaccactgcactccagcctgggcgacagggcgagactccatctcaaaacaaacaaaagaacggagaaaacgggagatcctacaggaatacacagtgatgctcacagggaatctttctagaatcttccctcagcccctcgggcacagggatgggaatggaacaggcagtcagctgtgggcagcttcagggagtctgaagtcactgctgttgaagggctgagctccagaggggaaacgcctgccttgatcccactagccttgaagagcgtggtttctgggttggaggtgggtttttttttgtttgtttgtttttttgttttttgttttgagacagacttttgctcttgttgcccaggctggagtgcagtgttgcaatctcggctcactgcaacctccacctcccgggttcacgccattctcctgcctcagcctcccgagtagctgggattacaggcatgcaccacgatgctcacctaatttttgtatttttagtagagatggggtttcaccacgttggccaggctggtctctaactcttgacctcaggtgatccacccgccttcgcctcccaaagtgctgggattacaggtgtgagccaccatgcctggcctagttccttaagatgtttgtcatttggtgatttttttttgtttttttgagatggagtctcactctgtcacccaggctggagtgcagtggtgcaatctcggctcactgcaacctccacctcccaggttcaagcaattctcctgcctcagcctcctgaatagctgggattacaggcaagcaccacgatactcagctaatttttgtatttttagtagagacggggtttcaccacgttggccaggctggtctcaaacctcaagtgatccacccgcctcggcctcccaaagtgctgggattacaggtgtgagccactgcacccggcctagttccttaagattttcgtcacttggtgattcttagtgaagttttgcatagttgagcgcagacaccccgcacgcagcatccctcggcacagggcgttgatggaaggaactctggtgacccggggttcattctcttcacactttttctctgtgtctcaggttccttaggatacagcggctgttcccgccagttccacagatcaaagacaaactgaatgataaccatgaggtggaagacgaggtaggcaggggtgggcggagcagtgacctgggatggaaggtggggagtggggagcgtgggacacggcctctgggtgtcgaccatcttgcttctccaccagatgggaccgcagcgtcaccaccggtgtggctggaatctgtatcccactcctgggccttctcccgggtcggggtcttctccaaggttggggtcagagtcatctctgtgagctccatcaggagaaactgaggcagggtggtggtcaagaaaaggaggagaagacggtagagagggccaggcacggtggctcatgcctgtcatcccagcactttgggaggttgaggcatgtggatcatctgaggtcagaggttcgagaccagcctggccaacgtggtgaaaccccatctctgctaaaaatacaaaaaattagctgggtgtggtggtgtacgcctgaaatcccagtgactcgggaggctggggcagtagaacggcttgaacccagggggcggaggttgcagtgagccgagatcgcaccactgcactccagcctgggtgacagagcgagactccatctcaaaagaaaaaagaaggtagagaggagaggcagaaatagagacaagagacagaggcagagaaagatggagggagagagatggaggagagagagaggaatgtagaagagaatgaggagacacaaaagagagggaaacaggcagacagactgacagaaacaaaggcagacacacagacagagaaacagagagagggagggagaaaagggagaaggaaagagagagacacgagacacagatggagaaacagagacagataaacaacaaacataaagacccaggcgggggccggtcgcggtgactcacatctgtcatcccagcactttgggaggccgaggcgggtggatcacttgaggtcgggagttcgagaccagcctgaccaacctgaagaaacctcgtctctactaaaattgcaaaaattagccaggtgtggtggcgcacacctgtaatcccacctactctggaggctgaggcaggagaatcacttgaacccaggaggcggaggctgcagtgagccgagatcgcaccattgcactctaacctgggcaacagagcaaaactctctatcaaaaacaaaacaaaacaaaaaaatcatccccagcagggagaggagagagacagagaggaacagaggcacagagaggggagagagacaaagacagagagacacagagaaagacacagaaaaagagagagagagggagaaggagacatagagacagggacaaagagaaaaagacggacagagagagaaacagagagacataggtggacacagagaggggagagagagagagagacagaaagagacagagagcaagggatgggagtggaagagagagacagatggaggaaaaagacagagagggaggcagataaaagacacacagagacaccgagagagacagggaagacagaggagtcggacttagtctcagcgagagcccagagagggtgaacaagggcgaggaaccatgtgacctgcaccctgagaccccattggcgctcctctcccacccacctctctccggctcagggactgcgtcttatgttgcagtaggctggcaggctggaaagtcaggccagggctgatgctgcatcccagaggcagaactgtcctgcattctcagagtgggagatgaaatttttaaaaaggaaataaaactcttgtcggggaacctcagcttttatcctttagacgtttgactgattagaccaggcccactcttctcctttacactttcggctgattgaatgaggcccacccttccccctttacaccttcgactgattagatgaggcccaccattcccctttagaccttcgactgatcagatgaagcccacccttcccctttagaccttcagcttattagataaggcccacccttaccctttagactttcaactgattaaatgaggcccactctccccgtttagacctttgactgattagatgaagcccacgcttctcctttggaccttcaactgattagatgaggcccacccttcccccttcagcctttcgactgattagatgaggcccaccctcccctttataccttcgactgattagatgaggcccaccctcccctttataccttcgactgattagatgaggcccaccctcccctttataccttcgactgattagatgaggcccgtccttcccccatttagatcttcaactgattagatgaggcccacctttccctttttagacctttgactgattagatgaggcctacccttctccctttagacctttgactgattagatgaggcctacccttctccctttagacctttgactgattagatgagacccacccttcccatttagaccttcaactcattagatgaagcccacccttccccccttcccctttagaccttcagcttattaattagacaaggcccaccccctttagaccttcaactgattagatgaggcccacccctcttcagaccttcaactgattagatgaggcccaccccctttagacctttgactgattagataaggcccacccacattctccagtccaatctcttttcctggaaatcagctgattgtggacttgacatctacaaagccccttcgtagcagccgctgagtcatggtttcattcaataactggggactgtagcctagtcacggggacacgtcattggtgccgggtatcagagacgaaggccaagagatgaaagagaaacagagactgaacccaaaagaggcagacacacaggaagatggagatagagacccagagatgggggtggaagaaggtgagagggggaggaaagagagacagagagggagacagagaaaagaggcagagagaccgagagagaggctgaacagcaagaccccagagagggtgactaagggtgagagacttgcgtgacccacatcccaagaccccgtgggtggccctctcccacccacctctctccagctcaggggctgtgtcttcctcccatggggaactccagttgcagcccagggttgcccccagcgccctcttctctgccacataggtaacatcctcctggttgccacttgcacacccccatcctagacctggccatctgtcattccattaccttccacccccacgccagcctcctccccggcccccgctttccactgacccccaggggtcccccacatcgaggtgccaggatgacggcttcaggcttcaaccttcccttctctgagctccatcagctccaggggcttagcacctgctgtaccctgcccaggtttcatgctcacaagctcttccaaagaccaccctgttcatcgtcaactatgaggtcccatgggtggatctgtctcagatctttaccccaggaaaaacccatggccaggtgcagtggctcatgcctgtcatcccagcactttgggaggccgaggcgagtggatcacctcgaggtcaggagtttgagaccagcctggccaacatggtaaaaccccatctccactgaaagtacaaaatttagctggtggcggctaaagggggaaaggtgggcctcatctaatcagtcgaaggtctaaagggggaagagtgggcctcatctgatcagtcaaatttgtggtggcgggcgcctgtaatcccagctactcaggaggctgaggcaggagaatcgcttgaacccgggaggccgaggttgcagtgagctgagatgacaccactgcactccagcctgggcaatagaatgagactccgtctcgagggagaaaaagaaaataaacacagcccactgagtcccaggctgagctcgtgaagatctgacagcctgaaccctcctttttctcagatcatctgggaggaattcaccccagaggaagggaaaggctaccgcgaagaggtcttgaccgtgaaggaaattacctgagacccagagggtgtaggaatggcatggacatctccgcctccgcgacacgggggaactgttttcttgatgatgctgtgaacctttatatcattttctatgtttttatttaaaaacatgacatttggggccaggcgcggtggctcacgcctgtaatcccagcactttgggaggccaaggcaggcggatcacctgaggtcaggagttcaagaccagcctgcccaacatggtgaaaccccatctggactaaaaatgcagaaatttacccaggcacggcggcggacgcccatcatcccagctacttgggaggctgaggcaggagaattgcttgaacccgtgaggcggaggttgtagtgagccaagatcgcaccattgcacaccaacctgcgtgacagagcaagattgcatctcaaaacaaacaataataataaataataaaaacctgatatttggctgggc

SEQ ID NO: 2848 - DNA, 41122 bp, human
tctgaagggagctactcagaagcgggagtctccgagagaagaaaagcaggtggaaggagaggaagcggatgccgtgggggtaagctaagttctttccttctgtggtctttgagcatgtcgagtcacccgggtacatgtttctgctgtgtctgtcgatagaaaagaaagagactgaactggaacataagatttcaaacgttggctcgagccgaagtggggacagcggcccagaagactgagagccaaggaaccttgcatatgagttgtcttctgcctttgttatatgcaggtttttaaaggcaaaattaaaaaaataaaataaaataaaaagagggaggtgttgttggaggacagggagggggcttctgtgaagctgtttgctgggaattctcgttggtttacagaaaaaaacaattgattaatgattggctgtacattgctaagctacagggcgttggggtgtagtatctagcacggaattatcacgtgaattcacagctatctgtggcatccggaagccgtttcgagagatgaacgcggccgggcgtggtggctcacgcctgtaatcccagcactttgggagactgaggcgggtggatcacctgaggtcgacagttcgagaccatcctggccaacatggagaaaccccgtctctactaaaaatacaaaattagccgggcatggtggtggcaggcacctgtaatcccacctactcaggaggctgaggcaggagaatcgtttgaacccgggaggcggagcttgcagtgagctgagattgcaccactgcactccagcctgggcaacaagacgagattctgtctcaaaaaaaagaaaaagaaaaaaaaagagatgaaaagagatgaacgcagagctgaaagggggagggagtgtgatggtgttactagttactagaaaggggtcctgatccagacttcaagaacgggttctgggatcttgcccaagaaagaactggaggcaagttcacattgcaaactgaaagcaagcttattaagatagtaaaggggggccgggcacggtggctcatgcctgtaatcccaacacttttggaggctgaggcgggcggatcacctgagctcaggagttcgagatcagcttggccaacatggcaaaaccacacctttattaaaaatagaaaaaattagctaggtgtggcagtgtgtgcctgtaatcccagctacttgggaggctgaggcaggagaatcgcttgaacccgggaggcggaggttgcagtgagcccagattgcaccgttgcactccagcctgggcaacaagagcaaaactctgtccccaaaaaaagataactaaaagaaaaaagtcgtggggagagatgctccactacaagggtgactgataaaggattcatctttgtcatgactatcttttgcagtaatcaatattgtatatatacatattatatattttttattattattattttgagatcatctggctgtgtcatccaggctggagggcagtggtgcaatcacagctgactgctgtcttgaattcctgggctcaagcaatcctcccatctcggcctcccgagtagctgggtcaaaggcaaatgccaccattcctggcaaatatttgtatttttgtagggacgagggtttcactgtgtttcccgggctggtcttgaactcctagactcaatctatcttcctgccccagcctcccaaagtggtgggatgacaggtgtgggccaccgcgcctggcccaatattatcatttttaaagcaaaacggattctcacactatgaaagcttttgttctgaagatatcaacacatcaggaggtttctgtgtctgttcagtcctcggtctgtttagtaaacagtattgatctgttcacatatcttgcgtcaggaatggctgacctccagggaatgctgcccagcctgtcccagcctccctgttcccagcccctattctagatggagtccctctaagctgggcgtggtgtaatcccaggactttgggaggctgaggtgggcggatcacctgaggtcaggagttcgagaccagcctggccaacagggtgaaaccccatctctactaaaaatacccaaaattagccggggcgtggtggcgggcgcctgtaatcccaatattttggaaggctgaggtgacagaggattgcttgaggccacagcaattccagaccagcccggggcaacatcgtaagattcccccatccctcgtgtataaaaaaaagattaaattattacaaattttaaaaaagacagaaatgaagcatcttaagttaccacccagattggggtactaagagtctggatttggacagcttgttgcgcgttttataggtgtgctaaatcacatttcactctttttgttgagacagagtctcgtgctgtcgcccaggctggagggcagtggcgcgatctctgctcaccgcaacctccgcctcctgggttcaagcaattctcctgcctcagcctcctgagtagctgggattacaggcacctgccaccacgcccggctaatttttgtattttttttttttttttttttttttggagacagcgtcttgctctgtcgcccaggctggagtgcagtggtgcaatctccgctcactgcaacctccacctcccgggttcaagcaattctcctgcattagcctcctgagtagctaggattacaggcacgtgccaccatgcccagctaatttttgaatttatttatttatttttttggagacagtatcttgctctgttgcccaggctggagtgcagtggtgcgatctcggctcactgtaacctccgcctcccgggttcaagtgattctcctgcctcagcctcctgggtagctgggattacaggtgtgtgctaccatgcccggctaatttttgtatttttagtagggatggtgtttcaccatgttggccaggctggtctggaactcctgacttcaaatgatccgctcaccttgacctcccaaagggctgggattacagacatgaaccacggagcccggccggatttcactctttagatttttggtttaaactcgagaagctcttctcgagggctgaaagctcttggtcccctgtaggtttgctgtagatgacagacatgaggcagattgattaataagagaaaagacatgcactttttttttcttttttttttttgagacggagtctcgctctgtcaccgaggctggagtgcactggcatgatctcggctcactgcaacctccaccttccaggttcaactgattctcctgcctcagcctctccagtagctgggattacaggcgtgtgctaccatgcctggctaatttttctatttttagtagagacagggttgttccatattggtcaggctggtctcgaacacctgacctcaggtgatccgcctgcctcggcctcccagtgtgctaggattacaggcgtgaaccactgtacccagccagatttacacatttatagaatgtgtatacacaagattcttcagaatgaggactccaccccacaatgaggttcagaagctagtacaccacattgagactacagaaggataggggattggatcctggtacaaaaaaaaaaaggttatagggttggggggaaagaggaattctattgaggagcaatatataatttctactgcggactgaactctgatttttttctttattttattttattttattttatttttttgagacagcatctcactctgccgcccaggctggagtgcagtggtgcgatctcagctcactgcaacctccacctcctgggttcacccgattttcctgcctcagcctcccgagtagctgcgattacaggcacccgccactacgcccagctaattttctttgtatttttagtagagacggggtttcaccatgttggccaggctggtcttgaactcctgacctcaggtgatccaacctcctcggcctcccaaagtgctgggattatacgcatgagccactgcacctagcttcttctttttctttttttttttctttctttttttcttttttttttttagatggagtctaactttgtcgcccagactggagtacagtggcacaatctcagctcaccacagcctccacctcccaaggtcaagcaattctcctgcctcagcctcccaagtagctgagattacaggcacgtaccactactgcctgagtaatttttgtgtttttagtagagacaacatttcaccaggttggccaggctggtctcgaactcctgacctcaagtgatccacacgcctcagcctcccaaagtgctaggattataggcaccagccaccacaccgggcctctgactttttttatcttgcccaaattcctatctaagaggtctgaggaggcaagccctacaaaccataaattctcatcaaatgggatttattgaaccctgtatatcgtgacttactttccaacctgactctggcaaacgttacaagacagagaaaaaaaacaacatatgttgccccaaaatatgtttcttagttgtattttttttttcttttaagatggtctcattctgtttccaaggctggagtgcagtggtgcaatcttggctccctgcaacctccgtcttctaggttcaagcgattctcctgcctcctcagccttccaaatagctggcgtaatatgcatgagccatcgtgcccagataattgttttttgttttttgttttttttttagtagagatggggtttcactgtgatggccaggctggtcttgaactcctgacctcaggtgatccaaccgcctcggcctcccaaagtgctgggattataggcgtgaaccactgctcccggctggagtacaggggcataatcttggctcactgcagcctctgcttcccaggttcaagtgattctcctgcctcagtctcccgagtagctgggactacaggcgcccgccaccacgcccagctaatttttttttttttttttgtattttttttttttagtagagatggggtttcactgtgtttgccaggatggtctcgatctcctggcctcatgatctgcccgcctcggcctcccgaagtgctgggatgacaggcgtgagtcaccgcgcccggcatgaaagggtttttcattaaaaatccttgttataccgtggagccctgtgttggggtaaaatatcatgatttccctcactctccatcattcttgctttgaatctgagaaggaagcttggcggcctctattttaggatcagccgaaaatttccagaaaggggaaagaaaactcattctgtaaacacaaaaaagaagaagagaaaaaagtataagcggtacagacaaaacgcaaagatgttgcataattttccgtgagtgcaaaatgtcctgtaaaccaaaaaagaggtatctgagacaggtctcagtccatttagaaagttcattttgccgaggttaaggacgcctgcccatgacagagcctcaggaaatcgcgatgacaggtgctgtggatacacagggcacaatttgctttcatacatttttttggcggggagggagctggggatccagtcttgttctgtcacccaggctgcagtgcaatggtgcaatctcagctcactatcactgtaacctccgcctcccgtgttcaagctattctcctgccacagccttctgagtagctgggattataggcacccactaccgcgcccagctaatttttgtatttttagtagagacggggtttcaccatgttggccaggatggtctcgaactcctggcctcaaatgatccacctgcctcggcctcccaaagtgctgggattataggcgtgagccatggcgcccagccctggtatgtaatttttaaaacctttgtagtaccttatttacgaataaaatgcgaggcaggtttgcctaagacagtttccactataacctttcatgattttggggtcctgagacttatttacctttcacagtttacagcaggaaaatccgtggagacagcagatccgagaagcggcgatgtttgcgtagaaccctgtacgtgcttccttcggcctgtcggtaatgtggttggggattttcttttttttaagtgaagtctaaagaactgaaatgttttgctccataatgatgaaccaggatagaagtgagaactcagggcagaagaatctgaatgaggaactgtctgacctatgacaaatttaacatgtcacgttccctctgagacagtacacatcctcctgaagcagcgtgacaaggcacatcctcctgaagggtctccaggcagaagagacgcatgaacctgtcaaaaaaaaaaaaaaaaagagccggccgggcgcagtggctcaagcctgtaatcccagcactgtgggaggctgaggcggggggatcatgaggtcaggagttccagaccagcctggccaacatggtgaaaccccatctctgctaaaaatacaaaaattagccgggtgtagtggcagttgcctctagtcccagctactccggaggccgaggcaggagaatcgcttgaacccaggaggcgtaggttgcagtgagccaagatcgcgccactgcactccagcctgggcaacagagcgacagtccgtcccaaacactgcaaaatatttaaagagatttattctgagccaaatatgagtgagcaagaaggcccagggaaaatagtctaaagagatcctgagaacacgtatccaagctggttgagcggcagtttggttttatatgtttttgtttgtttacttattttactttattttatttatttatttatttattttgagatgaagccttgctcagtctgttaggctggagtgcagtggcgcgatctcggctcactgcaacctccgcctcccgggttcacgccattctcctgcctcagcctcccgagtagctgggactacaggcgcccaccaccatgcccagctaattttttgtatttttagtagagaaggggtttcaccgtgttagccaggatggtctcgatctcctgacttcgtgatccgcccgcctcagcctcccaaagtgttgggattacaggcacccgccaccacgcccggccaatttttgtatttttagtagcgacggggtttcaccatgttggccaggctggtctcaaacttgtgacctcacatgatctgctcacctcggcctcccaaagtgctgggattacaggcgtaagccacagcgtccagctattttattttatttgttttattttttgtgacagagtctcactctgtcgcccaggctggagtgcagtggagcgatctcagctcactgcaacctctgcctccggagctgaagcaattctcccgcctcagcctcccaagtagctggcattacagaggtacgccaccacgcctggctaaattttgtttgtttgtttgtttgtttgtttgtttgtttttgtttttcagtagacacagggtttcactatgttggccaggctggtctcgaactcctgacctcacatgatctgcctgcctcagcctccagaagtactgggattacagccgtgagccacctcacccagccagcagcttggttttatgtttgtttatatatttatttatttatttatttttaatttttggagacggagtcttgctctgttgcctgggctggagtgcagtggcatgatcttggctcacggcaacctctgcctttcgagttccagtgattctcctgcctcagcctcgcgagtagctgggagtacaggcgcccgccatcacacccggctagtatttgtatttttagtagagagagggtttcaccgtattgtccaggctggtcttgaactcctgtcctcaagtgatccacccacctgagcctctcaaagtgctgggattgcaggcgtgagcctctgtggccagccaacagacagttttgcaggaccatttcaaaatatgtcaagtaaatatattttggggtgaaatgtattttaaagtggcatatactgatttcccacagtcttgtctggggaggcatatcctggcctcctagaaagcatacacagtagcagacaggtgtggtggctcacgcctgcaatcccagccctttgggaggccgaggcaggtggatcacaaggtcaggagatcgagaccatcctggccaacatggtgaaatgctatctctactaaaaatacaaaaattagctgggcgtggtggtgcatgcctgtaatcccagctactcgagaggctgaggcaggaggaccacttgaacctggcaggtggaggttgcagtgagctgagatcacgccactgcactccagcctgggagacagagcgaggctccgtctctaaataaataaataaagcttacgcagtagctgagaagacagggaaaagaggtgaagaaatgacagaaagcttagaagtcgctcattataaccccttcctaccccatctcatgcttcccttaaagcataaacgaagggtgcttgtgttacaggaaaggggttcggatccagcccccaagagggggttcttggatctcacgcaagaaagaattcagggcggccgggcgctgtggctcacacctgtaatcccagcaccttgggaggcagaggcgggcggatcacgaggtcaggagttcgagaccagcctgaccaacatggtgaaaccccatctctactaaaaatacaaaaattagccaggtgtggtggtgcgtgcctgtagtcccagctactcgggagacagaggcaagagaatggcgtgaacccgggaggcgatgcttgcagtgagtggagatcatgccactacactccagcctgggcgatagagtaagtccatctcaaaaaaaaaaaaaaaaaaaaaaaattcggggtgagtcagcagtgcaaagccaaagcaaatttattacaaaagtaaaacagtgaaagaatagctactccagaggccgggcgcagtggctcatgcctgtaatcccagcactttgggaggtggaggtgggcagatcacctgaggtcaggagttcgagaccagcctgaccaacatggtgaaaccccatctctactaaaaatacaaaaattagccaggcatggtggtgcgtgcctgtagtcccagctactcgggaggctgaggcagtagaattgcttcaacttgggagacggaggttgcagtgagccgagatggcaccactgcactccagcctgggcaacagaatgagactcagtctcaaaaaaaaaaaaaaaaatttcagggcgagcaagtttattatgaaagtaaaatagtgaaagactaggtactccagaggccaggcgcagtggctcatgcctataatcccagcactttgggagcccgaggcaggtggatcacctgaggtcaggagttcgagaccagcctcgccaacatggtgaaaccccatctctactaaaaatacaaaaattagccaggcatggtggtgcgtgcctgtagtcccagctacttggaggctgaggcagtagaattgcttcaacttgggagacggaggttgcagtgagccaagatggcaccactgcactccagcctgggcgacagaatgagactcagtctcaaaaaaacaaaagatttcagggcgagcaagtttattatgaaagtaaagtagtggaagactagctactccagaggccaggtgcagtggctcatgcctataatcccagcactttgggagcccgaggcaggtggatcacctgaggtcaggatttcgagaccagcctcgccaacatggtgaaaccccatctctactaaaaatacaaaaattagccaggcgtgttggtgcgtgcctgtagtcccagctactcggaggctgaggcagtagaattgcttcaacttgggagacggaggttgcagtgagccgagatggcaccactgcactccagcctgggtgacagaatgagactcagtctaaaaaaaaaaaaaattcagggcaagcaagtttattatgaaagtaaaatagtgaaagactaggtaatccagaggctgggtgcagtggctcatgcctataatcccagcactttgggagcccaaggcatgtggatcacctgaggtcagaagttcgagaccagcctggccaacatggtgaaaccccatctctactaaaaatacaaaaattagccaggcgtgttggtgcgtgcctgtagtcccagctactcggaggctgaggcagtagaatcacttgaacctaggagacagaggttgcagtgagccgagatggcgccactgtactccagcctgggcgacagagtgagactccatctccaaaaaataaataaataagtcaaccaagaaggccgtacgtacagtggctcacacctgtcatcccatcactttgggaggccgaggcagggggattacttgagatcaggagtttgagaccagcctggccaacatggtgaaaccccgtctctactaaaaatacaaaaattagccaggcgtgttggtgcgtgcctgtagtcccagctactcggaggctgaggcagtagaatggcttcaacttgggagacggaggttgcagtgagccgagatggcaccactgcactccagcctgggcgacagagcaagaccgtctacaaaataataataataattaataataataataataactagtgcaagagaagtacacaaatatcccaaacatttagtgactcagcagagggggccagtctcaaggaacaggacttctacacctgttaccaccacctggggagttgtatctgaatctcaaggtcaggcccacccagacagaacatgcatctctagggtgccacaggagagtctgtccagtgcccagaaacacctgcaagacccagaagcaggctccaagaagcggggtgccacagtccagtgggggaagcggccacatccctgtcatgtgggctacagatgagttggggggcaggggcaggagaagaagaaacaggtgtggcctacatgcttttacttcctcttagcaagcgaggttcctcttgcagaggaacggtctgagagacacaaccgttttttttttttgtttgtttgcttttccttgagacagagtctccctctgtcacccaggctggagggcagtggcgcgatctcggctcactgcagcctccacctcctgggttcaagcgattctcctgcctcaacctcccgagtagctgggattacaggcacccaccaccccacccggctaatttttgtatttctagtatagatgaggtttcaccgtattagccaagctggtcccgaactcctgacctcaggcgatccgcctgccttggcctcccaaagtgctgggattacaggcgtgagccactgtgcccggccgagagacgcaatctttcagagaggaggtttggagcaggaacctcagggtggacagatgggtcccaccaggtgcagatgcttgaactaaagatgctacaaaggccgggtgcagtggttcatgcctgtaattccagcagtttgagaagctgaggcaggcagatcatctgaggtcaggagttcgagcccagcctggccaacatggcaaaacagcgtctctactaaaaatgcaaaattagcctggcataatggcgggcgcctataatcccagctacttgggaggccgaggcaggagaatcgcttgaacccgggaggcggaggttgcagtgagccaagattgcaccactgcactccagcctgggtgacaagagtgaaactccgtctcaaaaaaaaaaaaaaaaaaagaagaagaagaaaagaaatacattagtttggtccataaaggcgggacaactcaaagtgggggcttccaggctataaatgaatttaaacattttctggttgacaattggttgagtttgtagctcctcctccttctcttcttcctcctccttctccccccttcctcctcttcctcctcttcctcctcctccttcttcttctcttctttcttcttcttctctttccccttcttcttcttcttcctcctccttctcctcctcctttttcttcttcttccttatgggcttggatagaagtatattgacatggatccaccatttgtagaatcataccgagtagcttcttttctcctccttcctctccttctcctcctcctcctcctccttctcctgctccttctcctcctcctcctcctgctccttctcctcctcctcctccttctcctcctcctcctcctgcttctcctcctcctccttctcctcctcctgcttctcctcctcctccttctcctcctcctccttctcctcctcctccttctcctcctcctcattctcctcctgctccccttctcctcctccttctcctcctcctccttctcctcctgctccccttctcctcctccttctcctcctcctcctcctcctgctcctcctcctccagctccccttctcctcctactcctccttctcctccttctccttctcctccttctcctactcctccttctcctactcctccttctcctactcctccttctcctcttccttcttctcctcctcctgctccttctcctcctcttcctcctactcctccttctcttccttctcctcctcctccttctcctcctcctccttctcctcttcctccttctcctcctcctccttctcctcctcctccctctcctcctcctccgccttctcctactcctccttctcctcctccttcttctcctcctcctgctccttctcctcctcctccttctcctcctgctccttctcctcctcttcctcctactcctccttctcttccttctcctcctcctccttctcctcctcctgcacctttcctcctcctccttctttttccttttttgcataaagaagtatcaaataagagtagtttcactgccctaaacatcctctgaggtccatgtattcatccctccatctgcccaacgccaaccaactccggatctttttactgtttccatgattttgtcttttccacagtgtccaagtgttagaatgactcagtctgcagccatctcaaagtggattctttcccttagtcataagtatttaaacttcattcatgtcgttttatgtactcaccctttttttcttcctcttcttttttttttttttttcactttccttttatagctgttgcaaaagtcaagattttttaaaaaatataaaagagcagggccgggcacggtggctcacgcctgtaatcccagcactttgggaggccgaggcaggtggatcacgaggtcaggagatggagaccatcctggctaacacggtgaaagcctgtttctactaaaaaaaaaaaaaaaaaaaaaaaattagctgggtgtggtggcaggcgcctgtagtcccagctacttgggaagctgaggcaggagaatggtgtgaacctgggatgtggaggttgcagtgagccgagatcgcgccactgcactccagcctgggtgacagagcgtgactttgtctcaaaaaagaaaaaaaaagtacaaaagagcaaaacaaaacaaaagttatgaaaatgaaaacctgagccatcgtttatcttatttccccaaatccactaattattaacagaaagtaaaagctatgaaaaatgaatgaaagtgactgcaatttccttgaagtgtgttagaacctgcctttagtgtcagctatgggttccctcatgaaggtcagctgagccatgacccatgaaccatggaagcttgactctagattgaccatcttgagatgccaaagatgtccacgtcctaatcccatgtgggagacagaataatggccctgcagaccttcccagctggccatgacccctcatttgaccaggtcagcggctgaccaccatcctgggtttgtttccccaaatcacctccctggggtcccctgccaggaatgtcctgggagaggcaaccttctcactgtgtgatattttctctcctgcagctcttcccttctctctgaccagcaccatgcttctcctggtgacaagccttctgctctgtgagttaccacacccagcattcctcctgatcccagagaaatcgggtaagtatggaaacctggctgaaccttctccgcggcccctgtttagatgtcctgcatctggagacccatctggatacctgggtccatctgcatttcatctctaatgtttatgagggacccaataagcaccagccaacccaccagaagctcagagctcctcttgttctcacctccttttctgctgttaattcccatccacccattctacagatgagaaaacggaggctcagatacctccacagtttaacccaacgaccatccaggtagtgatggggccaggatgaggacccatgtctgcatggggccaaagtgttccttccttccttcgttccttcgttccttcgttccttccttccttccttccttccttccttcgttccttccttcgttccttccttccttccttccttccttccctcccttgcttccttctcttcctcctgccctccctctttccatccttccttctctccttccttccatccttctctccctcctgattcatttcttctctttctttctcttccttccttccctccttccctttctctctttcttccttccattgtttccttctttccttccttcttccgtccctcccttctttctttctctttcttccttccctccttccctctctctctttcttccttccattgtttttctttctttccttccttccctccctccctccctctctctctctctttctttctttctttctcctttttttttctccttctttgtttctttcttcctctttcttctttctttctttctttctttccttctttctttttctttcttttcagagtctccctcttgttgcccaggctggagtgcaatggctcaatctcagctcactgcaaactcagcctcccgggttcaagcgattctcctgcctcagcctcccgagtagctgggattacaggcgcctgccaccaggcccagctaatttttttgtatttttagtagagatggggttttgtcatgttggccaggctggtctcaatctcctggcctcaggtgatcccgtgcctcggcctcccaaagtgctaggattacagctatgagccgccacacccagcctcttgtttgttgacttcttaatagcagccattgtgactggcgtggaatgatagctcattgtggttttgatttgcgtttccgggagggaccctcttgactgagggtgtcagggcctctgcttcaggaaagtatttccaggtttttgtgacctggttcagggaagacagacaaagacagctttctgtttctgcaattttctcaaattccttcagctttatattaaactgccaaggttccataatttgggaagtgtgttcagagccacatcactctggataaagagcctttgcctgttctcattcaagcggttttctttctctgtctctcttttttttttttttttttttttttttgagacaggatctcgctctgtctcccaggctggagtgcagtggcgtgatctcggctcactgcagcctcagctttctgggatcaagtatcctcccactccagcctcccaagtagctgggactgcagaaatacaccaccatgccaagctaatttaaattttttttttaattttatagaggagatcttgctatgttgccaagactagtttttgatttttttttttttttgagatggagtcttactctgtcacccaggctggagtgcagtggcgcgatctcggctcactgcagcctcagctttctgggatcaagtatcctcccactccagcctcccaagtagctgggactgcagaaatacaccaccatgccaagctaatttaaatttttttttttttaaattttatagacgagatcttgctatgttgccaagactagtttttgattttttttttttttttttttttgagatggagtcttactctgtctcccaggctggagtgcagtggcgcgatctcggctcattgcaacctccacctcccgggttcaaccgattctcctgcctcagcctcctgagtagctgggattacaggtacccgccaccatgtccacctaatttttttgtatttttagtagagacagggtttcaccacattggccaggctggtctcgaactgctgacctcaggtgatccgcccacctcagcctaccaaagtgctgggattgcaggcatgagccaccgcgcctggccagtttttgatgatttctgcagtaaacatctccatgtggagaaggagcaagctgggaccacagatgtgcaccatcacacctgcctaatttaaatttttaaaaaaaaattttttttaaagagatgcgatcttgctatgttgcccaggcgggatctgaacctactgggctcaagtcagctttttgcctcagcctcccaaggtgctgggattagaggcgtgagccaccacccccagtcttcagatgatttttgaatatttctgcagtagaaatctcctttttcagaaacagccagggggctgtgaaaaggagggaagatggacaagggaggaacagatacctgaggatgtgggacgtcctggggccatgtgggtgacagaggaaaatcagcaggcttcagccctgaacttcacctcccagagccgggtgggaggacagaaaacagggccggccgggcacggtggctcacgcctgttatcccagcacttcgggaggctgaggcaggcggatcacctgaggtcggcagttcgagaccagcctgaccaacatggtgaaacccccatctctactaaaaatacaaaaattagctgggcatggtggtcggcgcctgtcatcccagctactcgggaggctgaggcaggagaatcatttgaacccgggtggtggagcttgcagcttgcagtgacctgagatcacagcactgcactccagcctgggagacaaagccagactccgtctcaaaaaaaaaaaaaaaaaaaaaaaaaaaaaaggaaaagaaaagaggaaattctgaacccagtgcccgctccttgcagatctgcgaacagtggcaccagcctctagtctcaatgtgaggtttgactccaggacgatgaatttaagctgggactgccaagaaaacacaaccttcagcaagtgtttcttaactgacaagaagaacagagtcgtggaacccagggtgagacgaatttcccattctcaacccctgtcctttacacacccctttctgagttaaaagcaacagggccggctgggcgcggcggctcacgcctgtcatcccagcactttgggaggctgaggtgggcggatcacctgaggtcgggagttcaagaccagcctgaccaacatggtgaaaccccgtctctactacaaatacaaaattagccgggcgtgctggtgcatgcctgtagtcccagctactcaggaggctgagggcagaagaattactcgaacccgggaggtggaagttgcagtgagtcgagctcgtgccattgcactccagcctgggtgacagagcgagactctgtctcataaaatgcaataaggccgggtgtggtggctcacgcttgtcatcccagcactctgggaggccgaggcaggtggatcacctgaggtcaggagttcaagaccaggctgaccaacatggtgaaaccccatctctactaaaaatacaaaaattagtcgggcatggtggcaggcatctgtaatcccagctactcgggaggctgaggcaggagaattactgaaactcgggaggcggaggttgcggtgagccgagatggtgccattgcactccagcctgggcaacaagagcaaaactctgtctccaaaaaaaaaaaaaaataataaattcaattaaataaaagcgagagggccacagacacaaacaacacaagtgtggtatttggagaaatgtcacagccataatctcacgggaaccgggaaagtgctgttagctcatgtccacaatgtgtaccagagcctgattccctgaggcagagcctatgttaccgtattttaccccaagagaagagaaatcctggcaaatgcagttggatgtgcccctgggtctgtggtggaagcaggacggagaaaagtaaagtgtcagtcacgttgtcagtgtgtcaccgtcctggttccccaagggattaaggtcagggtttttggaacacaggagacagagacagaagagcggggagaggggagggaaggagggagaaacacagagaaaggatagaaggaggagggagaggaagagagaaatatggatgatcgatagataggtgatagatgatttattgactgataggtgataatagatgattggaagattgataatcaattctataggtagatgctacacggagggatgggtggtcttgctatgttaccccagatgacatactttttttttttttttttttttttgagatggagtttccctcttgttgcccaggctggagtacactggtgtgatcttggctcactgcaacctccacctcctgggttcaagcgattctcctatctcagcctcctgagtagctgggattacaggtgcgtgccaccacgcctggctaatttttgtatttttagtagagacggggtttcaccatgttggccaggctggtctccaactcctgacctcgtgatccaccctccttggcctcccaaagtgctggcattacaggtgtgagccaccgtgtccgacctttattttttgggatggagtctcgctctgtcgcccaggctggagtgcactggcgtgatctcagctccctgcaacctgtgcctcctgggttcaagagattctcctgcctcagcctcctgagtagctgggattacaggtgcccaccaccacacctggctaatttttgtatttttagtagagacggggtttcaccatgttggccaggctgatcttgaactcctgacctcaagtgatccacccgcctcggcctcccagagtgctggcattacaggtgtgagccactatgtccgaccctttttttggggggatggagtctctgtctgtcacccaggctggagtgcactggcgtgatctcagctcactgcaacctgtgcctcctgggttcaagagagtctcctgcctcagcctcccgagtagcagggattacaggtgcctgccaccacacctggctaatttttgtatttttagtagagacggggtttcaccatgttggccaggctggtcttgaactcctgacctcaagtgatccacccgccttggcctcccagagtgctgggattacaggtgtgagccacggcacctggcctctagtctggtactttcagcactgctagagtataagattgagttttcacctgcaagctggtattcagcgtatccactcagagccctcggaggaagcttagggggatgatttcacaaagggaggcaggtgcgtgtcgccaaatccaggtaaaaaccaataccatggccgggcatggtggctcacgcctgtaatcccagcactttgggaggccgaggcgggtggatcacctgaggtcaggagtttgagaccagcctggccaacatggtgaaaccctgtctctactacaaatacacaaattagcagggtgtggtggcgggtgtctgtaatccgagctactcgggaggctgaggcgggagaattgcttgaacctggaaggcggaggttgtagtgagccgagatcacgccactgcactccagcctgggagactgtaggagacagaaggttgtttcctaatcggctctgtctggttgcaattcttcagctcagtaacaacgaatgttcgtgcacatttcgtgaaatttgtctgcatgaaggagtcacatttgaggttcacgtgaatactagtcaaagaggatttcaacagaaactgctttatccaaattcaggtaagcaagacagctcagggatccgtttacagcactggccccaccaccccgccagcatcaaagtacatcccgttgaacttcggagtgaaaattattttgtttctacctcttcccaggaagggagggtaccgctgctcagaatttctcctgtttcatctacaatgcggatttaatgaactgtacctgggcgaggggtccgacggccccccgtgacgtccagtattttttgtacatacgaaactcaaagtaagtgttcacctcatgtgaagaattatgaggaatgcagggatgggagaaaaaatcatgctggttttctttttttcctttttctttttttaagacatggtcttgctctgttgcccaggctgcaatgcaatggtgccacctcggctcactgcaacctcgacctcctgggttcaagcaattttcctgcctcagcttcccaggtagctgggattacaggcgcccgccaccacaccaggccacatctatgtatttagagacagagtcttgctctgtcgcccaggctggagtgtagtgatgtgatctcagctccctgcaacctgcgcctccctccagggttcaagtgattctcctgcctcagcctcccaagtagctgggactacaggtgcactccaccacacctgtctaatttttgtatttttagtagagacagggtttcaccatgctggccaggctggtctccaactcctgacctcaagtgatctgcctgcctcaacctccccaaagtgctgggattacaggcgtgagccactgcacctggcctgtttttttggttgttgttttgttttgtgttttttgttttgttttgtgtttctttttgttttgccttgtgtttttgtgttcttgttttgttttgtgtttctgtgtttttcttttgtttttgtgtttttttggtttcacgtttttgtggtgttttgtgtttttgtgtttttgttttttgtgtttgtttttgttttgttttgtgttttgttttgtgtttgtttttgttttgttttgtggtttttgttttgtgttgtgtttgtttttgttttgtgtttttttgtttgtgttttggtgtttttgttttgtggttttcttttgtgtttgtttttgttttgtgtttttgtgtttttgtttcattttgttttgttttgtgtttttgtgttttgttttgttttgtgtttgtttttgttttgttttgtgtttttgtgtttttgttttgtgttttgtgtttttgtgttttgttttgttttgtgtttttgtgttttgtttttgtgttttgttttgttttgtgtttttgtgttttgttttgtgtttgtttttgttttgttttgtgtttttgtgtttttgttttgtgttttgtgttttgttttgtgtttttgtgttttgttttgttttgtgtttttgttttgttttgtgtttttgatttgtgtttttgtgttttgttttgtgtttgtttttgttttgtgttttgtgtttttatgttttgttttgtgtttgttttcgttttgttttgtgtttttgttttgtgttttgtgtttttgtgggttttttttgttttgtgtttttgttttgtgtttttgtgttttgtgtttttgtgttttgttttgtgtttgtttttgttttgttttgtgtttttgtgttttgttttgttttcctgattgctctctgagcactttctaatctttcaggagaaggagggagatccggtgtccttattacatacaagactcaggaacccatgtgggatgtcacctggataacctgtcaggattaacgtctcgcaattactttctggttaacggaaccagccgagaaattggcatccaattctttgattcacttttggacacaaagaaaataggtgagaataacacatatgattttcctattgtttataggtgaaatggaatttgccttaaaatctgtgtaactgaggccacgtgcggtgtctcacacctgtaatctcagcactttgggaggccgaggcgggccgatcacctgagatcgggtgttcaaaaccagcctgaccaacatggggaaaccccatctctactaaaaatacaaaaattagccgggcatggtggcgcgtgcctgtaatcccagctactcggaaggctgaggagaatcactcaaacctaggaggcggacgttgcaatgaggtgagattgtgccactgcactccagcttgagcgacagagcaagactctgtctcaaaaacaaacaaacaaaaatctgtgtaactttggtgctgtaacaaattagaactgagctgatttaactttcctttttttgagatagagtctcgctctgtcacccaggctggagtgcagtggtgcaatctcagctcactgcaacctctgcctcccaggttcaagcgattcttctgtcttagtctccttagtagcttggattacaggtgcacaccaccacgctcggctaatttttgtatttttagtagaggcagtgtttcaccatcttggccgggctagtctcgaactcctgacctcagatgatccacctgcctcagcctcccaaagtgctgggattacaggcgtcagccactgcacctgacctccctctttacctccttccttctttccttcctccctgcctttctgcctttcttcttttttcttccttccttccttccttccctccctccctcctttccttccttccttcctccttccctcccttcttccttccctccctccctctctccctcccttcttcattccttccttcttcctctccttccttctccttcactcatttcctccttccttcctctttttcttcatttcttcctcaccagcacctcttcgtgtcccagtgccctgctcctggctggcctcttggagccagtcccatatgcccacacgctctcctcttcccaagcccaccgcatcccacccgtggactccttcatcccgttggacgttcccagcctcttcaggcttaggactctcacagaagtgtgactcctgcccaccaagcccatccccacctcccaccctggaacccctgccccagtgggtatctctcctgtacatggtagctgccccacctccacttggacccagtgtagacaggaggagaccctgtaccacctccacctggacccagtgtagacaaagaggtgtccctactccacgtccacctggatccagtgtagacaggaggagactgcaccacctccacctggacccagtgtagtcaaagagatgtccctactccacgtccacctggacccagtgtagacaggaggagaccctgtaccacctccactttacccagtgtagacagaaggagaccctgcaccacctccacctggacccagtgtagacaaagaggtgtccctactccacatttacctggacacagtgtagacaggaggagactgcaccacctccacttggacccagtgtagacaggagaccctgcaccacctccacctggacccagtgtagacaaagaggtgtccctactccacgtccacctggacccagtgtagacaggaggagactgcaccacctccacctggacccagtgtagacaaagaggtgtccctactccacatttacgtggacacagtgtagacaggaggagaccctgccccacctctacctggacccagtgtgaaggcgaccagcccttccacacatgtgggtatttctcgtcaggtgggacgagagactgagaaaagaaataagacacagagacaaagtatagagaaagaacagtgagcccaggggaccggcgctcagcatacggaggacctgcaccggtctctgagttctctcagtatttattgcttactattttcactatcttggcaaggggaatgtggcaggaggacagggtgatagtggggagaaggtcagcaggaagacatatgagcaaaggaatctgtgtcacaaataagttcaagggaagctactatgcctggatgcacacgcaggccagatttatgcttctctccacacaaacatcagtgtagcaaagagtcacagagcagtattgccaccagcatatctcgcctccagccacagggcggttttctcctgtctcagaatagaacgaatgtacgatcgggttttacacggagacattccattcccaggggcaggcaggagacggagggcttcctcttatctcaaccgcgagaggacttcctcctcggcacagaccctttatggatgtcgggctgggggacggtcaggtctttttcccttcccacgaggccatatctcagactgtctcagtggggggaaccctcagacaatacccgggctctctcgggcagaggtccctgcggctttccgcagtgcatggtgtccctggttaatagagaatggagaatggcgatgacttttaccaagcatgctgcctgcaaacctattgttaacaagacacagcacatgtttctgtgagcacagtgttggggctacagttacagcttaacagcatctcaaggcaaaacagtggttcaacatacagatcacaatggagtttcttaccttcctttctacatagacacagtaacagtctgatctttctttttgtttgtttgtttgtttttctgagacagagtctcactctgtcgcccacccaggctggagggcagtggcgggatctcggctcactgcaacctccgcctcccgggttcacgccattctcctgcctcagcctcccgagtagctgggactacaggcacccgccaccacgcccggctaatttttttggatttttagtagagacggggtttcaccgtgttagccaggatggtctcgacctcctgacctcgtgatcctcccgcctcggcctcccaaagtgctgggattacaggcgtgagccaccgcgcccagccccctgatctctctttcttttccctacacagagtagacaaagaggtgtccctactccacatttacctggacccagtgtagacaggaggagaccctgccccacctccacctggacccagcgtagacaaagaggtgtttctactccatatctacctggacccagtgtagatgggaggagaccctgccccatctccacctggacccagtgtagacaaagaggtgtccctagtccacatccacctggaccgagtgtagacaggaggagaccctgccccacctccacctggacccagtgtagacaggagaagactctgcaccacctccacctggacccagtgtagacaggaggagaccctgccccacctccacctggacccagtgtagacaggagaagactctgccccatctccacctggacccagcgtagacaaagaggtgtttctactccatatctacctggacccagtgtagatgggaggagaccctgccccacctccacctggacccagtgtagacaggagaagactgcaccacctccacctggaccgagtgtagacaggaggagaccctgccccacctctacctggacccagtgtagacaggaggagaccctgccccatctccacctggacccagtgtagtcaaagaggtgtccctactccacctccacctggacccagtgtagacaggacctactccacctccacctggacccagtgtagacaggaggagactctgcaccacctccacctggacccagtgtagacaggacctctcgggttcaggggtgtgtcctgcgccctcgttacagaacgattcaaccctcccagcaatgtcaccgtacgttgcaacacgacgcactgcctcgtacggtggaaacagcccaggacctatcagaagctgtcgtacctggactttcagtaccagctggacgtccacagaaaggtcggtgagagctccccggggctgggcaccaggagggaggcgtacgggacacgcccgcacaggagcctgggaatcccggggaagtggcctgggggaaggatgcgtgggtggtgagcggtgactctggggtgaacgcacttcgggtagcggaggaagaggtgaagggtctgtggcctgtggagccaccttgaaagaggttgcagggagggtggacaaggatgatcctgcaaccatggaaccaggaagtggaccgggaggtgtgggggacgatgccacaagcaaggagagcctctgctccacctccagctggacgcagtgtagacagaaggagaccctgccccatgtctacctggacccagtgtagataggaggacacccgaccccacctccacctacacccagtgtagacaggaggagaccctgctccacctccatggagacccagtgtagacaggaggagttcttgtcccacaactacctggacccagtgtagacagggagagagactgcctcacgtccacctcgatccagtgtagacaagaggagatcttgtctcacaacctcctggacccagtgtagacaagaagagaccctgccccatgtccacctcgagccagtgtagacaagaggagatcttgtcccacaaccacctggacccagtgtagacaagaaggagagcctgctccatgtctacctggacgacaggagaacaccctgccccaaggccagtgggacctttctggatgggttacaggaagatatctggccaggaagacttctgtgtttgcagctcctcatcctacctgtcttgtagattcggggtttgtggagggagacctgcctgccactccgcagggactccttcccattcggtgcccacaccaggggagacactgtgtgaaccatctacagtgttttagaaatggaaacagtgagccttgtgttgtgttttgttttgtttctagaatacccagcctggcacggaaaacctactggtaagtgaaaccacagaccctactgacaaccctcagcgtaaccctacggtcccctactcaccacacctagtgtaactctacagtcccctactcatgacccctacagtcccctaccgacgacctccagcgtaaccctacggtcccctactcaccacacctagtgtaactctacagtcccctactcatgacccctacagtcccctactgacgacctccagcgtaaccctacagtcccctactcaccacacctagtgtaaggaggaggagaccctgccccacctccacagagacccagtatagacaggaggagctcttgtcccacaaccacctggaccccgtgtagacaggaagagaccctgccccacgtccacctagcttaatcctacagtcccctactcaccacacctaatgtaactctacagtcccctactcatgacccctacagtcccctaccgatgacctccagcgtaaccctacagtcccctactcaccacatctagtgtaactctacagtcccctactcacgacccccggagtaatcctacagtctcctactcacgacgcctacagttccctattcatgacccctagcgtaaccatacagtcccctacccatgagccctggcataaccctacaatcccctactcaccacacctagcataaacctacagtcccctacccatgacccctggagtaaccctacagtcccctagtcactacacctagtgtaactaaccatacagttccctatccatgacctctggcggaaccctacactcccctactcacaacccctagtgtaaccctacagtctcctacccatgacccctggcggaactgtacagtcccctactcacgacccctacactctcctacccatgacccctggcggaaccctacagtcccctactcacgacccgtacagtctcctacccatgacccctggcagaaccctacagtcccctactcacgacccctacactctcctacccatgacccctggcagaaccgtacagtcccctactcacgacccctacagtctcctacccatgacccctggcggaactgtacagtcccctactcacgacccctacagtctcctacccatgacccctggcggaactgtacagtcccctactcacgacccctacactctcctacccatgacccctggcggaaccctacagtcccctactcacgacccctacagtctcctacccatgacccctggaggaaccctacagtcccctactcacgacccctacagtctcctacccatgacccctggcggaactgtacagtcccctactcacgacccctacagtctcctacccatgacccctggcggaaccctacagtcccctactcacgacccgtacagtctcctacccatgacccctggcagaaccctacagtcccctactcacgacccctacactctcctacccatgacccctggcggaaccgtacagtcccctactcacgacccctacagtctcctacccatgacccctggcggaaccgtacagtcccctactcacgacccctacactctcctacccaagacccctggcggaaccctacagtcccctactcacgacccctacactttcctacccatgacccctggcggaaccctacagtcccctactcacgacccctacactctcctacccatgacccctggcggaaccctacagtcccctactcacgacccctacagtctcctacacatgacccctggcggaaccctacagtcccctactcacgacccctacagtctcctacccatgacccctggaggaaccctacagtcccctactcacgacccctacagtctcctacccatgacccctggcggaactgtacagtcccctactcacgacccctacagtctcctacccatgacccctggcggaaccctacagtcccctactcacgacccgtacagtctcctacccatgacccctggcagaaccctacagtcccctactcacgacccctacactctcctacccataacccctggcggaaccgtacagtcccctactcacgacccctacagtctcctacccatgacccctggcggaaccctacagtcccctactcacgacccctacagtctcctacccatgacccctggaggaaccctacagtcccctactcacgacccctacagtctcctactcatgacccctggagtaaccctacagtcccctactcacgacccctacagtctcctactcatgacccctggagtaaccctacagtcccctattcaggagccgtagtgtgaccctacaatcccctactcacaacccccggtggaaccctacagtcccctacccatgacccctggtggaaccctacagtcccctactcacgacccctacactctcctacccatgacccctggcggaaccctacagtcccctactcacgacccctacagtctcctacccatgacccctggcagaaccctacagtcccctactcacgacccctacactctcctacccatgacccctggcagaaccctacagtcccctactcacgacccctacagtctcctactcatgacccctggagtaaccctacagtcccctattcaggagccgtagtgtgaccctacaatcccctactcacaacccccggtggaaccctacagtcccctacccatgacctctggtggaaccctacagtcccctactcacgacccctacactctcctacccatgacccctggtggaaccctacagtcccctactcacgacccctacactctcctacccatgacctctggtggaaccctacagtcccctactcacgacccctacactctcctacccatgacccctggcggaaccctacagtcccctactcacgacccctacagtctcctacccatgacccctggcagaaccctacagtcccctactcacgacccctacactctcctacccatgacccctggcagaaccctacagtcccctactcacgacccctacagtctcctactcatgacccctggagtaaccctacagtcccctattcaggagccgtagtgtgaccctacaatcccctactcacaacccccggtggaaccctacagtcccctacccatgacctctggtggaaccctacagtcccctactcacgacccctacactctcctacccatgacccctggtggaaccctacagtcccctactcacgacccctacactctcctacccatgacctctggtggaaccctacagtcccctactcacgacccctagtgtaaccccacatgacccccagtgtaaccctatagtcccctacccacgacctatgtctgcctagacccagtgtgatcaggaggagaccccacctcacctccccctagacccagtgtagacaagaaggagagcctgccccacgtctacctggatccagtgtagacaggagaatactctgcccgacatacagttgaaccactcacaaccctagcgtcaccctacagtctccacgaaccctacagtcttggtttatgggactcttagtgccagtgtggcccaggggtggacacggtggatcctgaaccagaggatgcagatctcacacgggtgagggccccctcatagttctcactgggcagggtctgctcttggcctcaaccttcgtgtcccaatggttggaatatttatgctcagcctgttctactgattttcccattttattcctctttcctctacgtgggttaagaatatattctagtgactgtctaaggagattatgtctccctctaaaatgcttttagagtgagtactgttgccgggtatttaccaagtctcgcggccactctgaccctcggtatcctcctctgtccgatgagtatgctagacttggggatcttaatatcccttgctaaactatccgtctgaaggtctgttaatatcagttgttgatcctgaatcatttatttatgtatgtatttatttttgagacggagtctcgctctgtcccccaggctggagtgcagtggtgcgatctcggctcactgcaagctccacctcccagcgattgtcctgcctcagcctccctacagagattctacagtctcagcctgtagctgggactacaggcacccacccccacacctggccaacaatttctgtttcagaaaataaaattttagccaggcacggtggctcacgcctgtcatcccagcaccttgggaggctgaggtgggcggatcacttgaggtcagcagttcaagaccagcctgggcaacatggagaaaccccatctctactaaaaatacaaaacgtacccatgcgtggtggcgggcgcctgtaatcccagctacgtgggaggctgaggcaggagaatggcgtgaacccgggaagcggaggttgcggtgagcccagatcatgccattgcactccagcctgggcgacagagcgagagtgtctcaaataaaataaaataaaagaggccgggcgtggtggctcatgcctgtaatcccagcactttgtgaggccgaggcggtcggatcacgaggtgaggagatcgagaccatcctggccaacatggtgaaaccccgtctccactaaaaatacaacaaaaattagccgggcgtggtggtgggcacctgtagtcccaactactggggaggctgaggcaggagaatggtgtgaaccctggaggtggaggttgtagtgagccaagatcgcgccactgcactgcagcctgggtgacagagggagactccgtctcaaaaaataaataaataaaataaaataaaaaagcttaaagcctacatcacccaaattttcccaacttgtctcccatcgaaatactaacgaggcttgactctgcttagcttcgaagacccgatcagaccaagtgcattcagagtggtagaaaaaaaagaagaaaaagaaaaaaagaaaaggagaaaaaaacttaaaagacaaaagaacgaaaaaaggcaaccttttcctccacacagaagacgcctatctctaactttcttttttcctccaaagattaatgtttctggtgatttggaaaatagatacaactttccaagctctgagcccagagcaaaacacagtgtgaagatcagagctgcagacgtccgcatcttgaattggagctcctggagtgaagccattgaatttggtaagcgttgggcggaggtaagggatgtttgtgccgtctgcggccaccctgcagcaggcacagaggtcaggtgctctgtcctgggcgctgagatcgagttgagcacgtcgctgggagtagtgtcaggctctgagcttatcgctgaggctcaaaagaaggaggtggtctcgtacttggtcccgcaacattgctttgctgatgttttttcaggacggatgagttggctcccttaataaccagagaagggccaggtgcagcggttcacgcctgtaatcccagcaatttgggaggctgaggccggcggatcaccggaggtcaggagtttgagaccagcctggccaacatggtgaaaccccgtctctactaaaaatacaaaattagcccagcattgtggcaggtgcctgtaatcccagctactcgggaggctgaggcaggagaatcacttgaacccaggaggcggaggttgcactgagctgggatcacgccattgcactccagcctgggtgacagcgtgagactccgtctcaaaaaaaaaaagaaaaaaaaatacaaaaactaaccaggattggtggcacattcctgtaatcccagctactcaggaggctgagggcaggagaatgacttgaacccgggaggtggaggttgcagtgagctggggtcacgccattgcactccagcctgggtgacagagtgagactctgtctcaaaaaaaaaaaaaaaaaaaaaaagaaaaagtagaaggaggtggtctcatactcatacggggtcatgcaacattgctttgctggtgtttttttcagggtggatgagctagaatcccttaatagccagagaaggaccccactgatagccctcctaaagtcccacctccctctgctccactgggaaacaatcagtcagtctttgtccggtcaaaccgtcaccattccggctccctggccaaggggaagctctctccctctttttttcttttttttttttttttttttgagacggcgtttcgctcttgtcgcaggctggagtccagtggcgcaatctcggctcactgcaagctccacctcctgggttcacgccattctcctgcctcagcctccccagtagctgggactacaggtgcccatcaccacgcctggctaattttttgtatttttttttttttagtagagacagggtttcactgttttttagccaggatggtctcgatctcctgacctcgtgatccgcccacctcggcctcccaaagtgctgggattacaggcgtgagccaccgtgcccggccctccctcttttttttttttttttttttttagatggcgtttcgctcttgttgcccaggctggagtgcagtggtgccatctcggctcaccgcgatctccgcctcccaggttcaagcaattctccagcctcagtctcccgagtagctgggattacaggcgcccgccaccacacccggctaattttgtatttttagtagagacggggtttcaccatgttggtcaggctgttcttgaactcctgacctcaggtgatctgcccacctcgccctcccaaagtgctgcaatgacaggcgtgagccaccctgcccgtccggggaagctctcttcaaagccaggtctcggctgcccaggagacaggtctatgcttttctctgaagatgattttgagggctccaaattgaaaaggggaaggggcaggatattgagaagtatgcggttttcacctcaacaaagggtacagaagaaaaattgtgagctgcagtgcagtggtgcacctctacctcccagatcacacagacaaaatggggtacagggatgatcagaggtgcattcgtgtctggtgggccggggtgactgcacctgtaagaaattttttttgtttatttattttttgttatttgagacggactctcgctctgtcacccaggctggagtgcaatggcacgatctcagctcactacaacctctgcctcctgggttcaagcgattctcctgcctcagcctcccgagtagctgggattacattagacatgcatcacgcttggccaatttttgtatttttctttttatttatttatttatttattttgagatggagtttcgctgtgtcacccaggctggagttcaatggcacgatcttggctcactgcaacctccgtctcccaggctcaagcgattctcctgcctcagcctcctgagtagctacgattacagacatgcatcatgcttggccattttttaaatatttttatttatttatttattttgagacagggtctcactctgtcacccaggctggagtgcaatggcacgatctcggctcactgcaacctccgcctcccgggttcaagcgattctcctgcctcagcctcccgagtagctgggattacagacatgcatcacgcttggccaatttttgtatttttatttttatttatttatttatttattttgagatggagtttcgctgtgtcacccaggctggagtgcaatggcacgatcttggctcactgcaacctccgtctcccaggctcaagcgattctcctgcctcagcctcctgagtagctgggattacagacatgcatcatgcttggccattttttaaatatttttatttatttatttattttgacacagggtctcactctgtcacccaggctggagtgcaatggcacaatctcggctcactgcaacctccgtctcccaggctcaagcgattctcctgcctcagactcccaggtagataggattacaggcacccaccaccatgcctggctaattttgtattttttttttagcagagatgaggtttcaccatgttagtgaggcttgtctcgaactcctgacctcagatgatgcgcccgcctcggcctcccaaagtgctgggatgacaggtgtgagccaccgtgcctggcccaatttttgtatttttggtagagacggggtttcaccatgttggtcaggctggtctcgaactcccaacctcaggtgatcctcccgtgtcggcctcccaaagtgctgggatgacaggcgtgagccaccgcatccggcccatggtggcaaagttttaacagctcaccagaaatttccttgtgggcaaaacatagggcaggcaggttgctttcatctcagagccatcttagttaagaaccaaaaacagggaggcaggtttgctgggcccagttctcagcttgactgttccctttggctaaatgcatttggacacccgaagagatttaatttcctttcacatgtccgtcaacgattcaccgcagacgcaaacctgtgtgtctctccaggttctgacgacgggaacctcggctctgtgtacatttatgtgctcctaatcgtgggaacccttgtctgtggcatcgtcctcggcttcctctttaaaaggtaacctgtgaaacacctgggcctccccaatgaaaacaggccaggccgggaggaaagcgctttgtccagtctctgtctctgtctctgagaaagagaaacacagccttggccgggcgtgttggctcatgcctgtaatcccagcactctgggaggccgaggcgggtggatcacgaggtcaggagatcgagaccatcctggctaacacagtgaaaccccgtctctactaaaaaattagcccggcgtggtcgcgggcgcctgtagtcccagctactcgggaggctgaggcaggagaatcgcttgaacccgggaggtggaggttgcagtgagccgagattgcaccactgcactccagcctgggcgacagggcgagactccatctcaaaacaaacaaaagaacggagaaaacgggagatcctacaggaatacacagtgatgctcacagggaatctttctagaatcttccctcagcccctcgggcacagggatgggaatggaacaggcagtcagctgtgggcagcttcagggagtctgaagtcactgctgttgaagggctgagctccagaggggaaacgcctgccttgatcccactagccttgaagagcgtggtttctgggttggaggtgggtttttttttgtttgtttgtttttttgttttttgttttgagacagacttttgctcttgttgcccaggctggagtgcagtgttgcaatctcggctcactgcaacctccacctcccgggttcacgccattctcctgcctcagcctcccgagtagctgggattacaggcatgcaccacgatgctcacctaatttttgtatttttagtagagatggggtttcaccacgttggccaggctggtctctaactcttgacctcaggtgatccacccgccttcgcctcccaaagtgctgggattacaggtgtgagccaccatgcctggcctagttccttaagatgtttgtcatttggtgatttttttttgtttttttgagatggagtctcactctgtcacccaggctggagtgcagtggtgcaatctcggctcactgcaacctccacctcccaggttcaagcaattctcctgcctcagcctcctgaatagctgggattacaggcaagcaccacgatactcagctaatttttgtatttttagtagagacggggtttcaccacgttggccaggctggtctcaaacctcaagtgatccacccgcctcggcctcccaaagtgctgggattacaggtgtgagccactgcacccggcctagttccttaagattttcgtcacttggtgattcttagtgaagttttgcatagttgagcgcagacaccccgcacgcagcatccctcggcacagggcgttgatggaaggaactctggtgacccggggttcattctcttcacactttttctctgtgtctcaggttccttaggatacagcggctgttcccgccagttccacagatcaaagacaaactgaatgataaccatgaggtggaagacgaggtaggcaggggtgggcggagcagtgacctgggatggaaggtggggagtggggagcgtgggacacggcctctgggtgtcgaccatcttgcttctccaccagatgggaccgcagcgtcaccaccggtgtggctggaatctgtatcccactcctgggccttctcccgggtcggggtcttctccaaggttggggtcagagtcatctctgtgagctccatcaggagaaactgaggcagggtggtggtcaagaaaaggaggagaagacggtagagagggccaggcacggtggctcatgcctgtcatcccagcactttgggaggttgaggcatgtggatcatctgaggtcagaggttcgagaccagcctggccaacgtggtgaaaccccatctctgctaaaaatacaaaaaattagctgggtgtggtggtgtacgcctgaaatcccagtgactcgggaggctggggcagtagaacggcttgaacccagggggcggaggttgcagtgagccgagatcgcaccactgcactccagcctgggtgacagagcgagactccatctcaaaagaaaaaagaaggtagagaggagaggcagaaatagagacaagagacagaggcagagaaagatggagggagagagatggaggagagagagaggaatgtagaagagaatgaggagacacaaaagagagggaaacaggcagacagactgacagaaacaaaggcagacacacagacagagaaacagagagagggagggagaaaagggagaaggaaagagagagacacgagacacagatggagaaacagagacagataaacaacaaacataaagacccaggcgggggccggtcgcggtgactcacatctgtcatcccagcactttgggaggccgaggcgggtggatcacttgaggtcgggagttcgagaccagcctgaccaacctgaagaaacctcgtctctactaaaattgcaaaaattagccaggtgtggtggcgcacacctgtaatcccacctactctggaggctgaggcaggagaatcacttgaacccaggaggcggaggctgcagtgagccgagatcgcaccattgcactctaacctgggcaacagagcaaaactctctatcaaaaacaaaacaaaacaaaaaaatcatccccagcagggagaggagagagacagagaggaacagaggcacagagaggggagagagacaaagacagagagacacagagaaagacacagaaaaagagagagagagggagaaggagacatagagacagggacaaagagaaaaagacggacagagagagaaacagagagacataggtggacacagagaggggagagagagagagagacagaaagagacagagagcaagggatgggagtggaagagagagacagatggaggaaaaagacagagagggaggcagataaaagacacacagagacaccgagagagacagggaagacagaggagtcggacttagtctcagcgagagcccagagagggtgaacaagggcgaggaaccatgtgacctgcaccctgagaccccattggcgctcctctcccacccacctctctccggctcagggactgcgtcttatgttgcagtaggctggcaggctggaaagtcaggccagggctgatgctgcatcccagaggcagaactgtcctgcattctcagagtgggagatgaaatttttaaaaaggaaataaaactcttgtcggggaacctcagcttttatcctttagacgtttgactgattagaccaggcccactcttctcctttacactttcggctgattgaatgaggcccacccttccccctttacaccttcgactgattagatgaggcccaccattcccctttagaccttcgactgatcagatgaagcccacccttcccctttagaccttcagcttattagataaggcccacccttaccctttagactttcaactgattaaatgaggcccactctccccgtttagacctttgactgattagatgaagcccacgcttctcctttggaccttcaactgattagatgaggcccacccttcccccttcagcctttcgactgattagatgaggcccaccctcccctttataccttcgactgattagatgaggcccaccctcccctttataccttcgactgattagatgaggcccaccctcccctttataccttcgactgattagatgaggcccgtccttcccccatttagatcttcaactgattagatgaggcccacctttccctttttagacctttgactgattagatgaggcctacccttctccctttagacctttgactgattagatgaggcctacccttctccctttagacctttgactgattagatgagacccacccttcccatttagaccttcaactcattagatgaagcccacccttccccccttcccctttagaccttcagcttattaattagacaaggcccaccccctttagaccttcaactgattagatgaggcccacccctcttcagaccttcaactgattagatgaggcccaccccctttagacctttgactgattagataaggcccacccacattctccagtccaatctcttttcctggaaatcagctgattgtggacttgacatctacaaagccccttcgtagcagccgctgagtcatggtttcattcaataactggggactgtagcctagtcacggggacacgtcattggtgccgggtatcagagacgaaggccaagagatgaaagagaaacagagactgaacccaaaagaggcagacacacaggaagatggagatagagacccagagatgggggtggaagaaggtgagagggggaggaaagagagacagagagggagacagagaaaagaggcagagagaccgagagagaggctgaacagcaagaccccagagagggtgactaagggtgagagacttgcgtgacccacatcccaagaccccgtgggtggccctctcccacccacctctctccagctcaggggctgtgtcttcctcccatggggaactccagttgcagcccagggttgcccccagcgccctcttctctgccacataggtaacatcctcctggttgccacttgcacacccccatcctagacctggccatctgtcattccattaccttccacccccacgccagcctcctccccggcccccgctttccactgacccccaggggtcccccacatcgaggtgccaggatgacggcttcaggcttcaaccttcccttctctgagctccatcagctccaggggcttagcacctgctgtaccctgcccaggtttcatgctcacaagctcttccaaagaccaccctgttcatcgtcaactatgaggtcccatgggtggatctgtctcagatctttaccccaggaaaaacccatggccaggtgcagtggctcatgcctgtcatcccagcactttgggaggccgaggcgagtggatcacctcgaggtcaggagtttgagaccagcctggccaacatggtaaaaccccatctccactgaaagtacaaaatttagctggtggcggctaaagggggaaaggtgggcctcatctaatcagtcgaaggtctaaagggggaagagtgggcctcatctgatcagtcaaatttgtggtggcgggcgcctgtaatcccagctactcaggaggctgaggcaggagaatcgcttgaacccgggaggccgaggttgcagtgagctgagatgacaccactgcactccagcctgggcaatagaatgagactccgtctcgagggagaaaaagaaaataaacacagcccactgagtcccaggctgagctcgtgaagatctgacagcctgaaccctcctttttctcagatcatctgggaggaattcaccccagaggaagggaaaggctaccgcgaagaggtcttgaccgtgaaggaaattacctgagacccagagggtgtaggaatggcatggacatctccgcctccgcgacacgggggaactgttttcttgatgatgctgtgaacctttatatcattttctatgtttttatttaaaaacatgacatttggggccaggcgcggtggctcacgcctgtaatcccagcactttgggaggccaaggcaggcggatcacctgaggtcaggagttcaagaccagcctgcccaacatggtgaaaccccatctggactaaaaatgcagaaatttacccaggcacggcggcggacgcccatcatcccagctacttgggaggctgaggcaggagaattgcttgaacccgtgaggcggaggttgtagtgagccaagatcgcaccattgcacaccaacctgcgtgacagagcaagattgcatctcaaaacaaacaataataataaataataaaaacctga

SEQ ID NO: 2849 - DNA, 41135 bp, human; identical to SEQ ID NO: 2847

SEQ ID NO: 2850 - DNA, 41089 bp, human; identical to SEQ ID NO: 2844

SEQ ID NO: 2851 - DNA, 41089 bp, human; identical to SEQ ID NO: 2844

SEQ ID NO: 2852 - DNA, 21597 bp, human
tccgagagaagaaaagcaggtggaaggagaggaagcggatgccgtgggggtaagctaagttctttccttctgtggtctttgagcatgtcgagtcacccgggtacatgtttctgctgtgtctgtcgatagaaaagaaagagactgaactggaacataagatttcaaacgttggctcgagccgaagtggggacagcggcccagaagactgagagccaaggaaccttgcatatgagttgtcttctgcctttgttatatgcaggtttttaaaggcaaaattaaaaaaataaaataaaataaaaagagggaggtgttgttggaggacagggagggggcttctgtgaagctgtttgctgggaattctcgttggtttacagaaaaaaacaattgattaatgattggctgtacattgctaagctacagggcgttggggtgtagtatctagcacggaattatcacgtgaattcacagctatctgtggcatccggaagccgtttcgagagatgaacgcggccgggcgtggtggctcacgcctgtaatcccagcactttgggagactgaggcgggtggatcacctgaggtcgacagttcgagaccatcctggccaacatggagaaaccccgtctctactaaaaatacaaaattagccgggcatggtggtggcaggcacctgtaatcccacctactcaggaggctgaggcaggagaatcgtttgaacccgggaggcggagcttgcagtgagctgagattgcaccactgcactccagcctgggcaacaagacgagattctgtctcaaaaaaaagaaaaagaaaaaaaaagagatgaaaagagatgaacgcagagctgaaagggggagggagtgtgatggtgttactagttactagaaaggggtcctgatccagacttcaagaacgggttctgggatcttgcccaagaaagaactggaggcaagttcacattgcaaactgaaagcaagcttattaagatagtaaaggggggccgggcacggtggctcatgcctgtaatcccaacacttttggaggctgaggcgggcggatcacctgagctcaggagttcgagatcagcttggccaacatggcaaaaccacacctttattaaaaatagaaaaaattagctaggtgtggcagtgtgtgcctgtaatcccagctacttgggaggctgaggcaggagaatcgcttgaacccgggaggcggaggttgcagtgagcccagattgcaccgttgcactccagcctgggcaacaagagcaaaactctgtccccaaaaaaagataactaaaagaaaaaagtcgtggggagagatgctccactacaagggtgactgataaaggattcatctttgtcatgactatcttttgcagtaatcaatattgtatatatacatattatatattttttattattattattttgagatcatctggctgtgtcatccaggctggagggcagtggtgcaatcacagctgactgctgtcttgaattcctgggctcaagcaatcctcccatctcggcctcccgagtagctgggtcaaaggcaaatgccaccattcctggcaaatatttgtatttttgtagggacgagggtttcactgtgtttcccgggctggtcttgaactcctagactcaatctatcttcctgccccagcctcccaaagtggtgggatgacaggtgtgggccaccgcgcctggcccaatattatcatttttaaagcaaaacggattctcacactatgaaagcttttgttctgaagatatcaacacatcaggaggtttctgtgtctgttcagtcctcggtctgtttagtaaacagtattgatctgttcacatatcttgcgtcaggaatggctgacctccagggaatgctgcccagcctgtcccagcctccctgttcccagcccctattctagatggagtccctctaagctgggcgtggtgtaatcccaggactttgggaggctgaggtgggcggatcacctgaggtcaggagttcgagaccagcctggccaacagggtgaaaccccatctctactaaaaatacccaaaattagccggggcgtggtggcgggcgcctgtaatcccaatattttggaaggctgaggtgacagaggattgcttgaggccacagcaattccagaccagcccggggcaacatcgtaagattcccccatccctcgtgtataaaaaaaagattaaattattacaaattttaaaaaagacagaaatgaagcatcttaagttaccacccagattggggtactaagagtctggatttggacagcttgttgcgcgttttataggtgtgctaaatcacatttcactctttttgttgagacagagtctcgtgctgtcgcccaggctggagggcagtggcgcgatctctgctcaccgcaacctccgcctcctgggttcaagcaattctcctgcctcagcctcctgagtagctgggattacaggcacctgccaccacgcccggctaatttttgtattttttttttttttttttttttttggagacagcgtcttgctctgtcgcccaggctggagtgcagtggtgcaatctccgctcactgcaacctccacctcccgggttcaagcaattctcctgcattagcctcctgagtagctaggattacaggcacgtgccaccatgcccagctaatttttgaatttatttatttatttttttggagacagtatcttgctctgttgcccaggctggagtgcagtggtgcgatctcggctcactgtaacctccgcctcccgggttcaagtgattctcctgcctcagcctcctgggtagctgggattacaggtgtgtgctaccatgcccggctaatttttgtatttttagtagggatggtgtttcaccatgttggccaggctggtctggaactcctgacttcaaatgatccgctcaccttgacctcccaaagggctgggattacagacatgaaccacggagcccggccggatttcactctttagatttttggtttaaactcgagaagctcttctcgagggctgaaagctcttggtcccctgtaggtttgctgtagatgacagacatgaggcagattgattaataagagaaaagacatgcactttttttttcttttttttttttgagacggagtctcgctctgtcaccgaggctggagtgcactggcatgatctcggctcactgcaacctccaccttccaggttcaactgattctcctgcctcagcctctccagtagctgggattacaggcgtgtgctaccatgcctggctaatttttctatttttagtagagacagggttgttccatattggtcaggctggtctcgaacacctgacctcaggtgatccgcctgcctcggcctcccagtgtgctaggattacaggcgtgaaccactgtacccagccagatttacacatttatagaatgtgtatacacaagattcttcagaatgaggactccaccccacaatgaggttcagaagctagtacaccacattgagactacagaaggataggggattggatcctggtacaaaaaaaaaaaggttatagggttggggggaaagaggaattctattgaggagcaatatataatttctactgcggactgaactctgatttttttctttattttattttattttattttatttttttgagacagcatctcactctgccgcccaggctggagtgcagtggtgcgatctcagctcactgcaacctccacctcctgggttcacccgattttcctgcctcagcctcccgagtagctgcgattacaggcacccgccactacgcccagctaattttctttgtatttttagtagagacggggtttcaccatgttggccaggctggtcttgaactcctgacctcaggtgatccaacctcctcggcctcccaaagtgctgggattatacgcatgagccactgcacctagcttcttctttttctttttttttttctttctttttttcttttttttttttagatggagtctaactttgtcgcccagactggagtacagtggcacaatctcagctcaccacagcctccacctcccaaggtcaagcaattctcctgcctcagcctcccaagtagctgagattacaggcacgtaccactactgcctgagtaatttttgtgtttttagtagagacaacatttcaccaggttggccaggctggtctcgaactcctgacctcaagtgatccacacgcctcagcctcccaaagtgctaggattataggcaccagccaccacaccgggcctctgactttttttatcttgcccaaattcctatctaagaggtctgaggaggcaagccctacaaaccataaattctcatcaaatgggatttattgaaccctgtatatcgtgacttactttccaacctgactctggcaaacgttacaagacagagaaaaaaaacaacatatgttgccccaaaatatgtttcttagttgtattttttttttcttttaagatggtctcattctgtttccaaggctggagtgcagtggtgcaatcttggctccctgcaacctccgtcttctaggttcaagcgattctcctgcctcctcagccttccaaatagctggcgtaatatgcatgagccatcgtgcccagataattgttttttgttttttgttttttttttagtagagatggggtttcactgtgatggccaggctggtcttgaactcctgacctcaggtgatccaaccgcctcggcctcccaaagtgctgggattataggcgtgaaccactgctcccggctggagtacaggggcataatcttggctcactgcagcctctgcttcccaggttcaagtgattctcctgcctcagtctcccgagtagctgggactacaggcgcccgccaccacgcccagctaatttttttttttttttttgtattttttttttttagtagagatggggtttcactgtgtttgccaggatggtctcgatctcctggcctcatgatctgcccgcctcggcctcccgaagtgctgggatgacaggcgtgagtcaccgcgcccggcatgaaagggtttttcattaaaaatccttgttataccgtggagccctgtgttggggtaaaatatcatgatttccctcactctccatcattcttgctttgaatctgagaaggaagcttggcggcctctattttaggatcagccgaaaatttccagaaaggggaaagaaaactcattctgtaaacacaaaaaagaagaagagaaaaaagtataagcggtacagacaaaacgcaaagatgttgcataattttccgtgagtgcaaaatgtcctgtaaaccaaaaaagaggtatctgagacaggtctcagtccatttagaaagttcattttgccgaggttaaggacgcctgcccatgacagagcctcaggaaatcgcgatgacaggtgctgtggatacacagggcacaatttgctttcatacatttttttggcggggagggagctggggatccagtcttgttctgtcacccaggctgcagtgcaatggtgcaatctcagctcactatcactgtaacctccgcctcccgtgttcaagctattctcctgccacagccttctgagtagctgggattataggcacccactaccgcgcccagctaatttttgtatttttagtagagacggggtttcaccatgttggccaggatggtctcgaactcctggcctcaaatgatccacctgcctcggcctcccaaagtgctgggattataggcgtgagccatggcgcccagccctggtatgtaatttttaaaacctttgtagtaccttatttacgaataaaatgcgaggcaggtttgcctaagacagtttccactataacctttcatgattttggggtcctgagacttatttacctttcacagtttacagcaggaaaatccgtggagacagcagatccgagaagcggcgatgtttgcgtagaaccctgtacgtgcttccttcggcctgtcggtaatgtggttggggattttcttttttttaagtgaagtctaaagaactgaaatgttttgctccataatgatgaaccaggatagaagtgagaactcagggcagaagaatctgaatgaggaactgtctgacctatgacaaatttaacatgtcacgttccctctgagacagtacacatcctcctgaagcagcgtgacaaggcacatcctcctgaagggtctccaggcagaagagacgcatgaacctgtcaaaaaaaaaaaaaaaaagagccggccgggcgcagtggctcaagcctgtaatcccagcactgtgggaggctgaggcggggggatcatgaggtcaggagttccagaccagcctggccaacatggtgaaaccccatctctgctaaaaatacaaaaattagccgggtgtagtggcagttgcctctagtcccagctactccggaggccgaggcaggagaatcgcttgaacccaggaggcgtaggttgcagtgagccaagatcgcgccactgcactccagcctgggcaacagagcgacagtccgtcccaaacactgcaaaatatttaaagagatttattctgagccaaatatgagtgagcaagaaggcccagggaaaatagtctaaagagatcctgagaacacgtatccaagctggttgagcggcagtttggttttatatgtttttgtttgtttacttattttactttattttatttatttatttatttattttgagatgaagccttgctcagtctgttaggctggagtgcagtggcgcgatctcggctcactgcaacctccgcctcccgggttcacgccattctcctgcctcagcctcccgagtagctgggactacaggcgcccaccaccatgcccagctaattttttgtatttttagtagagaaggggtttcaccgtgttagccaggatggtctcgatctcctgacttcgtgatccgcccgcctcagcctcccaaagtgttgggattacaggcacccgccaccacgcccggccaatttttgtatttttagtagcgacggggtttcaccatgttggccaggctggtctcaaacttgtgacctcacatgatctgctcacctcggcctcccaaagtgctgggattacaggcgtaagccacagcgtccagctattttattttatttgttttattttttgtgacagagtctcactctgtcgcccaggctggagtgcagtggagcgatctcagctcactgcaacctctgcctccggagctgaagcaattctcccgcctcagcctcccaagtagctggcattacagaggtacgccaccacgcctggctaaattttgtttgtttgtttgtttgtttgtttgtttgtttttgtttttcagtagacacagggtttcactatgttggccaggctggtctcgaactcctgacctcacatgatctgcctgcctcagcctccagaagtactgggattacagccgtgagccacctcacccagccagcagcttggttttatgtttgtttatatatttatttatttatttatttttaatttttggagacggagtcttgctctgttgcctgggctggagtgcagtggcatgatcttggctcacggcaacctctgcctttcgagttccagtgattctcctgcctcagcctcgcgagtagctgggagtacaggcgcccgccatcacacccggctagtatttgtatttttagtagagagagggtttcaccgtattgtccaggctggtcttgaactcctgtcctcaagtgatccacccacctgagcctctcaaagtgctgggattgcaggcgtgagcctctgtggccagccaacagacagttttgcaggaccatttcaaaatatgtcaagtaaatatattttggggtgaaatgtattttaaagtggcatatactgatttcccacagtcttgtctggggaggcatatcctggcctcctagaaagcatacacagtagcagacaggtgtggtggctcacgcctgcaatcccagccctttgggaggccgaggcaggtggatcacaaggtcaggagatcgagaccatcctggccaacatggtgaaatgctatctctactaaaaatacaaaaattagctgggcgtggtggtgcatgcctgtaatcccagctactcgagaggctgaggcaggaggaccacttgaacctggcaggtggaggttgcagtgagctgagatcacgccactgcactccagcctgggagacagagcgaggctccgtctctaaataaataaataaagcttacgcagtagctgagaagacagggaaaagaggtgaagaaatgacagaaagcttagaagtcgctcattataaccccttcctaccccatctcatgcttcccttaaagcataaacgaagggtgcttgtgttacaggaaaggggttcggatccagcccccaagagggggttcttggatctcacgcaagaaagaattcagggcggccgggcgctgtggctcacacctgtaatcccagcaccttgggaggcagaggcgggcggatcacgaggtcaggagttcgagaccagcctgaccaacatggtgaaaccccatctctactaaaaatacaaaaattagccaggtgtggtggtgcgtgcctgtagtcccagctactcgggagacagaggcaagagaatggcgtgaacccgggaggcgatgcttgcagtgagtggagatcatgccactacactccagcctgggcgatagagtaagtccatctcaaaaaaaaaaaaaaaaaaaaaaaattcggggtgagtcagcagtgcaaagccaaagcaaatttattacaaaagtaaaacagtgaaagaatagctactccagaggccgggcgcagtggctcatgcctgtaatcccagcactttgggaggtggaggtgggcagatcacctgaggtcaggagttcgagaccagcctgaccaacatggtgaaaccccatctctactaaaaatacaaaaattagccaggcatggtggtgcgtgcctgtagtcccagctactcgggaggctgaggcagtagaattgcttcaacttgggagacggaggttgcagtgagccgagatggcaccactgcactccagcctgggcaacagaatgagactcagtctcaaaaaaaaaaaaaaaaatttcagggcgagcaagtttattatgaaagtaaaatagtgaaagactaggtactccagaggccaggcgcagtggctcatgcctataatcccagcactttgggagcccgaggcaggtggatcacctgaggtcaggagttcgagaccagcctcgccaacatggtgaaaccccatctctactaaaaatacaaaaattagccaggcatggtggtgcgtgcctgtagtcccagctacttggaggctgaggcagtagaattgcttcaacttgggagacggaggttgcagtgagccaagatggcaccactgcactccagcctgggcgacagaatgagactcagtctcaaaaaaacaaaagatttcagggcgagcaagtttattatgaaagtaaagtagtggaagactagctactccagaggccaggtgcagtggctcatgcctataatcccagcactttgggagcccgaggcaggtggatcacctgaggtcaggatttcgagaccagcctcgccaacatggtgaaaccccatctctactaaaaatacaaaaattagccaggcgtgttggtgcgtgcctgtagtcccagctactcggaggctgaggcagtagaattgcttcaacttgggagacggaggttgcagtgagccgagatggcaccactgcactccagcctgggtgacagaatgagactcagtctaaaaaaaaaaaaaattcagggcaagcaagtttattatgaaagtaaaatagtgaaagactaggtaatccagaggctgggtgcagtggctcatgcctataatcccagcactttgggagcccaaggcatgtggatcacctgaggtcagaagttcgagaccagcctggccaacatggtgaaaccccatctctactaaaaatacaaaaattagccaggcgtgttggtgcgtgcctgtagtcccagctactcggaggctgaggcagtagaatcacttgaacctaggagacagaggttgcagtgagccgagatggcgccactgtactccagcctgggcgacagagtgagactccatctccaaaaaataaataaataagtcaaccaagaaggccgtacgtacagtggctcacacctgtcatcccatcactttgggaggccgaggcagggggattacttgagatcaggagtttgagaccagcctggccaacatggtgaaaccccgtctctactaaaaatacaaaaattagccaggcgtgttggtgcgtgcctgtagtcccagctactcggaggctgaggcagtagaatggcttcaacttgggagacggaggttgcagtgagccgagatggcaccactgcactccagcctgggcgacagagcaagaccgtctacaaaataataataataattaataataataataataactagtgcaagagaagtacacaaatatcccaaacatttagtgactcagcagagggggccagtctcaaggaacaggacttctacacctgttaccaccacctggggagttgtatctgaatctcaaggtcaggcccacccagacagaacatgcatctctagggtgccacaggagagtctgtccagtgcccagaaacacctgcaagacccagaagcaggctccaagaagcggggtgccacagtccagtgggggaagcggccacatccctgtcatgtgggctacagatgagttggggggcaggggcaggagaagaagaaacaggtgtggcctacatgcttttacttcctcttagcaagcgaggttcctcttgcagaggaacggtctgagagacacaaccgttttttttttttgtttgtttgcttttccttgagacagagtctccctctgtcacccaggctggagggcagtggcgcgatctcggctcactgcagcctccacctcctgggttcaagcgattctcctgcctcaacctcccgagtagctgggattacaggcacccaccaccccacccggctaatttttgtatttctagtatagatgaggtttcaccgtattagccaagctggtcccgaactcctgacctcaggcgatccgcctgccttggcctcccaaagtgctgggattacaggcgtgagccactgtgcccggccgagagacgcaatctttcagagaggaggtttggagcaggaacctcagggtggacagatgggtcccaccaggtgcagatgcttgaactaaagatgctacaaaggccgggtgcagtggttcatgcctgtaattccagcagtttgagaagctgaggcaggcagatcatctgaggtcaggagttcgagcccagcctggccaacatggcaaaacagcgtctctactaaaaatgcaaaattagcctggcataatggcgggcgcctataatcccagctacttgggaggccgaggcaggagaatcgcttgaacccgggaggcggaggttgcagtgagccaagattgcaccactgcactccagcctgggtgacaagagtgaaactccgtctcaaaaaaaaaaaaaaaaaaagaagaagaagaaaagaaatacattagtttggtccataaaggcgggacaactcaaagtgggggcttccaggctataaatgaatttaaacattttctggttgacaattggttgagtttgtagctcctcctccttctcttcttcctcctccttctccccccttcctcctcttcctcctcttcctcctcctccttcttcttctcttctttcttcttcttctctttccccttcttcttcttcttcctcctccttctcctcctcctttttcttcttcttccttatgggcttggatagaagtatattgacatggatccaccatttgtagaatcataccgagtagcttcttttctcctccttcctctccttctcctcctcctcctcctccttctcctgctccttctcctcctcctcctcctgctccttctcctcctcctcctccttctcctcctcctcctcctgcttctcctcctcctccttctcctcctcctgcttctcctcctcctccttctcctcctcctccttctcctcctcctccttctcctcctcctcattctcctcctgctccccttctcctcctccttctcctcctcctccttctcctcctgctccccttctcctcctccttctcctcctcctcctcctcctgctcctcctcctccagctccccttctcctcctactcctccttctcctccttctccttctcctccttctcctactcctccttctcctactcctccttctcctactcctccttctcctcttccttcttctcctcctcctgctccttctcctcctcttcctcctactcctccttctcttccttctcctcctcctccttctcctcctcctccttctcctcttcctccttctcctcctcctccttctcctcctcctccctctcctcctcctccgccttctcctactcctccttctcctcctccttcttctcctcctcctgctccttctcctcctcctccttctcctcctgctccttctcctcctcttcctcctactcctccttctcttccttctcctcctcctccttctcctcctcctgcacctttcctcctcctccttctttttccttttttgcataaagaagtatcaaataagagtagtttcactgccctaaacatcctctgaggtccatgtattcatccctccatctgcccaacgccaaccaactccggatctttttactgtttccatgattttgtcttttccacagtgtccaagtgttagaatgactcagtctgcagccatctcaaagtggattctttcccttagtcataagtatttaaacttcattcatgtcgttttatgtactcaccctttttttcttcctcttcttttttttttttttttcactttccttttatagctgttgcaaaagtcaagattttttaaaaaatataaaagagcagggccgggcacggtggctcacgcctgtaatcccagcactttgggaggccgaggcaggtggatcacgaggtcaggagatggagaccatcctggctaacacggtgaaagcctgtttctactaaaaaaaaaaaaaaaaaaaaaaaattagctgggtgtggtggcaggcgcctgtagtcccagctacttgggaagctgaggcaggagaatggtgtgaacctgggatgtggaggttgcagtgagccgagatcgcgccactgcactccagcctgggtgacagagcgtgactttgtctcaaaaaagaaaaaaaaagtacaaaagagcaaaacaaaacaaaagttatgaaaatgaaaacctgagccatcgtttatcttatttccccaaatccactaattattaacagaaagtaaaagctatgaaaaatgaatgaaagtgactgcaatttccttgaagtgtgttagaacctgcctttagtgtcagctatgggttccctcatgaaggtcagctgagccatgacccatgaaccatggaagcttgactctagattgaccatcttgagatgccaaagatgtccacgtcctaatcccatgtgggagacagaataatggccctgcagaccttcccagctggccatgacccctcatttgaccaggtcagcggctgaccaccatcctgggtttgtttccccaaatcacctccctggggtcccctgccaggaatgtcctgggagaggcaaccttctcactgtgtgatattttctctcctgcagctcttcccttctctctgaccagcaccatgcttctcctggtgacaagccttctgctctgtgagttaccacacccagcattcctcctgatcccagagaaatcgggtaagtatggaaacctggctgaaccttctccgcggcccctgtttagatgtcctgcatctggagacccatctggatacctgggtccatctgcatttcatctctaatgtttatgagggacccaataagcaccagccaacccaccagaagctcagagctcctcttgttctcacctccttttctgctgttaattcccatccacccattctacagatgagaaaacggaggctcagatacctccacagtttaacccaacgaccatccaggtagtgatggggccaggatgaggacccatgtctgcatggggccaaagtgttccttccttccttcgttccttcgttccttcgttccttccttccttccttccttccttccttcgttccttccttcgttccttccttccttccttccttccttccctcccttgcttccttctcttcctcctgccctccctctttccatccttccttctctccttccttccatccttctctccctcctgattcatttcttctctttctttctcttccttccttccctccttccctttctctctttcttccttccattgtttccttctttccttccttcttccgtccctcccttctttctttctctttcttccttccctccttccctctctctctttcttccttccattgtttttctttctttccttccttccctccctccctccctctctctctctctttctttctttctttctcctttttttttctccttctttgtttctttcttcctctttcttctttctttctttctttctttccttctttctttttctttcttttcagagtctccctcttgttgcccaggctggagtgcaatggctcaatctcagctcactgcaaactcagcctcccgggttcaagcgattctcctgcctcagcctcccgagtagctgggattacaggcgcctgccaccaggcccagctaatttttttgtatttttagtagagatggggttttgtcatgttggccaggctggtctcaatctcctggcctcaggtgatcccgtgcctcggcctcccaaagtgctaggattacagctatgagccgccacacccagcctcttgtttgttgacttcttaatagcagccattgtgactggcgtggaatgatagctcattgtggttttgatttgcgtttccgggagggaccctcttgactgagggtgtcagggcctctgcttcaggaaagtatttccaggtttttgtgacctggttcagggaagacagacaaagacagctttctgtttctgcaattttctcaaattccttcagctttatattaaactgccaaggttccataatttgggaagtgtgttcagagccacatcactctggataaagagcctttgcctgttctcattcaagcggttttctttctctgtctctcttttttttttttttttttttttttttgagacaggatctcgctctgtctcccaggctggagtgcagtggcgtgatctcggctcactgcagcctcagctttctgggatcaagtatcctcccactccagcctcccaagtagctgggactgcagaaatacaccaccatgccaagctaatttaaattttttttttaattttatagaggagatcttgctatgttgccaagactagtttttgatttttttttttttttgagatggagtcttactctgtcacccaggctggagtgcagtggcgcgatctcggctcactgcagcctcagctttctgggatcaagtatcctcccactccagcctcccaagtagctgggactgcagaaatacaccaccatgccaagctaatttaaatttttttttttttaaattttatagacgagatcttgctatgttgccaagactagtttttgattttttttttttttttttttttgagatggagtcttactctgtctcccaggctggagtgcagtggcgcgatctcggctcattgcaacctccacctcccgggttcaaccgattctcctgcctcagcctcctgagtagctgggattacaggtacccgccaccatgtccacctaatttttttgtatttttagtagagacagggtttcaccacattggccaggctggtctcgaactgctgacctcaggtgatccgcccacctcagcctaccaaagtgctgggattgcaggcatgagccaccgcgcctggccagtttttgatgatttctgcagtaaacatctccatgtggagaaggagcaagctgggaccacagatgtgcaccatcacacctgcctaatttaaatttttaaaaaaaaattttttttaaagagatgcgatcttgctatgttgcccaggcgggatctgaacctactgggctcaagtcagctttttgcctcagcctcccaaggtgctgggattagaggcgtgagccaccacccccagtcttcagatgatttttgaatatttctgcagtagaaatctcctttttcagaaacagccagggggctgtgaaaaggagggaagatggacaagggaggaacagatacctgaggatgtgggacgtcctggggccatgtgggtgacagaggaaaatcagcaggcttcagccctgaacttcacctcccagagccgggtgggaggacagaaaacagggccggccgggcacggtggctcacgcctgttatcccagcacttcgggaggctgaggcaggcggatcacctgaggtcggcagttcgagaccagcctgaccaacatggtgaaacccccatctctactaaaaatacaaaaattagctgggcatggtggtcggcgcctgtcatcccagctactcgggaggctgaggcaggagaatcatttgaacccgggtggtggagcttgcagcttgcagtgacctgagatcacagcactgcactccagcctgggagacaaagccagactccgtctcaaaaaaaaaaaaaaaaaaaaaaaaaaaaaaggaaaagaaaagaggaaattctgaacccagtgcccgctccttgcagatctgcgaacagtggcaccagcctctagtctcaatgtgaggtttgactccaggacgatgaatttaagctgggactgccaagaaaacacaaccttcagcaagtgtttcttaactgacaagaagaacagagtcgtggaacccagggtgagacgaatttcccattctcaacccctgtcctttacacacccctttctgagttaaaagcaacagggccggctgggcgcggcggctcacgcctgtcatcccagcactttgggaggctgaggtgggcggatcacctgaggtcgggagttcaagaccagcctgaccaacatggtgaaaccccgtctctactacaaatacaaaattagccgggcgtgctggtgcatgcctgtagtcccagctactcaggaggctgagggcagaagaattactcgaacccgggaggtggaagttgcagtgagtcgagctcgtgccattgcactccagcctgggtgacagagcgagactctgtctcataaaatgcaataaggccgggtgtggtggctcacgcttgtcatcccagcactctgggaggccgaggcaggtggatcacctgaggtcaggagttcaagaccaggctgaccaacatggtgaaaccccatctctactaaaaatacaaaaattagtcgggcatggtggcaggcatctgtaatcccagctactcgggaggctgaggcaggagaattactgaaactcgggaggcggaggttgcggtgagccgagatggtgccattgcactccagcctgggcaacaagagcaaaactctgtctccaaaaaaaaaaaaaaataataaattcaattaaataaaagcgagagggccacagacacaaacaacacaagtgtggtatttggagaaatgtcacagccataatctcacgggaaccgggaaagtgctgttagctcatgtccacaatgtgtaccagagcctgattccctgaggcagagcctatgttaccgtattttaccccaagagaagagaaatcctggcaaatgcagttggatgtgcccctgggtctgtggtggaagcaggacggagaaaagtaaagtgtcagtcacgttgtcagtgtgtcaccgtcctggttccccaagggattaaggtcagggtttttggaacacaggagacagagacagaagagcggggagaggggagggaaggagggagaaacacagagaaaggatagaaggaggagggagaggaagagagaaatatggatgatcgatagataggtgatagatgatttattgactgataggtgataatagatgattggaagattgataatcaattctataggtagatgctacacggagggatgggtggtcttgctatgttaccccagatgacatactttttttttttttttttttttttgagatggagtttccctcttgttgcccaggctggagtacactggtgtgatcttggctcactgcaacctccacctcctgggttcaagcgattctcctatctcagcctcctgagtagctgggattacaggtgcgtgccaccacgcctggctaatttttgtatttttagtagagacggggtttcaccatgttggccaggctggtctccaactcctgacctcgtgatccaccctccttggcctcccaaagtgctggcattacaggtgtgagccaccgtgtccgacctttattttttgggatggagtctcgctctgtcgcccaggctggagtgcactggcgtgatctcagctccctgcaacctgtgcctcctgggttcaagagattctcctgcctcagcctcctgagtagctgggattacaggtgcccaccaccacacctggctaatttttgtatttttagtagagacggggtttcaccatgttggccaggctgatcttgaactcctgacctcaagtgatccacccgcctcggcctcccagagtgctggcattacaggtgtgagccactatgtccgaccctttttttggggggatggagtctctgtctgtcacccaggctggagtgcactggcgtgatctcagctcactgcaacctgtgcctcctgggttcaagagagtctcctgcctcagcctcccgagtagcagggattacaggtgcctgccaccacacctggctaatttttgtatttttagtagagacggggtttcaccatgttggccaggctggtcttgaactcctgacctcaagtgatccacccgccttggcctcccagagtgctgggattacaggtgtgagccacggcacctggcctctagtctggtactttcagcactgctagagtataagattgagttttcacctgcaagctggtattcagcgtatccactcagagccctcggaggaagcttagggggatgatttcacaaagggaggcaggtgcgtgtcgccaaatccaggtaaaaaccaataccatggccgggcatggtggctcacgcctgtaatcccagcactttgggaggccgaggcgggtggatcacctgaggtcaggagtttgagaccagcctggccaacatggtgaaaccctgtctctactacaaatacacaaattagcagggtgtggtggcgggtgtctgtaatccgagctactcgggaggctgaggcgggagaattgcttgaacctggaaggcggaggttgtagtgagccgagatcacgccactgcactccagcctgggagactgtaggagacagaaggttgtttcctaatcggctctgtctggttgcaattcttcagctcagtaacaacgaatgttcgtgcacatttcgtgaaatttgtctgcatgaaggagtcacatttgaggttcacgtgaatactagtcaaagaggatttcaacagaaactgctttatccaaattcaggtaagcaagacagctcagggatccgtttacagcactggccccaccaccccgccagcatcaaagtacatcccgttgaacttcggagtgaaaattattttgtttctacctcttcccaggaagggagggtaccgctgctcagaatttctcctgtttcatctacaatgcggatttaatgaactgtacctgggcgaggggtccgacggccccccgtgacgtccagtattttttgtacatacgaaactcaaagtaagtgttcacctcatgtgaagaattatgaggaatgcagggatgggagaaaaaatcatgctggttttctttttttcctttttctttttttaagacatggtcttgctctgttgcccaggctgcaatgcaatggtgccacctcggctcactgcaacctcgacctcctgggttcaagcaattttcctgcctcagcttcccaggtagctgggattacaggcgcccgccaccacaccaggccacatctatgtatttagagacagagtcttgctctgtcgcccaggctggagtgtagtgatgtgatctcagctccctgcaacctgcgcctccctccagggttcaagtgattctcctgcctcagcctcccaagtagctgggactacaggtgcactccaccacacctgtctaatttttgtatttttagtagagacagggtttcaccatgctggccaggctggtctccaactcctgacctcaagtgatctgcctgcctcaacctccccaaagtgctgggattacaggcgtgagccactgcacctggcctgtttttttggttgttgttttgttttgtgttttttgttttgttttgtgtttctttttgttttgccttgtgtttttgtgttcttgttttgttttgtgtttctgtgtttttcttttgtttttgtgtttttttggtttcacgtttttgtggtgttttgtgtttttgtgtttttgttttttgtgtttgtttttgttttgttttgtgttttgttttgtgtttgtttttgttttgttttgtggtttttgttttgtgttgtgtttgtttttgttttgtgtttttttgtttgtgttttggtgtttttgttttgtggttttcttttgtgtttgtttttgttttgtgtttttgtgtttttgtttcattttgttttgttttgtgtttttgtgttttgttttgttttgtgtttgtttttgttttgttttgtgtttttgtgtttttgttttgtgttttgtgtttttgtgttttgttttgttttgtgtttttgtgttttgtttttgtgttttgttttgttttgtgtttttgtgttttgttttgtgtttgtttttgttttgttttgtgtttttgtgtttttgttttgtgttttgtgttttgttttgtgtttttgtgttttgttttgttttgtgtttttgttttgttttgtgtttttgatttgtgtttttgtgttttgttttgtgtttgtttttgttttgtgttttgtgtttttatgttttgttttgtgtttgttttcgttttgttttgtgtttttgttttgtgttttgtgtttttgtgggttttttttgttttgtgtttttgttttgtgtttttgtgttttgtgtttttgtgttttgttttgtgtttgtttttgttttgttttgtgtttttgtgttttgttttgttttcctgattgctctctgagcactttctaatctttcaggagaaggagggagatccggtgtccttattacatacaagactcaggaacccatgtgggatgtcacctggataacctgtcaggattaacgtct

SEQ ID NO: 2853 - DNA, 31729 bp, human
ctcagaagcgggagtctccgagagaagaaaagcaggtggaaggagaggaagcggatgccgtgggggtaagctaagttctttccttctgtggtctttgagcatgtcgagtcacccgggtacatgtttctgctgtgtctgtcgatagaaaagaaagagactgaactggaacataagatttcaaacgttggctcgagccgaagtggggacagcggcccagaagactgagagccaaggaaccttgcatatgagttgtcttctgcctttgttatatgcaggtttttaaaggcaaaattaaaaaaataaaataaaataaaaagagggaggtgttgttggaggacagggagggggcttctgtgaagctgtttgctgggaattctcgttggtttacagaaaaaaacaattgattaatgattggctgtacattgctaagctacagggcgttggggtgtagtatctagcacggaattatcacgtgaattcacagctatctgtggcatccggaagccgtttcgagagatgaacgcggccgggcgtggtggctcacgcctgtaatcccagcactttgggagactgaggcgggtggatcacctgaggtcgacagttcgagaccatcctggccaacatggagaaaccccgtctctactaaaaatacaaaattagccgggcatggtggtggcaggcacctgtaatcccacctactcaggaggctgaggcaggagaatcgtttgaacccgggaggcggagcttgcagtgagctgagattgcaccactgcactccagcctgggcaacaagacgagattctgtctcaaaaaaaagaaaaagaaaaaaaaagagatgaaaagagatgaacgcagagctgaaagggggagggagtgtgatggtgttactagttactagaaaggggtcctgatccagacttcaagaacgggttctgggatcttgcccaagaaagaactggaggcaagttcacattgcaaactgaaagcaagcttattaagatagtaaaggggggccgggcacggtggctcatgcctgtaatcccaacacttttggaggctgaggcgggcggatcacctgagctcaggagttcgagatcagcttggccaacatggcaaaaccacacctttattaaaaatagaaaaaattagctaggtgtggcagtgtgtgcctgtaatcccagctacttgggaggctgaggcaggagaatcgcttgaacccgggaggcggaggttgcagtgagcccagattgcaccgttgcactccagcctgggcaacaagagcaaaactctgtccccaaaaaaagataactaaaagaaaaaagtcgtggggagagatgctccactacaagggtgactgataaaggattcatctttgtcatgactatcttttgcagtaatcaatattgtatatatacatattatatattttttattattattattttgagatcatctggctgtgtcatccaggctggagggcagtggtgcaatcacagctgactgctgtcttgaattcctgggctcaagcaatcctcccatctcggcctcccgagtagctgggtcaaaggcaaatgccaccattcctggcaaatatttgtatttttgtagggacgagggtttcactgtgtttcccgggctggtcttgaactcctagactcaatctatcttcctgccccagcctcccaaagtggtgggatgacaggtgtgggccaccgcgcctggcccaatattatcatttttaaagcaaaacggattctcacactatgaaagcttttgttctgaagatatcaacacatcaggaggtttctgtgtctgttcagtcctcggtctgtttagtaaacagtattgatctgttcacatatcttgcgtcaggaatggctgacctccagggaatgctgcccagcctgtcccagcctccctgttcccagcccctattctagatggagtccctctaagctgggcgtggtgtaatcccaggactttgggaggctgaggtgggcggatcacctgaggtcaggagttcgagaccagcctggccaacagggtgaaaccccatctctactaaaaatacccaaaattagccggggcgtggtggcgggcgcctgtaatcccaatattttggaaggctgaggtgacagaggattgcttgaggccacagcaattccagaccagcccggggcaacatcgtaagattcccccatccctcgtgtataaaaaaaagattaaattattacaaattttaaaaaagacagaaatgaagcatcttaagttaccacccagattggggtactaagagtctggatttggacagcttgttgcgcgttttataggtgtgctaaatcacatttcactctttttgttgagacagagtctcgtgctgtcgcccaggctggagggcagtggcgcgatctctgctcaccgcaacctccgcctcctgggttcaagcaattctcctgcctcagcctcctgagtagctgggattacaggcacctgccaccacgcccggctaatttttgtattttttttttttttttttttttttggagacagcgtcttgctctgtcgcccaggctggagtgcagtggtgcaatctccgctcactgcaacctccacctcccgggttcaagcaattctcctgcattagcctcctgagtagctaggattacaggcacgtgccaccatgcccagctaatttttgaatttatttatttatttttttggagacagtatcttgctctgttgcccaggctggagtgcagtggtgcgatctcggctcactgtaacctccgcctcccgggttcaagtgattctcctgcctcagcctcctgggtagctgggattacaggtgtgtgctaccatgcccggctaatttttgtatttttagtagggatggtgtttcaccatgttggccaggctggtctggaactcctgacttcaaatgatccgctcaccttgacctcccaaagggctgggattacagacatgaaccacggagcccggccggatttcactctttagatttttggtttaaactcgagaagctcttctcgagggctgaaagctcttggtcccctgtaggtttgctgtagatgacagacatgaggcagattgattaataagagaaaagacatgcactttttttttcttttttttttttgagacggagtctcgctctgtcaccgaggctggagtgcactggcatgatctcggctcactgcaacctccaccttccaggttcaactgattctcctgcctcagcctctccagtagctgggattacaggcgtgtgctaccatgcctggctaatttttctatttttagtagagacagggttgttccatattggtcaggctggtctcgaacacctgacctcaggtgatccgcctgcctcggcctcccagtgtgctaggattacaggcgtgaaccactgtacccagccagatttacacatttatagaatgtgtatacacaagattcttcagaatgaggactccaccccacaatgaggttcagaagctagtacaccacattgagactacagaaggataggggattggatcctggtacaaaaaaaaaaaggttatagggttggggggaaagaggaattctattgaggagcaatatataatttctactgcggactgaactctgatttttttctttattttattttattttattttatttttttgagacagcatctcactctgccgcccaggctggagtgcagtggtgcgatctcagctcactgcaacctccacctcctgggttcacccgattttcctgcctcagcctcccgagtagctgcgattacaggcacccgccactacgcccagctaattttctttgtatttttagtagagacggggtttcaccatgttggccaggctggtcttgaactcctgacctcaggtgatccaacctcctcggcctcccaaagtgctgggattatacgcatgagccactgcacctagcttcttctttttctttttttttttctttctttttttcttttttttttttagatggagtctaactttgtcgcccagactggagtacagtggcacaatctcagctcaccacagcctccacctcccaaggtcaagcaattctcctgcctcagcctcccaagtagctgagattacaggcacgtaccactactgcctgagtaatttttgtgtttttagtagagacaacatttcaccaggttggccaggctggtctcgaactcctgacctcaagtgatccacacgcctcagcctcccaaagtgctaggattataggcaccagccaccacaccgggcctctgactttttttatcttgcccaaattcctatctaagaggtctgaggaggcaagccctacaaaccataaattctcatcaaatgggatttattgaaccctgtatatcgtgacttactttccaacctgactctggcaaacgttacaagacagagaaaaaaaacaacatatgttgccccaaaatatgtttcttagttgtattttttttttcttttaagatggtctcattctgtttccaaggctggagtgcagtggtgcaatcttggctccctgcaacctccgtcttctaggttcaagcgattctcctgcctcctcagccttccaaatagctggcgtaatatgcatgagccatcgtgcccagataattgttttttgttttttgttttttttttagtagagatggggtttcactgtgatggccaggctggtcttgaactcctgacctcaggtgatccaaccgcctcggcctcccaaagtgctgggattataggcgtgaaccactgctcccggctggagtacaggggcataatcttggctcactgcagcctctgcttcccaggttcaagtgattctcctgcctcagtctcccgagtagctgggactacaggcgcccgccaccacgcccagctaatttttttttttttttttgtattttttttttttagtagagatggggtttcactgtgtttgccaggatggtctcgatctcctggcctcatgatctgcccgcctcggcctcccgaagtgctgggatgacaggcgtgagtcaccgcgcccggcatgaaagggtttttcattaaaaatccttgttataccgtggagccctgtgttggggtaaaatatcatgatttccctcactctccatcattcttgctttgaatctgagaaggaagcttggcggcctctattttaggatcagccgaaaatttccagaaaggggaaagaaaactcattctgtaaacacaaaaaagaagaagagaaaaaagtataagcggtacagacaaaacgcaaagatgttgcataattttccgtgagtgcaaaatgtcctgtaaaccaaaaaagaggtatctgagacaggtctcagtccatttagaaagttcattttgccgaggttaaggacgcctgcccatgacagagcctcaggaaatcgcgatgacaggtgctgtggatacacagggcacaatttgctttcatacatttttttggcggggagggagctggggatccagtcttgttctgtcacccaggctgcagtgcaatggtgcaatctcagctcactatcactgtaacctccgcctcccgtgttcaagctattctcctgccacagccttctgagtagctgggattataggcacccactaccgcgcccagctaatttttgtatttttagtagagacggggtttcaccatgttggccaggatggtctcgaactcctggcctcaaatgatccacctgcctcggcctcccaaagtgctgggattataggcgtgagccatggcgcccagccctggtatgtaatttttaaaacctttgtagtaccttatttacgaataaaatgcgaggcaggtttgcctaagacagtttccactataacctttcatgattttggggtcctgagacttatttacctttcacagtttacagcaggaaaatccgtggagacagcagatccgagaagcggcgatgtttgcgtagaaccctgtacgtgcttccttcggcctgtcggtaatgtggttggggattttcttttttttaagtgaagtctaaagaactgaaatgttttgctccataatgatgaaccaggatagaagtgagaactcagggcagaagaatctgaatgaggaactgtctgacctatgacaaatttaacatgtcacgttccctctgagacagtacacatcctcctgaagcagcgtgacaaggcacatcctcctgaagggtctccaggcagaagagacgcatgaacctgtcaaaaaaaaaaaaaaaaagagccggccgggcgcagtggctcaagcctgtaatcccagcactgtgggaggctgaggcggggggatcatgaggtcaggagttccagaccagcctggccaacatggtgaaaccccatctctgctaaaaatacaaaaattagccgggtgtagtggcagttgcctctagtcccagctactccggaggccgaggcaggagaatcgcttgaacccaggaggcgtaggttgcagtgagccaagatcgcgccactgcactccagcctgggcaacagagcgacagtccgtcccaaacactgcaaaatatttaaagagatttattctgagccaaatatgagtgagcaagaaggcccagggaaaatagtctaaagagatcctgagaacacgtatccaagctggttgagcggcagtttggttttatatgtttttgtttgtttacttattttactttattttatttatttatttatttattttgagatgaagccttgctcagtctgttaggctggagtgcagtggcgcgatctcggctcactgcaacctccgcctcccgggttcacgccattctcctgcctcagcctcccgagtagctgggactacaggcgcccaccaccatgcccagctaattttttgtatttttagtagagaaggggtttcaccgtgttagccaggatggtctcgatctcctgacttcgtgatccgcccgcctcagcctcccaaagtgttgggattacaggcacccgccaccacgcccggccaatttttgtatttttagtagcgacggggtttcaccatgttggccaggctggtctcaaacttgtgacctcacatgatctgctcacctcggcctcccaaagtgctgggattacaggcgtaagccacagcgtccagctattttattttatttgttttattttttgtgacagagtctcactctgtcgcccaggctggagtgcagtggagcgatctcagctcactgcaacctctgcctccggagctgaagcaattctcccgcctcagcctcccaagtagctggcattacagaggtacgccaccacgcctggctaaattttgtttgtttgtttgtttgtttgtttgtttgtttttgtttttcagtagacacagggtttcactatgttggccaggctggtctcgaactcctgacctcacatgatctgcctgcctcagcctccagaagtactgggattacagccgtgagccacctcacccagccagcagcttggttttatgtttgtttatatatttatttatttatttatttttaatttttggagacggagtcttgctctgttgcctgggctggagtgcagtggcatgatcttggctcacggcaacctctgcctttcgagttccagtgattctcctgcctcagcctcgcgagtagctgggagtacaggcgcccgccatcacacccggctagtatttgtatttttagtagagagagggtttcaccgtattgtccaggctggtcttgaactcctgtcctcaagtgatccacccacctgagcctctcaaagtgctgggattgcaggcgtgagcctctgtggccagccaacagacagttttgcaggaccatttcaaaatatgtcaagtaaatatattttggggtgaaatgtattttaaagtggcatatactgatttcccacagtcttgtctggggaggcatatcctggcctcctagaaagcatacacagtagcagacaggtgtggtggctcacgcctgcaatcccagccctttgggaggccgaggcaggtggatcacaaggtcaggagatcgagaccatcctggccaacatggtgaaatgctatctctactaaaaatacaaaaattagctgggcgtggtggtgcatgcctgtaatcccagctactcgagaggctgaggcaggaggaccacttgaacctggcaggtggaggttgcagtgagctgagatcacgccactgcactccagcctgggagacagagcgaggctccgtctctaaataaataaataaagcttacgcagtagctgagaagacagggaaaagaggtgaagaaatgacagaaagcttagaagtcgctcattataaccccttcctaccccatctcatgcttcccttaaagcataaacgaagggtgcttgtgttacaggaaaggggttcggatccagcccccaagagggggttcttggatctcacgcaagaaagaattcagggcggccgggcgctgtggctcacacctgtaatcccagcaccttgggaggcagaggcgggcggatcacgaggtcaggagttcgagaccagcctgaccaacatggtgaaaccccatctctactaaaaatacaaaaattagccaggtgtggtggtgcgtgcctgtagtcccagctactcgggagacagaggcaagagaatggcgtgaacccgggaggcgatgcttgcagtgagtggagatcatgccactacactccagcctgggcgatagagtaagtccatctcaaaaaaaaaaaaaaaaaaaaaaaattcggggtgagtcagcagtgcaaagccaaagcaaatttattacaaaagtaaaacagtgaaagaatagctactccagaggccgggcgcagtggctcatgcctgtaatcccagcactttgggaggtggaggtgggcagatcacctgaggtcaggagttcgagaccagcctgaccaacatggtgaaaccccatctctactaaaaatacaaaaattagccaggcatggtggtgcgtgcctgtagtcccagctactcgggaggctgaggcagtagaattgcttcaacttgggagacggaggttgcagtgagccgagatggcaccactgcactccagcctgggcaacagaatgagactcagtctcaaaaaaaaaaaaaaaaatttcagggcgagcaagtttattatgaaagtaaaatagtgaaagactaggtactccagaggccaggcgcagtggctcatgcctataatcccagcactttgggagcccgaggcaggtggatcacctgaggtcaggagttcgagaccagcctcgccaacatggtgaaaccccatctctactaaaaatacaaaaattagccaggcatggtggtgcgtgcctgtagtcccagctacttggaggctgaggcagtagaattgcttcaacttgggagacggaggttgcagtgagccaagatggcaccactgcactccagcctgggcgacagaatgagactcagtctcaaaaaaacaaaagatttcagggcgagcaagtttattatgaaagtaaagtagtggaagactagctactccagaggccaggtgcagtggctcatgcctataatcccagcactttgggagcccgaggcaggtggatcacctgaggtcaggatttcgagaccagcctcgccaacatggtgaaaccccatctctactaaaaatacaaaaattagccaggcgtgttggtgcgtgcctgtagtcccagctactcggaggctgaggcagtagaattgcttcaacttgggagacggaggttgcagtgagccgagatggcaccactgcactccagcctgggtgacagaatgagactcagtctaaaaaaaaaaaaaattcagggcaagcaagtttattatgaaagtaaaatagtgaaagactaggtaatccagaggctgggtgcagtggctcatgcctataatcccagcactttgggagcccaaggcatgtggatcacctgaggtcagaagttcgagaccagcctggccaacatggtgaaaccccatctctactaaaaatacaaaaattagccaggcgtgttggtgcgtgcctgtagtcccagctactcggaggctgaggcagtagaatcacttgaacctaggagacagaggttgcagtgagccgagatggcgccactgtactccagcctgggcgacagagtgagactccatctccaaaaaataaataaataagtcaaccaagaaggccgtacgtacagtggctcacacctgtcatcccatcactttgggaggccgaggcagggggattacttgagatcaggagtttgagaccagcctggccaacatggtgaaaccccgtctctactaaaaatacaaaaattagccaggcgtgttggtgcgtgcctgtagtcccagctactcggaggctgaggcagtagaatggcttcaacttgggagacggaggttgcagtgagccgagatggcaccactgcactccagcctgggcgacagagcaagaccgtctacaaaataataataataattaataataataataataactagtgcaagagaagtacacaaatatcccaaacatttagtgactcagcagagggggccagtctcaaggaacaggacttctacacctgttaccaccacctggggagttgtatctgaatctcaaggtcaggcccacccagacagaacatgcatctctagggtgccacaggagagtctgtccagtgcccagaaacacctgcaagacccagaagcaggctccaagaagcggggtgccacagtccagtgggggaagcggccacatccctgtcatgtgggctacagatgagttggggggcaggggcaggagaagaagaaacaggtgtggcctacatgcttttacttcctcttagcaagcgaggttcctcttgcagaggaacggtctgagagacacaaccgttttttttttttgtttgtttgcttttccttgagacagagtctccctctgtcacccaggctggagggcagtggcgcgatctcggctcactgcagcctccacctcctgggttcaagcgattctcctgcctcaacctcccgagtagctgggattacaggcacccaccaccccacccggctaatttttgtatttctagtatagatgaggtttcaccgtattagccaagctggtcccgaactcctgacctcaggcgatccgcctgccttggcctcccaaagtgctgggattacaggcgtgagccactgtgcccggccgagagacgcaatctttcagagaggaggtttggagcaggaacctcagggtggacagatgggtcccaccaggtgcagatgcttgaactaaagatgctacaaaggccgggtgcagtggttcatgcctgtaattccagcagtttgagaagctgaggcaggcagatcatctgaggtcaggagttcgagcccagcctggccaacatggcaaaacagcgtctctactaaaaatgcaaaattagcctggcataatggcgggcgcctataatcccagctacttgggaggccgaggcaggagaatcgcttgaacccgggaggcggaggttgcagtgagccaagattgcaccactgcactccagcctgggtgacaagagtgaaactccgtctcaaaaaaaaaaaaaaaaaaagaagaagaagaaaagaaatacattagtttggtccataaaggcgggacaactcaaagtgggggcttccaggctataaatgaatttaaacattttctggttgacaattggttgagtttgtagctcctcctccttctcttcttcctcctccttctccccccttcctcctcttcctcctcttcctcctcctccttcttcttctcttctttcttcttcttctctttccccttcttcttcttcttcctcctccttctcctcctcctttttcttcttcttccttatgggcttggatagaagtatattgacatggatccaccatttgtagaatcataccgagtagcttcttttctcctccttcctctccttctcctcctcctcctcctccttctcctgctccttctcctcctcctcctcctgctccttctcctcctcctcctccttctcctcctcctcctcctgcttctcctcctcctccttctcctcctcctgcttctcctcctcctccttctcctcctcctccttctcctcctcctccttctcctcctcctcattctcctcctgctccccttctcctcctccttctcctcctcctccttctcctcctgctccccttctcctcctccttctcctcctcctcctcctcctgctcctcctcctccagctccccttctcctcctactcctccttctcctccttctccttctcctccttctcctactcctccttctcctactcctccttctcctactcctccttctcctcttccttcttctcctcctcctgctccttctcctcctcttcctcctactcctccttctcttccttctcctcctcctccttctcctcctcctccttctcctcttcctccttctcctcctcctccttctcctcctcctccctctcctcctcctccgccttctcctactcctccttctcctcctccttcttctcctcctcctgctccttctcctcctcctccttctcctcctgctccttctcctcctcttcctcctactcctccttctcttccttctcctcctcctccttctcctcctcctgcacctttcctcctcctccttctttttccttttttgcataaagaagtatcaaataagagtagtttcactgccctaaacatcctctgaggtccatgtattcatccctccatctgcccaacgccaaccaactccggatctttttactgtttccatgattttgtcttttccacagtgtccaagtgttagaatgactcagtctgcagccatctcaaagtggattctttcccttagtcataagtatttaaacttcattcatgtcgttttatgtactcaccctttttttcttcctcttcttttttttttttttttcactttccttttatagctgttgcaaaagtcaagattttttaaaaaatataaaagagcagggccgggcacggtggctcacgcctgtaatcccagcactttgggaggccgaggcaggtggatcacgaggtcaggagatggagaccatcctggctaacacggtgaaagcctgtttctactaaaaaaaaaaaaaaaaaaaaaaaattagctgggtgtggtggcaggcgcctgtagtcccagctacttgggaagctgaggcaggagaatggtgtgaacctgggatgtggaggttgcagtgagccgagatcgcgccactgcactccagcctgggtgacagagcgtgactttgtctcaaaaaagaaaaaaaaagtacaaaagagcaaaacaaaacaaaagttatgaaaatgaaaacctgagccatcgtttatcttatttccccaaatccactaattattaacagaaagtaaaagctatgaaaaatgaatgaaagtgactgcaatttccttgaagtgtgttagaacctgcctttagtgtcagctatgggttccctcatgaaggtcagctgagccatgacccatgaaccatggaagcttgactctagattgaccatcttgagatgccaaagatgtccacgtcctaatcccatgtgggagacagaataatggccctgcagaccttcccagctggccatgacccctcatttgaccaggtcagcggctgaccaccatcctgggtttgtttccccaaatcacctccctggggtcccctgccaggaatgtcctgggagaggcaaccttctcactgtgtgatattttctctcctgcagctcttcccttctctctgaccagcaccatgcttctcctggtgacaagccttctgctctgtgagttaccacacccagcattcctcctgatcccagagaaatcgggtaagtatggaaacctggctgaaccttctccgcggcccctgtttagatgtcctgcatctggagacccatctggatacctgggtccatctgcatttcatctctaatgtttatgagggacccaataagcaccagccaacccaccagaagctcagagctcctcttgttctcacctccttttctgctgttaattcccatccacccattctacagatgagaaaacggaggctcagatacctccacagtttaacccaacgaccatccaggtagtgatggggccaggatgaggacccatgtctgcatggggccaaagtgttccttccttccttcgttccttcgttccttcgttccttccttccttccttccttccttccttcgttccttccttcgttccttccttccttccttccttccttccctcccttgcttccttctcttcctcctgccctccctctttccatccttccttctctccttccttccatccttctctccctcctgattcatttcttctctttctttctcttccttccttccctccttccctttctctctttcttccttccattgtttccttctttccttccttcttccgtccctcccttctttctttctctttcttccttccctccttccctctctctctttcttccttccattgtttttctttctttccttccttccctccctccctccctctctctctctctttctttctttctttctcctttttttttctccttctttgtttctttcttcctctttcttctttctttctttctttctttccttctttctttttctttcttttcagagtctccctcttgttgcccaggctggagtgcaatggctcaatctcagctcactgcaaactcagcctcccgggttcaagcgattctcctgcctcagcctcccgagtagctgggattacaggcgcctgccaccaggcccagctaatttttttgtatttttagtagagatggggttttgtcatgttggccaggctggtctcaatctcctggcctcaggtgatcccgtgcctcggcctcccaaagtgctaggattacagctatgagccgccacacccagcctcttgtttgttgacttcttaatagcagccattgtgactggcgtggaatgatagctcattgtggttttgatttgcgtttccgggagggaccctcttgactgagggtgtcagggcctctgcttcaggaaagtatttccaggtttttgtgacctggttcagggaagacagacaaagacagctttctgtttctgcaattttctcaaattccttcagctttatattaaactgccaaggttccataatttgggaagtgtgttcagagccacatcactctggataaagagcctttgcctgttctcattcaagcggttttctttctctgtctctcttttttttttttttttttttttttttgagacaggatctcgctctgtctcccaggctggagtgcagtggcgtgatctcggctcactgcagcctcagctttctgggatcaagtatcctcccactccagcctcccaagtagctgggactgcagaaatacaccaccatgccaagctaatttaaattttttttttaattttatagaggagatcttgctatgttgccaagactagtttttgatttttttttttttttgagatggagtcttactctgtcacccaggctggagtgcagtggcgcgatctcggctcactgcagcctcagctttctgggatcaagtatcctcccactccagcctcccaagtagctgggactgcagaaatacaccaccatgccaagctaatttaaatttttttttttttaaattttatagacgagatcttgctatgttgccaagactagtttttgattttttttttttttttttttttgagatggagtcttactctgtctcccaggctggagtgcagtggcgcgatctcggctcattgcaacctccacctcccgggttcaaccgattctcctgcctcagcctcctgagtagctgggattacaggtacccgccaccatgtccacctaatttttttgtatttttagtagagacagggtttcaccacattggccaggctggtctcgaactgctgacctcaggtgatccgcccacctcagcctaccaaagtgctgggattgcaggcatgagccaccgcgcctggccagtttttgatgatttctgcagtaaacatctccatgtggagaaggagcaagctgggaccacagatgtgcaccatcacacctgcctaatttaaatttttaaaaaaaaattttttttaaagagatgcgatcttgctatgttgcccaggcgggatctgaacctactgggctcaagtcagctttttgcctcagcctcccaaggtgctgggattagaggcgtgagccaccacccccagtcttcagatgatttttgaatatttctgcagtagaaatctcctttttcagaaacagccagggggctgtgaaaaggagggaagatggacaagggaggaacagatacctgaggatgtgggacgtcctggggccatgtgggtgacagaggaaaatcagcaggcttcagccctgaacttcacctcccagagccgggtgggaggacagaaaacagggccggccgggcacggtggctcacgcctgttatcccagcacttcgggaggctgaggcaggcggatcacctgaggtcggcagttcgagaccagcctgaccaacatggtgaaacccccatctctactaaaaatacaaaaattagctgggcatggtggtcggcgcctgtcatcccagctactcgggaggctgaggcaggagaatcatttgaacccgggtggtggagcttgcagcttgcagtgacctgagatcacagcactgcactccagcctgggagacaaagccagactccgtctcaaaaaaaaaaaaaaaaaaaaaaaaaaaaaaggaaaagaaaagaggaaattctgaacccagtgcccgctccttgcagatctgcgaacagtggcaccagcctctagtctcaatgtgaggtttgactccaggacgatgaatttaagctgggactgccaagaaaacacaaccttcagcaagtgtttcttaactgacaagaagaacagagtcgtggaacccagggtgagacgaatttcccattctcaacccctgtcctttacacacccctttctgagttaaaagcaacagggccggctgggcgcggcggctcacgcctgtcatcccagcactttgggaggctgaggtgggcggatcacctgaggtcgggagttcaagaccagcctgaccaacatggtgaaaccccgtctctactacaaatacaaaattagccgggcgtgctggtgcatgcctgtagtcccagctactcaggaggctgagggcagaagaattactcgaacccgggaggtggaagttgcagtgagtcgagctcgtgccattgcactccagcctgggtgacagagcgagactctgtctcataaaatgcaataaggccgggtgtggtggctcacgcttgtcatcccagcactctgggaggccgaggcaggtggatcacctgaggtcaggagttcaagaccaggctgaccaacatggtgaaaccccatctctactaaaaatacaaaaattagtcgggcatggtggcaggcatctgtaatcccagctactcgggaggctgaggcaggagaattactgaaactcgggaggcggaggttgcggtgagccgagatggtgccattgcactccagcctgggcaacaagagcaaaactctgtctccaaaaaaaaaaaaaaataataaattcaattaaataaaagcgagagggccacagacacaaacaacacaagtgtggtatttggagaaatgtcacagccataatctcacgggaaccgggaaagtgctgttagctcatgtccacaatgtgtaccagagcctgattccctgaggcagagcctatgttaccgtattttaccccaagagaagagaaatcctggcaaatgcagttggatgtgcccctgggtctgtggtggaagcaggacggagaaaagtaaagtgtcagtcacgttgtcagtgtgtcaccgtcctggttccccaagggattaaggtcagggtttttggaacacaggagacagagacagaagagcggggagaggggagggaaggagggagaaacacagagaaaggatagaaggaggagggagaggaagagagaaatatggatgatcgatagataggtgatagatgatttattgactgataggtgataatagatgattggaagattgataatcaattctataggtagatgctacacggagggatgggtggtcttgctatgttaccccagatgacatactttttttttttttttttttttttgagatggagtttccctcttgttgcccaggctggagtacactggtgtgatcttggctcactgcaacctccacctcctgggttcaagcgattctcctatctcagcctcctgagtagctgggattacaggtgcgtgccaccacgcctggctaatttttgtatttttagtagagacggggtttcaccatgttggccaggctggtctccaactcctgacctcgtgatccaccctccttggcctcccaaagtgctggcattacaggtgtgagccaccgtgtccgacctttattttttgggatggagtctcgctctgtcgcccaggctggagtgcactggcgtgatctcagctccctgcaacctgtgcctcctgggttcaagagattctcctgcctcagcctcctgagtagctgggattacaggtgcccaccaccacacctggctaatttttgtatttttagtagagacggggtttcaccatgttggccaggctgatcttgaactcctgacctcaagtgatccacccgcctcggcctcccagagtgctggcattacaggtgtgagccactatgtccgaccctttttttggggggatggagtctctgtctgtcacccaggctggagtgcactggcgtgatctcagctcactgcaacctgtgcctcctgggttcaagagagtctcctgcctcagcctcccgagtagcagggattacaggtgcctgccaccacacctggctaatttttgtatttttagtagagacggggtttcaccatgttggccaggctggtcttgaactcctgacctcaagtgatccacccgccttggcctcccagagtgctgggattacaggtgtgagccacggcacctggcctctagtctggtactttcagcactgctagagtataagattgagttttcacctgcaagctggtattcagcgtatccactcagagccctcggaggaagcttagggggatgatttcacaaagggaggcaggtgcgtgtcgccaaatccaggtaaaaaccaataccatggccgggcatggtggctcacgcctgtaatcccagcactttgggaggccgaggcgggtggatcacctgaggtcaggagtttgagaccagcctggccaacatggtgaaaccctgtctctactacaaatacacaaattagcagggtgtggtggcgggtgtctgtaatccgagctactcgggaggctgaggcgggagaattgcttgaacctggaaggcggaggttgtagtgagccgagatcacgccactgcactccagcctgggagactgtaggagacagaaggttgtttcctaatcggctctgtctggttgcaattcttcagctcagtaacaacgaatgttcgtgcacatttcgtgaaatttgtctgcatgaaggagtcacatttgaggttcacgtgaatactagtcaaagaggatttcaacagaaactgctttatccaaattcaggtaagcaagacagctcagggatccgtttacagcactggccccaccaccccgccagcatcaaagtacatcccgttgaacttcggagtgaaaattattttgtttctacctcttcccaggaagggagggtaccgctgctcagaatttctcctgtttcatctacaatgcggatttaatgaactgtacctgggcgaggggtccgacggccccccgtgacgtccagtattttttgtacatacgaaactcaaagtaagtgttcacctcatgtgaagaattatgaggaatgcagggatgggagaaaaaatcatgctggttttctttttttcctttttctttttttaagacatggtcttgctctgttgcccaggctgcaatgcaatggtgccacctcggctcactgcaacctcgacctcctgggttcaagcaattttcctgcctcagcttcccaggtagctgggattacaggcgcccgccaccacaccaggccacatctatgtatttagagacagagtcttgctctgtcgcccaggctggagtgtagtgatgtgatctcagctccctgcaacctgcgcctccctccagggttcaagtgattctcctgcctcagcctcccaagtagctgggactacaggtgcactccaccacacctgtctaatttttgtatttttagtagagacagggtttcaccatgctggccaggctggtctccaactcctgacctcaagtgatctgcctgcctcaacctccccaaagtgctgggattacaggcgtgagccactgcacctggcctgtttttttggttgttgttttgttttgtgttttttgttttgttttgtgtttctttttgttttgccttgtgtttttgtgttcttgttttgttttgtgtttctgtgtttttcttttgtttttgtgtttttttggtttcacgtttttgtggtgttttgtgtttttgtgtttttgttttttgtgtttgtttttgttttgttttgtgttttgttttgtgtttgtttttgttttgttttgtggtttttgttttgtgttgtgtttgtttttgttttgtgtttttttgtttgtgttttggtgtttttgttttgtggttttcttttgtgtttgtttttgttttgtgtttttgtgtttttgtttcattttgttttgttttgtgtttttgtgttttgttttgttttgtgtttgtttttgttttgttttgtgtttttgtgtttttgttttgtgttttgtgtttttgtgttttgttttgttttgtgtttttgtgttttgtttttgtgttttgttttgttttgtgtttttgtgttttgttttgtgtttgtttttgttttgttttgtgtttttgtgtttttgttttgtgttttgtgttttgttttgtgtttttgtgttttgttttgttttgtgtttttgttttgttttgtgtttttgatttgtgtttttgtgttttgttttgtgtttgtttttgttttgtgttttgtgtttttatgttttgttttgtgtttgttttcgttttgttttgtgtttttgttttgtgttttgtgtttttgtgggttttttttgttttgtgtttttgttttgtgtttttgtgttttgtgtttttgtgttttgttttgtgtttgtttttgttttgttttgtgtttttgtgttttgttttgttttcctgattgctctctgagcactttctaatctttcaggagaaggagggagatccggtgtccttattacatacaagactcaggaacccatgtgggatgtcacctggataacctgtcaggattaacgtctcgcaattactttctggttaacggaaccagccgagaaattggcatccaattctttgattcacttttggacacaaagaaaataggtgagaataacacatatgattttcctattgtttataggtgaaatggaatttgccttaaaatctgtgtaactgaggccacgtgcggtgtctcacacctgtaatctcagcactttgggaggccgaggcgggccgatcacctgagatcgggtgttcaaaaccagcctgaccaacatggggaaaccccatctctactaaaaatacaaaaattagccgggcatggtggcgcgtgcctgtaatcccagctactcggaaggctgaggagaatcactcaaacctaggaggcggacgttgcaatgaggtgagattgtgccactgcactccagcttgagcgacagagcaagactctgtctcaaaaacaaacaaacaaaaatctgtgtaactttggtgctgtaacaaattagaactgagctgatttaactttcctttttttgagatagagtctcgctctgtcacccaggctggagtgcagtggtgcaatctcagctcactgcaacctctgcctcccaggttcaagcgattcttctgtcttagtctccttagtagcttggattacaggtgcacaccaccacgctcggctaatttttgtatttttagtagaggcagtgtttcaccatcttggccgggctagtctcgaactcctgacctcagatgatccacctgcctcagcctcccaaagtgctgggattacaggcgtcagccactgcacctgacctccctctttacctccttccttctttccttcctccctgcctttctgcctttcttcttttttcttccttccttccttccttccctccctccctcctttccttccttccttcctccttccctcccttcttccttccctccctccctctctccctcccttcttcattccttccttcttcctctccttccttctccttcactcatttcctccttccttcctctttttcttcatttcttcctcaccagcacctcttcgtgtcccagtgccctgctcctggctggcctcttggagccagtcccatatgcccacacgctctcctcttcccaagcccaccgcatcccacccgtggactccttcatcccgttggacgttcccagcctcttcaggcttaggactctcacagaagtgtgactcctgcccaccaagcccatccccacctcccaccctggaacccctgccccagtgggtatctctcctgtacatggtagctgccccacctccacttggacccagtgtagacaggaggagaccctgtaccacctccacctggacccagtgtagacaaagaggtgtccctactccacgtccacctggatccagtgtagacaggaggagactgcaccacctccacctggacccagtgtagtcaaagagatgtccctactccacgtccacctggacccagtgtagacaggaggagaccctgtaccacctccactttacccagtgtagacagaaggagaccctgcaccacctccacctggacccagtgtagacaaagaggtgtccctactccacatttacctggacacagtgtagacaggaggagactgcaccacctccacttggacccagtgtagacaggagaccctgcaccacctccacctggacccagtgtagacaaagaggtgtccctactccacgtccacctggacccagtgtagacaggaggagactgcaccacctccacctggacccagtgtagacaaagaggtgtccctactccacatttacgtggacacagtgtagacaggaggagaccctgccccacctctacctggacccagtgtgaaggcgaccagcccttccacacatgtgggtatttctcgtcaggtgggacgagagactgagaaaagaaataagacacagagacaaagtatagagaaagaacagtgagcccaggggaccggcgctcagcatacggaggacctgcaccggtctctgagttctctcagtatttattgcttactattttcactatcttggcaaggggaatgtggcaggaggacagggtgatagtggggagaaggtcagcaggaagacatatgagcaaaggaatctgtgtcacaaataagttcaagggaagctactatgcctggatgcacacgcaggccagatttatgcttctctccacacaaacatcagtgtagcaaagagtcacagagcagtattgccaccagcatatctcgcctccagccacagggcggttttctcctgtctcagaatagaacgaatgtacgatcgggttttacacggagacattccattcccaggggcaggcaggagacggagggcttcctcttatctcaaccgcgagaggacttcctcctcggcacagaccctttatggatgtcgggctgggggacggtcaggtctttttcccttcccacgaggccatatctcagactgtctcagtggggggaaccctcagacaatacccgggctctctcgggcagaggtccctgcggctttccgcagtgcatggtgtccctggttaatagagaatggagaatggcgatgacttttaccaagcatgctgcctgcaaacctattgttaacaagacacagcacatgtttctgtgagcacagtgttggggctacagttacagcttaacagcatctcaaggcaaaacagtggttcaacatacagatcacaatggagtttcttaccttcctttctacatagacacagtaacagtctgatctttctttttgtttgtttgtttgtttttctgagacagagtctcactctgtcgcccacccaggctggagggcagtggcgggatctcggctcactgcaacctccgcctcccgggttcacgccattctcctgcctcagcctcccgagtagctgggactacaggcacccgccaccacgcccggctaatttttttggatttttagtagagacggggtttcaccgtgttagccaggatggtctcgacctcctgacctcgtgatcctcccgcctcggcctcccaaagtgctgggattacaggcgtgagccaccgcgcccagccccctgatctctctttcttttccctacacagagtagacaaagaggtgtccctactccacatttacctggacccagtgtagacaggaggagaccctgccccacctccacctggacccagcgtagacaaagaggtgtttctactccatatctacctggacccagtgtagatgggaggagaccctgccccatctccacctggacccagtgtagacaaagaggtgtccctagtccacatccacctggaccgagtgtagacaggaggagaccctgccccacctccacctggacccagtgtagacaggagaagactctgcaccacctccacctggacccagtgtagacaggaggagaccctgccccacctccacctggacccagtgtagacaggagaagactctgccccatctccacctggacccagcgtagacaaagaggtgtttctactccatatctacctggacccagtgtagatgggaggagaccctgccccacctccacctggacccagtgtagacaggagaagactgcaccacctccacctggaccgagtgtagacaggaggagaccctgccccacctctacctggacccagtgtagacaggaggagaccctgccccatctccacctggacccagtgtagtcaaagaggtgtccctactccacctccacctggacccagtgtagacaggacctactccacctccacctggacccagtgtagacaggaggagactctgcaccacctccacctggacccagtgtagacaggacctctcgggttcaggggtgtgtcctgcgccctcgttacagaacgattcaaccctcccagcaatgtcaccgtacgttgcaacacgacgcactgcctcgtacggtggaaacagcccaggacctatcagaagctgtcgtacctggactttcagtaccagctggacgtccacagaaaggtcggtgagagctccccggggctgggcaccaggagggaggcgtacgggacacgcccgcacaggagcctgggaatcccggggaagtggcctgggggaaggatgcgtgggtggtgagcggtgactctggggtgaacgcacttcgggtagcggaggaagaggtgaagggtctgtggcctgtggagccaccttgaaagaggttgcagggagggtggacaaggatgatcctgcaaccatggaaccaggaagtggaccgggaggtgtgggggacgatgccacaagcaaggagagcctctgctccacctccagctggacgcagtgtagacagaaggagaccctgccccatgtctacctggacccagtgtagataggaggacacccgaccccacctccacctacacccagtgtagacaggaggagaccctgctccacctccatggagacccagtgtagacaggaggagttcttgtcccacaactacctggacccagtgtagacagggagagagactgcctcacgtccacctcgatccagtgtagacaagaggagatcttgtctcacaacctcctggacccagtgtagacaagaagagaccctgccccatgtccacctcgagccagtgtagacaagaggagatcttgtcccacaaccacctggacccagtgtagacaagaaggagagcctgctccatgtctacctggacgacaggagaacaccctgccccaaggccagtgggacctttctggatgggttacaggaagatatctggccaggaagacttctgtgtttgcagctcctcatcctacctgtcttgtagattcggggtttgtggagggagacctgcctgccactccgcagggactccttcccattcggtgcccacaccaggggagacactgtgtgaaccatctacagtgttttagaaatggaaacagtgagccttgtgttgtgttttgttttgtttctagaatacccagcctggcacggaaaacctactggtaagtgaaaccacagaccctactgacaaccctcagcgtaaccctacggtcccctactcaccacacctagtgtaactctacagtcccctactcatgacccctacagtcccctaccgacgacctccagcgtaaccctacggtcccctactcaccacacctagtgtaactctacagtcccctactcatgacccctacagtcccctactgacgacctccagcgtaaccctacagtcccctactcaccacacctagtgtaaggaggaggagaccctgccccacctccacagagacccagtatagacaggaggagctcttgtcccacaaccacctggaccccgtgtagacaggaagagaccctgccccacgtccacctagcttaatcctacagtcccctactcaccacacctaatgtaactctacagtcccctactcatgacccctacagtcccctaccgatgacctccagcgtaaccctacagtcccctactcaccacatctagtgtaactctacagtcccctactcacgacccccggagtaatcctacagtctcctactcacgacgcctacagttccctattcatgacccctagcgtaaccatacagtcccctacccatgagccctggcataaccctacaatcccctactcaccacacctagcataaacctacagtcccctacccatgacccctggagtaaccctacagtcccctagtcactacacctagtgtaactaaccatacagttccctatccatgacctctggcggaaccctacactcccctactcacaacccctagtgtaaccctacagtctcctacccatgacccctggcggaactgtacagtcccctactcacgacccctacactctcctacccatgacccctggcggaaccctacagtcccctactcacgacccgtacagtctcctacccatgacccctggcagaaccctacagtcccctactcacgacccctacactctcctacccatgacccctggcagaaccgtacagtcccctactcacgacccctacagtctcctacccatgacccctggcggaactgtacagtcccctactcacgacccctacagtctcctacccatgacccctggcggaactgtacagtcccctactcacgacccctacactctcctacccatgacccctggcggaaccctacagtcccctactcacgacccctacagtctcctacccatgacccctggaggaaccctacagtcccctactcacgacccctacagtctcctacccatgacccctggcggaactgtacagtcccctactcacgacccctacagtctcctacccatgacccctggcggaaccctacagtcccctactcacgacccgtacagtctcctacccatgacccctggcagaaccctacagtcccctactcacgacccctacactctcctacccatgacccctggcggaaccgtacagtcccctactcacgacccctacagtctcctacccatgacccctggcggaaccgtacagtcccctactcacgacccctacactctcctacccaagacccctggcggaaccctacagtcccctactcacgacccctacactttcctacccatgacccctggcggaaccctacagtcccctactcacgacccctacactctcctacccatgacccctggcggaaccctacagtcccctactcacgacccctacagtctcctacacatgacccctggcggaaccctacagtcccctactcacgacccctacagtctcctacccatgacccctggaggaaccctacagtcccctactcacgacccctacagtctcctacccatgacccctggcggaactgtacagtcccctactcacgacccctacagtctcctacccatgacccctggcggaaccctacagtcccctactcacgacccgtacagtctcctacccatgacccctggcagaaccctacagtcccctactcacgacccctacactctcctacccataacccctggcggaaccgtacagtcccctactcacgacccctacagtctcctacccatgacccctggcggaaccctacagtcccctactcacgacccctacagtctcctacccatgacccctggaggaaccctacagtcccctactcacgacccctacagtctcctactcatgacccctggagtaaccctacagtcccctactcacgacccctacagtctcctactcatgacccctggagtaaccctacagtcccctattcaggagccgtagtgtgaccctacaatcccctactcacaacccccggtggaaccctacagtcccctacccatgacccctggtggaaccctacagtcccctactcacgacccctacactctcctacccatgacccctggcggaaccctacagtcccctactcacgacccctacagtctcctacccatgacccctggcagaaccctacagtcccctactcacgacccctacactctcctacccatgacccctggcagaaccctacagtcccctactcacgacccctacagtctcctactcatgacccctggagtaaccctacagtcccctattcaggagccgtagtgtgaccctacaatcccctactcacaacccccggtggaaccctacagtcccctacccatgacctctggtggaaccctacagtcccctactcacgacccctacactctcctacccatgacccctggtggaaccctacagtcccctactcacgacccctacactctcctacccatgacctctggtggaaccctacagtcccctactcacgacccctacactctcctacccatgacccctggcggaaccctacagtcccctactcacgacccctacagtctcctacccatgacccctggcagaaccctacagtcccctactcacgacccctacactctcctacccatgacccctggcagaaccctacagtcccctactcacgacccctacagtctcctactcatgacccctggagtaaccctacagtcccctattcaggagccgtagtgtgaccctacaatcccctactcacaacccccggtggaaccctacagtcccctacccatgacctctggtggaaccctacagtcccctactcacgacccctacactctcctacccatgacccctggtggaaccctacagtcccctactcacgacccctacactctcctacccatgacctctggtggaaccctacagtcccctactcacgacccctagtgtaaccccacatgacccccagtgtaaccctatagtcccctacccacgacctatgtctgcctagacccagtgtgatcaggaggagaccccacctcacctccccctagacccagtgtagacaagaaggagagcctgccccacgtctacctggatccagtgtagacaggagaatactctgcccgacatacagttgaaccactcacaaccctagcgtcaccctacagtctccacgaaccctacagtcttggtttatgggactcttagtgccagtgtggcccaggggtggacacggtggatcctgaaccagaggatgcagatctcacacgggtgagggccccctcatagttctcactgggcagggtctgctcttggcctcaaccttcgtgtcccaatggttggaatatttatgctcagcctgttctactgattttcccattttattcctctttcctctacgtgggttaagaatatattctagtgactgtctaaggagattatgtctccctctaaaatgcttttagagtgagtactgttgccgggtatttaccaagtctcgcggccactctgaccctcggtatcctcctctgtccgatgagtatgctagacttggggatcttaatatcccttgctaaactatccgtctgaaggtctgttaatatcagttgttgatcctgaatcatttatttatgtatgtatttatttttgagacggagtctcgctctgtcccccaggctggagtgcagtggtgcgatctcggctcactgcaagctccacctcccagcgattgtcctgcctcagcctccctacagagattctacagtctcagcctgtagctgggactacaggcacccacccccacacctggccaacaatttctgtttcagaaaataaaattttagccaggcacggtggctcacgcctgtcatcccagcaccttgggaggctgaggtgggcggatcacttgaggtcagcagttcaagaccagcctgggcaacatggagaaaccccatctctactaaaaatacaaaacgtacccatgcgtggtggcgggcgcctgtaatcccagctacgtgggaggctgaggcaggagaatggcgtgaacccgggaagcggaggttgcggtgagcccagatcatgccattgcactccagcctgggcgacagagcgagagtgtctcaaataaaataaaataaaagaggccgggcgtggtggctcatgcctgtaatcccagcactttgtgaggccgaggcggtcggatcacgaggtgaggagatcgagaccatcctggccaacatggtgaaaccccgtctccactaaaaatacaacaaaaattagccgggcgtggtggtgggcacctgtagtcccaactactggggaggctgaggcaggagaatggtgtgaaccctggaggtggaggttgtagtgagccaagatcgcgccactgcactgcagcctgggtgacagagggagactccgtctcaaaaaataaataaataaaataaaataaaaaagcttaaagcctacatcacccaaattttcccaacttgtctcccatcgaaatactaacgaggcttgactctgcttagcttcgaagacccgatcagaccaagtgcattcagagtggtagaaaaaaaagaagaaaaagaaaaaaagaaaaggagaaaaaaacttaaaagacaaaagaacgaaaaaaggcaaccttttcctccacacagaagacgcctatctctaactttcttttttcctccaaagattaatgtttctggtgatttggaaaatagatacaactttccaagctctgagcc

SEQ ID NO: 2854 - DNA, 41135 bp, human; identical to SEQ ID NO: 2847

SEQ ID NO: 2855 - DNA, 37109 bp, human
cgagagaagaaaagcaggtggaaggagaggaagcggatgccgtgggggtaagctaagttctttccttctgtggtctttgagcatgtcgagtcacccgggtacatgtttctgctgtgtctgtcgatagaaaagaaagagactgaactggaacataagatttcaaacgttggctcgagccgaagtggggacagcggcccagaagactgagagccaaggaaccttgcatatgagttgtcttctgcctttgttatatgcaggtttttaaaggcaaaattaaaaaaataaaataaaataaaaagagggaggtgttgttggaggacagggagggggcttctgtgaagctgtttgctgggaattctcgttggtttacagaaaaaaacaattgattaatgattggctgtacattgctaagctacagggcgttggggtgtagtatctagcacggaattatcacgtgaattcacagctatctgtggcatccggaagccgtttcgagagatgaacgcggccgggcgtggtggctcacgcctgtaatcccagcactttgggagactgaggcgggtggatcacctgaggtcgacagttcgagaccatcctggccaacatggagaaaccccgtctctactaaaaatacaaaattagccgggcatggtggtggcaggcacctgtaatcccacctactcaggaggctgaggcaggagaatcgtttgaacccgggaggcggagcttgcagtgagctgagattgcaccactgcactccagcctgggcaacaagacgagattctgtctcaaaaaaaagaaaaagaaaaaaaaagagatgaaaagagatgaacgcagagctgaaagggggagggagtgtgatggtgttactagttactagaaaggggtcctgatccagacttcaagaacgggttctgggatcttgcccaagaaagaactggaggcaagttcacattgcaaactgaaagcaagcttattaagatagtaaaggggggccgggcacggtggctcatgcctgtaatcccaacacttttggaggctgaggcgggcggatcacctgagctcaggagttcgagatcagcttggccaacatggcaaaaccacacctttattaaaaatagaaaaaattagctaggtgtggcagtgtgtgcctgtaatcccagctacttgggaggctgaggcaggagaatcgcttgaacccgggaggcggaggttgcagtgagcccagattgcaccgttgcactccagcctgggcaacaagagcaaaactctgtccccaaaaaaagataactaaaagaaaaaagtcgtggggagagatgctccactacaagggtgactgataaaggattcatctttgtcatgactatcttttgcagtaatcaatattgtatatatacatattatatattttttattattattattttgagatcatctggctgtgtcatccaggctggagggcagtggtgcaatcacagctgactgctgtcttgaattcctgggctcaagcaatcctcccatctcggcctcccgagtagctgggtcaaaggcaaatgccaccattcctggcaaatatttgtatttttgtagggacgagggtttcactgtgtttcccgggctggtcttgaactcctagactcaatctatcttcctgccccagcctcccaaagtggtgggatgacaggtgtgggccaccgcgcctggcccaatattatcatttttaaagcaaaacggattctcacactatgaaagcttttgttctgaagatatcaacacatcaggaggtttctgtgtctgttcagtcctcggtctgtttagtaaacagtattgatctgttcacatatcttgcgtcaggaatggctgacctccagggaatgctgcccagcctgtcccagcctccctgttcccagcccctattctagatggagtccctctaagctgggcgtggtgtaatcccaggactttgggaggctgaggtgggcggatcacctgaggtcaggagttcgagaccagcctggccaacagggtgaaaccccatctctactaaaaatacccaaaattagccggggcgtggtggcgggcgcctgtaatcccaatattttggaaggctgaggtgacagaggattgcttgaggccacagcaattccagaccagcccggggcaacatcgtaagattcccccatccctcgtgtataaaaaaaagattaaattattacaaattttaaaaaagacagaaatgaagcatcttaagttaccacccagattggggtactaagagtctggatttggacagcttgttgcgcgttttataggtgtgctaaatcacatttcactctttttgttgagacagagtctcgtgctgtcgcccaggctggagggcagtggcgcgatctctgctcaccgcaacctccgcctcctgggttcaagcaattctcctgcctcagcctcctgagtagctgggattacaggcacctgccaccacgcccggctaatttttgtattttttttttttttttttttttttggagacagcgtcttgctctgtcgcccaggctggagtgcagtggtgcaatctccgctcactgcaacctccacctcccgggttcaagcaattctcctgcattagcctcctgagtagctaggattacaggcacgtgccaccatgcccagctaatttttgaatttatttatttatttttttggagacagtatcttgctctgttgcccaggctggagtgcagtggtgcgatctcggctcactgtaacctccgcctcccgggttcaagtgattctcctgcctcagcctcctgggtagctgggattacaggtgtgtgctaccatgcccggctaatttttgtatttttagtagggatggtgtttcaccatgttggccaggctggtctggaactcctgacttcaaatgatccgctcaccttgacctcccaaagggctgggattacagacatgaaccacggagcccggccggatttcactctttagatttttggtttaaactcgagaagctcttctcgagggctgaaagctcttggtcccctgtaggtttgctgtagatgacagacatgaggcagattgattaataagagaaaagacatgcactttttttttcttttttttttttgagacggagtctcgctctgtcaccgaggctggagtgcactggcatgatctcggctcactgcaacctccaccttccaggttcaactgattctcctgcctcagcctctccagtagctgggattacaggcgtgtgctaccatgcctggctaatttttctatttttagtagagacagggttgttccatattggtcaggctggtctcgaacacctgacctcaggtgatccgcctgcctcggcctcccagtgtgctaggattacaggcgtgaaccactgtacccagccagatttacacatttatagaatgtgtatacacaagattcttcagaatgaggactccaccccacaatgaggttcagaagctagtacaccacattgagactacagaaggataggggattggatcctggtacaaaaaaaaaaaggttatagggttggggggaaagaggaattctattgaggagcaatatataatttctactgcggactgaactctgatttttttctttattttattttattttattttatttttttgagacagcatctcactctgccgcccaggctggagtgcagtggtgcgatctcagctcactgcaacctccacctcctgggttcacccgattttcctgcctcagcctcccgagtagctgcgattacaggcacccgccactacgcccagctaattttctttgtatttttagtagagacggggtttcaccatgttggccaggctggtcttgaactcctgacctcaggtgatccaacctcctcggcctcccaaagtgctgggattatacgcatgagccactgcacctagcttcttctttttctttttttttttctttctttttttcttttttttttttagatggagtctaactttgtcgcccagactggagtacagtggcacaatctcagctcaccacagcctccacctcccaaggtcaagcaattctcctgcctcagcctcccaagtagctgagattacaggcacgtaccactactgcctgagtaatttttgtgtttttagtagagacaacatttcaccaggttggccaggctggtctcgaactcctgacctcaagtgatccacacgcctcagcctcccaaagtgctaggattataggcaccagccaccacaccgggcctctgactttttttatcttgcccaaattcctatctaagaggtctgaggaggcaagccctacaaaccataaattctcatcaaatgggatttattgaaccctgtatatcgtgacttactttccaacctgactctggcaaacgttacaagacagagaaaaaaaacaacatatgttgccccaaaatatgtttcttagttgtattttttttttcttttaagatggtctcattctgtttccaaggctggagtgcagtggtgcaatcttggctccctgcaacctccgtcttctaggttcaagcgattctcctgcctcctcagccttccaaatagctggcgtaatatgcatgagccatcgtgcccagataattgttttttgttttttgttttttttttagtagagatggggtttcactgtgatggccaggctggtcttgaactcctgacctcaggtgatccaaccgcctcggcctcccaaagtgctgggattataggcgtgaaccactgctcccggctggagtacaggggcataatcttggctcactgcagcctctgcttcccaggttcaagtgattctcctgcctcagtctcccgagtagctgggactacaggcgcccgccaccacgcccagctaatttttttttttttttttgtattttttttttttagtagagatggggtttcactgtgtttgccaggatggtctcgatctcctggcctcatgatctgcccgcctcggcctcccgaagtgctgggatgacaggcgtgagtcaccgcgcccggcatgaaagggtttttcattaaaaatccttgttataccgtggagccctgtgttggggtaaaatatcatgatttccctcactctccatcattcttgctttgaatctgagaaggaagcttggcggcctctattttaggatcagccgaaaatttccagaaaggggaaagaaaactcattctgtaaacacaaaaaagaagaagagaaaaaagtataagcggtacagacaaaacgcaaagatgttgcataattttccgtgagtgcaaaatgtcctgtaaaccaaaaaagaggtatctgagacaggtctcagtccatttagaaagttcattttgccgaggttaaggacgcctgcccatgacagagcctcaggaaatcgcgatgacaggtgctgtggatacacagggcacaatttgctttcatacatttttttggcggggagggagctggggatccagtcttgttctgtcacccaggctgcagtgcaatggtgcaatctcagctcactatcactgtaacctccgcctcccgtgttcaagctattctcctgccacagccttctgagtagctgggattataggcacccactaccgcgcccagctaatttttgtatttttagtagagacggggtttcaccatgttggccaggatggtctcgaactcctggcctcaaatgatccacctgcctcggcctcccaaagtgctgggattataggcgtgagccatggcgcccagccctggtatgtaatttttaaaacctttgtagtaccttatttacgaataaaatgcgaggcaggtttgcctaagacagtttccactataacctttcatgattttggggtcctgagacttatttacctttcacagtttacagcaggaaaatccgtggagacagcagatccgagaagcggcgatgtttgcgtagaaccctgtacgtgcttccttcggcctgtcggtaatgtggttggggattttcttttttttaagtgaagtctaaagaactgaaatgttttgctccataatgatgaaccaggatagaagtgagaactcagggcagaagaatctgaatgaggaactgtctgacctatgacaaatttaacatgtcacgttccctctgagacagtacacatcctcctgaagcagcgtgacaaggcacatcctcctgaagggtctccaggcagaagagacgcatgaacctgtcaaaaaaaaaaaaaaaaagagccggccgggcgcagtggctcaagcctgtaatcccagcactgtgggaggctgaggcggggggatcatgaggtcaggagttccagaccagcctggccaacatggtgaaaccccatctctgctaaaaatacaaaaattagccgggtgtagtggcagttgcctctagtcccagctactccggaggccgaggcaggagaatcgcttgaacccaggaggcgtaggttgcagtgagccaagatcgcgccactgcactccagcctgggcaacagagcgacagtccgtcccaaacactgcaaaatatttaaagagatttattctgagccaaatatgagtgagcaagaaggcccagggaaaatagtctaaagagatcctgagaacacgtatccaagctggttgagcggcagtttggttttatatgtttttgtttgtttacttattttactttattttatttatttatttatttattttgagatgaagccttgctcagtctgttaggctggagtgcagtggcgcgatctcggctcactgcaacctccgcctcccgggttcacgccattctcctgcctcagcctcccgagtagctgggactacaggcgcccaccaccatgcccagctaattttttgtatttttagtagagaaggggtttcaccgtgttagccaggatggtctcgatctcctgacttcgtgatccgcccgcctcagcctcccaaagtgttgggattacaggcacccgccaccacgcccggccaatttttgtatttttagtagcgacggggtttcaccatgttggccaggctggtctcaaacttgtgacctcacatgatctgctcacctcggcctcccaaagtgctgggattacaggcgtaagccacagcgtccagctattttattttatttgttttattttttgtgacagagtctcactctgtcgcccaggctggagtgcagtggagcgatctcagctcactgcaacctctgcctccggagctgaagcaattctcccgcctcagcctcccaagtagctggcattacagaggtacgccaccacgcctggctaaattttgtttgtttgtttgtttgtttgtttgtttgtttttgtttttcagtagacacagggtttcactatgttggccaggctggtctcgaactcctgacctcacatgatctgcctgcctcagcctccagaagtactgggattacagccgtgagccacctcacccagccagcagcttggttttatgtttgtttatatatttatttatttatttatttttaatttttggagacggagtcttgctctgttgcctgggctggagtgcagtggcatgatcttggctcacggcaacctctgcctttcgagttccagtgattctcctgcctcagcctcgcgagtagctgggagtacaggcgcccgccatcacacccggctagtatttgtatttttagtagagagagggtttcaccgtattgtccaggctggtcttgaactcctgtcctcaagtgatccacccacctgagcctctcaaagtgctgggattgcaggcgtgagcctctgtggccagccaacagacagttttgcaggaccatttcaaaatatgtcaagtaaatatattttggggtgaaatgtattttaaagtggcatatactgatttcccacagtcttgtctggggaggcatatcctggcctcctagaaagcatacacagtagcagacaggtgtggtggctcacgcctgcaatcccagccctttgggaggccgaggcaggtggatcacaaggtcaggagatcgagaccatcctggccaacatggtgaaatgctatctctactaaaaatacaaaaattagctgggcgtggtggtgcatgcctgtaatcccagctactcgagaggctgaggcaggaggaccacttgaacctggcaggtggaggttgcagtgagctgagatcacgccactgcactccagcctgggagacagagcgaggctccgtctctaaataaataaataaagcttacgcagtagctgagaagacagggaaaagaggtgaagaaatgacagaaagcttagaagtcgctcattataaccccttcctaccccatctcatgcttcccttaaagcataaacgaagggtgcttgtgttacaggaaaggggttcggatccagcccccaagagggggttcttggatctcacgcaagaaagaattcagggcggccgggcgctgtggctcacacctgtaatcccagcaccttgggaggcagaggcgggcggatcacgaggtcaggagttcgagaccagcctgaccaacatggtgaaaccccatctctactaaaaatacaaaaattagccaggtgtggtggtgcgtgcctgtagtcccagctactcgggagacagaggcaagagaatggcgtgaacccgggaggcgatgcttgcagtgagtggagatcatgccactacactccagcctgggcgatagagtaagtccatctcaaaaaaaaaaaaaaaaaaaaaaaattcggggtgagtcagcagtgcaaagccaaagcaaatttattacaaaagtaaaacagtgaaagaatagctactccagaggccgggcgcagtggctcatgcctgtaatcccagcactttgggaggtggaggtgggcagatcacctgaggtcaggagttcgagaccagcctgaccaacatggtgaaaccccatctctactaaaaatacaaaaattagccaggcatggtggtgcgtgcctgtagtcccagctactcgggaggctgaggcagtagaattgcttcaacttgggagacggaggttgcagtgagccgagatggcaccactgcactccagcctgggcaacagaatgagactcagtctcaaaaaaaaaaaaaaaaatttcagggcgagcaagtttattatgaaagtaaaatagtgaaagactaggtactccagaggccaggcgcagtggctcatgcctataatcccagcactttgggagcccgaggcaggtggatcacctgaggtcaggagttcgagaccagcctcgccaacatggtgaaaccccatctctactaaaaatacaaaaattagccaggcatggtggtgcgtgcctgtagtcccagctacttggaggctgaggcagtagaattgcttcaacttgggagacggaggttgcagtgagccaagatggcaccactgcactccagcctgggcgacagaatgagactcagtctcaaaaaaacaaaagatttcagggcgagcaagtttattatgaaagtaaagtagtggaagactagctactccagaggccaggtgcagtggctcatgcctataatcccagcactttgggagcccgaggcaggtggatcacctgaggtcaggatttcgagaccagcctcgccaacatggtgaaaccccatctctactaaaaatacaaaaattagccaggcgtgttggtgcgtgcctgtagtcccagctactcggaggctgaggcagtagaattgcttcaacttgggagacggaggttgcagtgagccgagatggcaccactgcactccagcctgggtgacagaatgagactcagtctaaaaaaaaaaaaaattcagggcaagcaagtttattatgaaagtaaaatagtgaaagactaggtaatccagaggctgggtgcagtggctcatgcctataatcccagcactttgggagcccaaggcatgtggatcacctgaggtcagaagttcgagaccagcctggccaacatggtgaaaccccatctctactaaaaatacaaaaattagccaggcgtgttggtgcgtgcctgtagtcccagctactcggaggctgaggcagtagaatcacttgaacctaggagacagaggttgcagtgagccgagatggcgccactgtactccagcctgggcgacagagtgagactccatctccaaaaaataaataaataagtcaaccaagaaggccgtacgtacagtggctcacacctgtcatcccatcactttgggaggccgaggcagggggattacttgagatcaggagtttgagaccagcctggccaacatggtgaaaccccgtctctactaaaaatacaaaaattagccaggcgtgttggtgcgtgcctgtagtcccagctactcggaggctgaggcagtagaatggcttcaacttgggagacggaggttgcagtgagccgagatggcaccactgcactccagcctgggcgacagagcaagaccgtctacaaaataataataataattaataataataataataactagtgcaagagaagtacacaaatatcccaaacatttagtgactcagcagagggggccagtctcaaggaacaggacttctacacctgttaccaccacctggggagttgtatctgaatctcaaggtcaggcccacccagacagaacatgcatctctagggtgccacaggagagtctgtccagtgcccagaaacacctgcaagacccagaagcaggctccaagaagcggggtgccacagtccagtgggggaagcggccacatccctgtcatgtgggctacagatgagttggggggcaggggcaggagaagaagaaacaggtgtggcctacatgcttttacttcctcttagcaagcgaggttcctcttgcagaggaacggtctgagagacacaaccgttttttttttttgtttgtttgcttttccttgagacagagtctccctctgtcacccaggctggagggcagtggcgcgatctcggctcactgcagcctccacctcctgggttcaagcgattctcctgcctcaacctcccgagtagctgggattacaggcacccaccaccccacccggctaatttttgtatttctagtatagatgaggtttcaccgtattagccaagctggtcccgaactcctgacctcaggcgatccgcctgccttggcctcccaaagtgctgggattacaggcgtgagccactgtgcccggccgagagacgcaatctttcagagaggaggtttggagcaggaacctcagggtggacagatgggtcccaccaggtgcagatgcttgaactaaagatgctacaaaggccgggtgcagtggttcatgcctgtaattccagcagtttgagaagctgaggcaggcagatcatctgaggtcaggagttcgagcccagcctggccaacatggcaaaacagcgtctctactaaaaatgcaaaattagcctggcataatggcgggcgcctataatcccagctacttgggaggccgaggcaggagaatcgcttgaacccgggaggcggaggttgcagtgagccaagattgcaccactgcactccagcctgggtgacaagagtgaaactccgtctcaaaaaaaaaaaaaaaaaaagaagaagaagaaaagaaatacattagtttggtccataaaggcgggacaactcaaagtgggggcttccaggctataaatgaatttaaacattttctggttgacaattggttgagtttgtagctcctcctccttctcttcttcctcctccttctccccccttcctcctcttcctcctcttcctcctcctccttcttcttctcttctttcttcttcttctctttccccttcttcttcttcttcctcctccttctcctcctcctttttcttcttcttccttatgggcttggatagaagtatattgacatggatccaccatttgtagaatcataccgagtagcttcttttctcctccttcctctccttctcctcctcctcctcctccttctcctgctccttctcctcctcctcctcctgctccttctcctcctcctcctccttctcctcctcctcctcctgcttctcctcctcctccttctcctcctcctgcttctcctcctcctccttctcctcctcctccttctcctcctcctccttctcctcctcctcattctcctcctgctccccttctcctcctccttctcctcctcctccttctcctcctgctccccttctcctcctccttctcctcctcctcctcctcctgctcctcctcctccagctccccttctcctcctactcctccttctcctccttctccttctcctccttctcctactcctccttctcctactcctccttctcctactcctccttctcctcttccttcttctcctcctcctgctccttctcctcctcttcctcctactcctccttctcttccttctcctcctcctccttctcctcctcctccttctcctcttcctccttctcctcctcctccttctcctcctcctccctctcctcctcctccgccttctcctactcctccttctcctcctccttcttctcctcctcctgctccttctcctcctcctccttctcctcctgctccttctcctcctcttcctcctactcctccttctcttccttctcctcctcctccttctcctcctcctgcacctttcctcctcctccttctttttccttttttgcataaagaagtatcaaataagagtagtttcactgccctaaacatcctctgaggtccatgtattcatccctccatctgcccaacgccaaccaactccggatctttttactgtttccatgattttgtcttttccacagtgtccaagtgttagaatgactcagtctgcagccatctcaaagtggattctttcccttagtcataagtatttaaacttcattcatgtcgttttatgtactcaccctttttttcttcctcttcttttttttttttttttcactttccttttatagctgttgcaaaagtcaagattttttaaaaaatataaaagagcagggccgggcacggtggctcacgcctgtaatcccagcactttgggaggccgaggcaggtggatcacgaggtcaggagatggagaccatcctggctaacacggtgaaagcctgtttctactaaaaaaaaaaaaaaaaaaaaaaaattagctgggtgtggtggcaggcgcctgtagtcccagctacttgggaagctgaggcaggagaatggtgtgaacctgggatgtggaggttgcagtgagccgagatcgcgccactgcactccagcctgggtgacagagcgtgactttgtctcaaaaaagaaaaaaaaagtacaaaagagcaaaacaaaacaaaagttatgaaaatgaaaacctgagccatcgtttatcttatttccccaaatccactaattattaacagaaagtaaaagctatgaaaaatgaatgaaagtgactgcaatttccttgaagtgtgttagaacctgcctttagtgtcagctatgggttccctcatgaaggtcagctgagccatgacccatgaaccatggaagcttgactctagattgaccatcttgagatgccaaagatgtccacgtcctaatcccatgtgggagacagaataatggccctgcagaccttcccagctggccatgacccctcatttgaccaggtcagcggctgaccaccatcctgggtttgtttccccaaatcacctccctggggtcccctgccaggaatgtcctgggagaggcaaccttctcactgtgtgatattttctctcctgcagctcttcccttctctctgaccagcaccatgcttctcctggtgacaagccttctgctctgtgagttaccacacccagcattcctcctgatcccagagaaatcgggtaagtatggaaacctggctgaaccttctccgcggcccctgtttagatgtcctgcatctggagacccatctggatacctgggtccatctgcatttcatctctaatgtttatgagggacccaataagcaccagccaacccaccagaagctcagagctcctcttgttctcacctccttttctgctgttaattcccatccacccattctacagatgagaaaacggaggctcagatacctccacagtttaacccaacgaccatccaggtagtgatggggccaggatgaggacccatgtctgcatggggccaaagtgttccttccttccttcgttccttcgttccttcgttccttccttccttccttccttccttccttcgttccttccttcgttccttccttccttccttccttccttccctcccttgcttccttctcttcctcctgccctccctctttccatccttccttctctccttccttccatccttctctccctcctgattcatttcttctctttctttctcttccttccttccctccttccctttctctctttcttccttccattgtttccttctttccttccttcttccgtccctcccttctttctttctctttcttccttccctccttccctctctctctttcttccttccattgtttttctttctttccttccttccctccctccctccctctctctctctctttctttctttctttctcctttttttttctccttctttgtttctttcttcctctttcttctttctttctttctttctttccttctttctttttctttcttttcagagtctccctcttgttgcccaggctggagtgcaatggctcaatctcagctcactgcaaactcagcctcccgggttcaagcgattctcctgcctcagcctcccgagtagctgggattacaggcgcctgccaccaggcccagctaatttttttgtatttttagtagagatggggttttgtcatgttggccaggctggtctcaatctcctggcctcaggtgatcccgtgcctcggcctcccaaagtgctaggattacagctatgagccgccacacccagcctcttgtttgttgacttcttaatagcagccattgtgactggcgtggaatgatagctcattgtggttttgatttgcgtttccgggagggaccctcttgactgagggtgtcagggcctctgcttcaggaaagtatttccaggtttttgtgacctggttcagggaagacagacaaagacagctttctgtttctgcaattttctcaaattccttcagctttatattaaactgccaaggttccataatttgggaagtgtgttcagagccacatcactctggataaagagcctttgcctgttctcattcaagcggttttctttctctgtctctcttttttttttttttttttttttttttgagacaggatctcgctctgtctcccaggctggagtgcagtggcgtgatctcggctcactgcagcctcagctttctgggatcaagtatcctcccactccagcctcccaagtagctgggactgcagaaatacaccaccatgccaagctaatttaaattttttttttaattttatagaggagatcttgctatgttgccaagactagtttttgatttttttttttttttgagatggagtcttactctgtcacccaggctggagtgcagtggcgcgatctcggctcactgcagcctcagctttctgggatcaagtatcctcccactccagcctcccaagtagctgggactgcagaaatacaccaccatgccaagctaatttaaatttttttttttttaaattttatagacgagatcttgctatgttgccaagactagtttttgattttttttttttttttttttttgagatggagtcttactctgtctcccaggctggagtgcagtggcgcgatctcggctcattgcaacctccacctcccgggttcaaccgattctcctgcctcagcctcctgagtagctgggattacaggtacccgccaccatgtccacctaatttttttgtatttttagtagagacagggtttcaccacattggccaggctggtctcgaactgctgacctcaggtgatccgcccacctcagcctaccaaagtgctgggattgcaggcatgagccaccgcgcctggccagtttttgatgatttctgcagtaaacatctccatgtggagaaggagcaagctgggaccacagatgtgcaccatcacacctgcctaatttaaatttttaaaaaaaaattttttttaaagagatgcgatcttgctatgttgcccaggcgggatctgaacctactgggctcaagtcagctttttgcctcagcctcccaaggtgctgggattagaggcgtgagccaccacccccagtcttcagatgatttttgaatatttctgcagtagaaatctcctttttcagaaacagccagggggctgtgaaaaggagggaagatggacaagggaggaacagatacctgaggatgtgggacgtcctggggccatgtgggtgacagaggaaaatcagcaggcttcagccctgaacttcacctcccagagccgggtgggaggacagaaaacagggccggccgggcacggtggctcacgcctgttatcccagcacttcgggaggctgaggcaggcggatcacctgaggtcggcagttcgagaccagcctgaccaacatggtgaaacccccatctctactaaaaatacaaaaattagctgggcatggtggtcggcgcctgtcatcccagctactcgggaggctgaggcaggagaatcatttgaacccgggtggtggagcttgcagcttgcagtgacctgagatcacagcactgcactccagcctgggagacaaagccagactccgtctcaaaaaaaaaaaaaaaaaaaaaaaaaaaaaaggaaaagaaaagaggaaattctgaacccagtgcccgctccttgcagatctgcgaacagtggcaccagcctctagtctcaatgtgaggtttgactccaggacgatgaatttaagctgggactgccaagaaaacacaaccttcagcaagtgtttcttaactgacaagaagaacagagtcgtggaacccagggtgagacgaatttcccattctcaacccctgtcctttacacacccctttctgagttaaaagcaacagggccggctgggcgcggcggctcacgcctgtcatcccagcactttgggaggctgaggtgggcggatcacctgaggtcgggagttcaagaccagcctgaccaacatggtgaaaccccgtctctactacaaatacaaaattagccgggcgtgctggtgcatgcctgtagtcccagctactcaggaggctgagggcagaagaattactcgaacccgggaggtggaagttgcagtgagtcgagctcgtgccattgcactccagcctgggtgacagagcgagactctgtctcataaaatgcaataaggccgggtgtggtggctcacgcttgtcatcccagcactctgggaggccgaggcaggtggatcacctgaggtcaggagttcaagaccaggctgaccaacatggtgaaaccccatctctactaaaaatacaaaaattagtcgggcatggtggcaggcatctgtaatcccagctactcgggaggctgaggcaggagaattactgaaactcgggaggcggaggttgcggtgagccgagatggtgccattgcactccagcctgggcaacaagagcaaaactctgtctccaaaaaaaaaaaaaaataataaattcaattaaataaaagcgagagggccacagacacaaacaacacaagtgtggtatttggagaaatgtcacagccataatctcacgggaaccgggaaagtgctgttagctcatgtccacaatgtgtaccagagcctgattccctgaggcagagcctatgttaccgtattttaccccaagagaagagaaatcctggcaaatgcagttggatgtgcccctgggtctgtggtggaagcaggacggagaaaagtaaagtgtcagtcacgttgtcagtgtgtcaccgtcctggttccccaagggattaaggtcagggtttttggaacacaggagacagagacagaagagcggggagaggggagggaaggagggagaaacacagagaaaggatagaaggaggagggagaggaagagagaaatatggatgatcgatagataggtgatagatgatttattgactgataggtgataatagatgattggaagattgataatcaattctataggtagatgctacacggagggatgggtggtcttgctatgttaccccagatgacatactttttttttttttttttttttttgagatggagtttccctcttgttgcccaggctggagtacactggtgtgatcttggctcactgcaacctccacctcctgggttcaagcgattctcctatctcagcctcctgagtagctgggattacaggtgcgtgccaccacgcctggctaatttttgtatttttagtagagacggggtttcaccatgttggccaggctggtctccaactcctgacctcgtgatccaccctccttggcctcccaaagtgctggcattacaggtgtgagccaccgtgtccgacctttattttttgggatggagtctcgctctgtcgcccaggctggagtgcactggcgtgatctcagctccctgcaacctgtgcctcctgggttcaagagattctcctgcctcagcctcctgagtagctgggattacaggtgcccaccaccacacctggctaatttttgtatttttagtagagacggggtttcaccatgttggccaggctgatcttgaactcctgacctcaagtgatccacccgcctcggcctcccagagtgctggcattacaggtgtgagccactatgtccgaccctttttttggggggatggagtctctgtctgtcacccaggctggagtgcactggcgtgatctcagctcactgcaacctgtgcctcctgggttcaagagagtctcctgcctcagcctcccgagtagcagggattacaggtgcctgccaccacacctggctaatttttgtatttttagtagagacggggtttcaccatgttggccaggctggtcttgaactcctgacctcaagtgatccacccgccttggcctcccagagtgctgggattacaggtgtgagccacggcacctggcctctagtctggtactttcagcactgctagagtataagattgagttttcacctgcaagctggtattcagcgtatccactcagagccctcggaggaagcttagggggatgatttcacaaagggaggcaggtgcgtgtcgccaaatccaggtaaaaaccaataccatggccgggcatggtggctcacgcctgtaatcccagcactttgggaggccgaggcgggtggatcacctgaggtcaggagtttgagaccagcctggccaacatggtgaaaccctgtctctactacaaatacacaaattagcagggtgtggtggcgggtgtctgtaatccgagctactcgggaggctgaggcgggagaattgcttgaacctggaaggcggaggttgtagtgagccgagatcacgccactgcactccagcctgggagactgtaggagacagaaggttgtttcctaatcggctctgtctggttgcaattcttcagctcagtaacaacgaatgttcgtgcacatttcgtgaaatttgtctgcatgaaggagtcacatttgaggttcacgtgaatactagtcaaagaggatttcaacagaaactgctttatccaaattcaggtaagcaagacagctcagggatccgtttacagcactggccccaccaccccgccagcatcaaagtacatcccgttgaacttcggagtgaaaattattttgtttctacctcttcccaggaagggagggtaccgctgctcagaatttctcctgtttcatctacaatgcggatttaatgaactgtacctgggcgaggggtccgacggccccccgtgacgtccagtattttttgtacatacgaaactcaaagtaagtgttcacctcatgtgaagaattatgaggaatgcagggatgggagaaaaaatcatgctggttttctttttttcctttttctttttttaagacatggtcttgctctgttgcccaggctgcaatgcaatggtgccacctcggctcactgcaacctcgacctcctgggttcaagcaattttcctgcctcagcttcccaggtagctgggattacaggcgcccgccaccacaccaggccacatctatgtatttagagacagagtcttgctctgtcgcccaggctggagtgtagtgatgtgatctcagctccctgcaacctgcgcctccctccagggttcaagtgattctcctgcctcagcctcccaagtagctgggactacaggtgcactccaccacacctgtctaatttttgtatttttagtagagacagggtttcaccatgctggccaggctggtctccaactcctgacctcaagtgatctgcctgcctcaacctccccaaagtgctgggattacaggcgtgagccactgcacctggcctgtttttttggttgttgttttgttttgtgttttttgttttgttttgtgtttctttttgttttgccttgtgtttttgtgttcttgttttgttttgtgtttctgtgtttttcttttgtttttgtgtttttttggtttcacgtttttgtggtgttttgtgtttttgtgtttttgttttttgtgtttgtttttgttttgttttgtgttttgttttgtgtttgtttttgttttgttttgtggtttttgttttgtgttgtgtttgtttttgttttgtgtttttttgtttgtgttttggtgtttttgttttgtggttttcttttgtgtttgtttttgttttgtgtttttgtgtttttgtttcattttgttttgttttgtgtttttgtgttttgttttgttttgtgtttgtttttgttttgttttgtgtttttgtgtttttgttttgtgttttgtgtttttgtgttttgttttgttttgtgtttttgtgttttgtttttgtgttttgttttgttttgtgtttttgtgttttgttttgtgtttgtttttgttttgttttgtgtttttgtgtttttgttttgtgttttgtgttttgttttgtgtttttgtgttttgttttgttttgtgtttttgttttgttttgtgtttttgatttgtgtttttgtgttttgttttgtgtttgtttttgttttgtgttttgtgtttttatgttttgttttgtgtttgttttcgttttgttttgtgtttttgttttgtgttttgtgtttttgtgggttttttttgttttgtgtttttgttttgtgtttttgtgttttgtgtttttgtgttttgttttgtgtttgtttttgttttgttttgtgtttttgtgttttgttttgttttcctgattgctctctgagcactttctaatctttcaggagaaggagggagatccggtgtccttattacatacaagactcaggaacccatgtgggatgtcacctggataacctgtcaggattaacgtctcgcaattactttctggttaacggaaccagccgagaaattggcatccaattctttgattcacttttggacacaaagaaaataggtgagaataacacatatgattttcctattgtttataggtgaaatggaatttgccttaaaatctgtgtaactgaggccacgtgcggtgtctcacacctgtaatctcagcactttgggaggccgaggcgggccgatcacctgagatcgggtgttcaaaaccagcctgaccaacatggggaaaccccatctctactaaaaatacaaaaattagccgggcatggtggcgcgtgcctgtaatcccagctactcggaaggctgaggagaatcactcaaacctaggaggcggacgttgcaatgaggtgagattgtgccactgcactccagcttgagcgacagagcaagactctgtctcaaaaacaaacaaacaaaaatctgtgtaactttggtgctgtaacaaattagaactgagctgatttaactttcctttttttgagatagagtctcgctctgtcacccaggctggagtgcagtggtgcaatctcagctcactgcaacctctgcctcccaggttcaagcgattcttctgtcttagtctccttagtagcttggattacaggtgcacaccaccacgctcggctaatttttgtatttttagtagaggcagtgtttcaccatcttggccgggctagtctcgaactcctgacctcagatgatccacctgcctcagcctcccaaagtgctgggattacaggcgtcagccactgcacctgacctccctctttacctccttccttctttccttcctccctgcctttctgcctttcttcttttttcttccttccttccttccttccctccctccctcctttccttccttccttcctccttccctcccttcttccttccctccctccctctctccctcccttcttcattccttccttcttcctctccttccttctccttcactcatttcctccttccttcctctttttcttcatttcttcctcaccagcacctcttcgtgtcccagtgccctgctcctggctggcctcttggagccagtcccatatgcccacacgctctcctcttcccaagcccaccgcatcccacccgtggactccttcatcccgttggacgttcccagcctcttcaggcttaggactctcacagaagtgtgactcctgcccaccaagcccatccccacctcccaccctggaacccctgccccagtgggtatctctcctgtacatggtagctgccccacctccacttggacccagtgtagacaggaggagaccctgtaccacctccacctggacccagtgtagacaaagaggtgtccctactccacgtccacctggatccagtgtagacaggaggagactgcaccacctccacctggacccagtgtagtcaaagagatgtccctactccacgtccacctggacccagtgtagacaggaggagaccctgtaccacctccactttacccagtgtagacagaaggagaccctgcaccacctccacctggacccagtgtagacaaagaggtgtccctactccacatttacctggacacagtgtagacaggaggagactgcaccacctccacttggacccagtgtagacaggagaccctgcaccacctccacctggacccagtgtagacaaagaggtgtccctactccacgtccacctggacccagtgtagacaggaggagactgcaccacctccacctggacccagtgtagacaaagaggtgtccctactccacatttacgtggacacagtgtagacaggaggagaccctgccccacctctacctggacccagtgtgaaggcgaccagcccttccacacatgtgggtatttctcgtcaggtgggacgagagactgagaaaagaaataagacacagagacaaagtatagagaaagaacagtgagcccaggggaccggcgctcagcatacggaggacctgcaccggtctctgagttctctcagtatttattgcttactattttcactatcttggcaaggggaatgtggcaggaggacagggtgatagtggggagaaggtcagcaggaagacatatgagcaaaggaatctgtgtcacaaataagttcaagggaagctactatgcctggatgcacacgcaggccagatttatgcttctctccacacaaacatcagtgtagcaaagagtcacagagcagtattgccaccagcatatctcgcctccagccacagggcggttttctcctgtctcagaatagaacgaatgtacgatcgggttttacacggagacattccattcccaggggcaggcaggagacggagggcttcctcttatctcaaccgcgagaggacttcctcctcggcacagaccctttatggatgtcgggctgggggacggtcaggtctttttcccttcccacgaggccatatctcagactgtctcagtggggggaaccctcagacaatacccgggctctctcgggcagaggtccctgcggctttccgcagtgcatggtgtccctggttaatagagaatggagaatggcgatgacttttaccaagcatgctgcctgcaaacctattgttaacaagacacagcacatgtttctgtgagcacagtgttggggctacagttacagcttaacagcatctcaaggcaaaacagtggttcaacatacagatcacaatggagtttcttaccttcctttctacatagacacagtaacagtctgatctttctttttgtttgtttgtttgtttttctgagacagagtctcactctgtcgcccacccaggctggagggcagtggcgggatctcggctcactgcaacctccgcctcccgggttcacgccattctcctgcctcagcctcccgagtagctgggactacaggcacccgccaccacgcccggctaatttttttggatttttagtagagacggggtttcaccgtgttagccaggatggtctcgacctcctgacctcgtgatcctcccgcctcggcctcccaaagtgctgggattacaggcgtgagccaccgcgcccagccccctgatctctctttcttttccctacacagagtagacaaagaggtgtccctactccacatttacctggacccagtgtagacaggaggagaccctgccccacctccacctggacccagcgtagacaaagaggtgtttctactccatatctacctggacccagtgtagatgggaggagaccctgccccatctccacctggacccagtgtagacaaagaggtgtccctagtccacatccacctggaccgagtgtagacaggaggagaccctgccccacctccacctggacccagtgtagacaggagaagactctgcaccacctccacctggacccagtgtagacaggaggagaccctgccccacctccacctggacccagtgtagacaggagaagactctgccccatctccacctggacccagcgtagacaaagaggtgtttctactccatatctacctggacccagtgtagatgggaggagaccctgccccacctccacctggacccagtgtagacaggagaagactgcaccacctccacctggaccgagtgtagacaggaggagaccctgccccacctctacctggacccagtgtagacaggaggagaccctgccccatctccacctggacccagtgtagtcaaagaggtgtccctactccacctccacctggacccagtgtagacaggacctactccacctccacctggacccagtgtagacaggaggagactctgcaccacctccacctggacccagtgtagacaggacctctcgggttcaggggtgtgtcctgcgccctcgttacagaacgattcaaccctcccagcaatgtcaccgtacgttgcaacacgacgcactgcctcgtacggtggaaacagcccaggacctatcagaagctgtcgtacctggactttcagtaccagctggacgtccacagaaaggtcggtgagagctccccggggctgggcaccaggagggaggcgtacgggacacgcccgcacaggagcctgggaatcccggggaagtggcctgggggaaggatgcgtgggtggtgagcggtgactctggggtgaacgcacttcgggtagcggaggaagaggtgaagggtctgtggcctgtggagccaccttgaaagaggttgcagggagggtggacaaggatgatcctgcaaccatggaaccaggaagtggaccgggaggtgtgggggacgatgccacaagcaaggagagcctctgctccacctccagctggacgcagtgtagacagaaggagaccctgccccatgtctacctggacccagtgtagataggaggacacccgaccccacctccacctacacccagtgtagacaggaggagaccctgctccacctccatggagacccagtgtagacaggaggagttcttgtcccacaactacctggacccagtgtagacagggagagagactgcctcacgtccacctcgatccagtgtagacaagaggagatcttgtctcacaacctcctggacccagtgtagacaagaagagaccctgccccatgtccacctcgagccagtgtagacaagaggagatcttgtcccacaaccacctggacccagtgtagacaagaaggagagcctgctccatgtctacctggacgacaggagaacaccctgccccaaggccagtgggacctttctggatgggttacaggaagatatctggccaggaagacttctgtgtttgcagctcctcatcctacctgtcttgtagattcggggtttgtggagggagacctgcctgccactccgcagggactccttcccattcggtgcccacaccaggggagacactgtgtgaaccatctacagtgttttagaaatggaaacagtgagccttgtgttgtgttttgttttgtttctagaatacccagcctggcacggaaaacctactggtaagtgaaaccacagaccctactgacaaccctcagcgtaaccctacggtcccctactcaccacacctagtgtaactctacagtcccctactcatgacccctacagtcccctaccgacgacctccagcgtaaccctacggtcccctactcaccacacctagtgtaactctacagtcccctactcatgacccctacagtcccctactgacgacctccagcgtaaccctacagtcccctactcaccacacctagtgtaaggaggaggagaccctgccccacctccacagagacccagtatagacaggaggagctcttgtcccacaaccacctggaccccgtgtagacaggaagagaccctgccccacgtccacctagcttaatcctacagtcccctactcaccacacctaatgtaactctacagtcccctactcatgacccctacagtcccctaccgatgacctccagcgtaaccctacagtcccctactcaccacatctagtgtaactctacagtcccctactcacgacccccggagtaatcctacagtctcctactcacgacgcctacagttccctattcatgacccctagcgtaaccatacagtcccctacccatgagccctggcataaccctacaatcccctactcaccacacctagcataaacctacagtcccctacccatgacccctggagtaaccctacagtcccctagtcactacacctagtgtaactaaccatacagttccctatccatgacctctggcggaaccctacactcccctactcacaacccctagtgtaaccctacagtctcctacccatgacccctggcggaactgtacagtcccctactcacgacccctacactctcctacccatgacccctggcggaaccctacagtcccctactcacgacccgtacagtctcctacccatgacccctggcagaaccctacagtcccctactcacgacccctacactctcctacccatgacccctggcagaaccgtacagtcccctactcacgacccctacagtctcctacccatgacccctggcggaactgtacagtcccctactcacgacccctacagtctcctacccatgacccctggcggaactgtacagtcccctactcacgacccctacactctcctacccatgacccctggcggaaccctacagtcccctactcacgacccctacagtctcctacccatgacccctggaggaaccctacagtcccctactcacgacccctacagtctcctacccatgacccctggcggaactgtacagtcccctactcacgacccctacagtctcctacccatgacccctggcggaaccctacagtcccctactcacgacccgtacagtctcctacccatgacccctggcagaaccctacagtcccctactcacgacccctacactctcctacccatgacccctggcggaaccgtacagtcccctactcacgacccctacagtctcctacccatgacccctggcggaaccgtacagtcccctactcacgacccctacactctcctacccaagacccctggcggaaccctacagtcccctactcacgacccctacactttcctacccatgacccctggcggaaccctacagtcccctactcacgacccctacactctcctacccatgacccctggcggaaccctacagtcccctactcacgacccctacagtctcctacacatgacccctggcggaaccctacagtcccctactcacgacccctacagtctcctacccatgacccctggaggaaccctacagtcccctactcacgacccctacagtctcctacccatgacccctggcggaactgtacagtcccctactcacgacccctacagtctcctacccatgacccctggcggaaccctacagtcccctactcacgacccgtacagtctcctacccatgacccctggcagaaccctacagtcccctactcacgacccctacactctcctacccataacccctggcggaaccgtacagtcccctactcacgacccctacagtctcctacccatgacccctggcggaaccctacagtcccctactcacgacccctacagtctcctacccatgacccctggaggaaccctacagtcccctactcacgacccctacagtctcctactcatgacccctggagtaaccctacagtcccctactcacgacccctacagtctcctactcatgacccctggagtaaccctacagtcccctattcaggagccgtagtgtgaccctacaatcccctactcacaacccccggtggaaccctacagtcccctacccatgacccctggtggaaccctacagtcccctactcacgacccctacactctcctacccatgacccctggcggaaccctacagtcccctactcacgacccctacagtctcctacccatgacccctggcagaaccctacagtcccctactcacgacccctacactctcctacccatgacccctggcagaaccctacagtcccctactcacgacccctacagtctcctactcatgacccctggagtaaccctacagtcccctattcaggagccgtagtgtgaccctacaatcccctactcacaacccccggtggaaccctacagtcccctacccatgacctctggtggaaccctacagtcccctactcacgacccctacactctcctacccatgacccctggtggaaccctacagtcccctactcacgacccctacactctcctacccatgacctctggtggaaccctacagtcccctactcacgacccctacactctcctacccatgacccctggcggaaccctacagtcccctactcacgacccctacagtctcctacccatgacccctggcagaaccctacagtcccctactcacgacccctacactctcctacccatgacccctggcagaaccctacagtcccctactcacgacccctacagtctcctactcatgacccctggagtaaccctacagtcccctattcaggagccgtagtgtgaccctacaatcccctactcacaacccccggtggaaccctacagtcccctacccatgacctctggtggaaccctacagtcccctactcacgacccctacactctcctacccatgacccctggtggaaccctacagtcccctactcacgacccctacactctcctacccatgacctctggtggaaccctacagtcccctactcacgacccctagtgtaaccccacatgacccccagtgtaaccctatagtcccctacccacgacctatgtctgcctagacccagtgtgatcaggaggagaccccacctcacctccccctagacccagtgtagacaagaaggagagcctgccccacgtctacctggatccagtgtagacaggagaatactctgcccgacatacagttgaaccactcacaaccctagcgtcaccctacagtctccacgaaccctacagtcttggtttatgggactcttagtgccagtgtggcccaggggtggacacggtggatcctgaaccagaggatgcagatctcacacgggtgagggccccctcatagttctcactgggcagggtctgctcttggcctcaaccttcgtgtcccaatggttggaatatttatgctcagcctgttctactgattttcccattttattcctctttcctctacgtgggttaagaatatattctagtgactgtctaaggagattatgtctccctctaaaatgcttttagagtgagtactgttgccgggtatttaccaagtctcgcggccactctgaccctcggtatcctcctctgtccgatgagtatgctagacttggggatcttaatatcccttgctaaactatccgtctgaaggtctgttaatatcagttgttgatcctgaatcatttatttatgtatgtatttatttttgagacggagtctcgctctgtcccccaggctggagtgcagtggtgcgatctcggctcactgcaagctccacctcccagcgattgtcctgcctcagcctccctacagagattctacagtctcagcctgtagctgggactacaggcacccacccccacacctggccaacaatttctgtttcagaaaataaaattttagccaggcacggtggctcacgcctgtcatcccagcaccttgggaggctgaggtgggcggatcacttgaggtcagcagttcaagaccagcctgggcaacatggagaaaccccatctctactaaaaatacaaaacgtacccatgcgtggtggcgggcgcctgtaatcccagctacgtgggaggctgaggcaggagaatggcgtgaacccgggaagcggaggttgcggtgagcccagatcatgccattgcactccagcctgggcgacagagcgagagtgtctcaaataaaataaaataaaagaggccgggcgtggtggctcatgcctgtaatcccagcactttgtgaggccgaggcggtcggatcacgaggtgaggagatcgagaccatcctggccaacatggtgaaaccccgtctccactaaaaatacaacaaaaattagccgggcgtggtggtgggcacctgtagtcccaactactggggaggctgaggcaggagaatggtgtgaaccctggaggtggaggttgtagtgagccaagatcgcgccactgcactgcagcctgggtgacagagggagactccgtctcaaaaaataaataaataaaataaaataaaaaagcttaaagcctacatcacccaaattttcccaacttgtctcccatcgaaatactaacgaggcttgactctgcttagcttcgaagacccgatcagaccaagtgcattcagagtggtagaaaaaaaagaagaaaaagaaaaaaagaaaaggagaaaaaaacttaaaagacaaaagaacgaaaaaaggcaaccttttcctccacacagaagacgcctatctctaactttcttttttcctccaaagattaatgtttctggtgatttggaaaatagatacaactttccaagctctgagcccagagcaaaacacagtgtgaagatcagagctgcagacgtccgcatcttgaattggagctcctggagtgaagccattgaatttggtaagcgttgggcggaggtaagggatgtttgtgccgtctgcggccaccctgcagcaggcacagaggtcaggtgctctgtcctgggcgctgagatcgagttgagcacgtcgctgggagtagtgtcaggctctgagcttatcgctgaggctcaaaagaaggaggtggtctcgtacttggtcccgcaacattgctttgctgatgttttttcaggacggatgagttggctcccttaataaccagagaagggccaggtgcagcggttcacgcctgtaatcccagcaatttgggaggctgaggccggcggatcaccggaggtcaggagtttgagaccagcctggccaacatggtgaaaccccgtctctactaaaaatacaaaattagcccagcattgtggcaggtgcctgtaatcccagctactcgggaggctgaggcaggagaatcacttgaacccaggaggcggaggttgcactgagctgggatcacgccattgcactccagcctgggtgacagcgtgagactccgtctcaaaaaaaaaaagaaaaaaaaatacaaaaactaaccaggattggtggcacattcctgtaatcccagctactcaggaggctgagggcaggagaatgacttgaacccgggaggtggaggttgcagtgagctggggtcacgccattgcactccagcctgggtgacagagtgagactctgtctcaaaaaaaaaaaaaaaaaaaaaaagaaaaagtagaaggaggtggtctcatactcatacggggtcatgcaacattgctttgctggtgtttttttcagggtggatgagctagaatcccttaatagccagagaaggaccccactgatagccctcctaaagtcccacctccctctgctccactgggaaacaatcagtcagtctttgtccggtcaaaccgtcaccattccggctccctggccaaggggaagctctctccctctttttttcttttttttttttttttttttgagacggcgtttcgctcttgtcgcaggctggagtccagtggcgcaatctcggctcactgcaagctccacctcctgggttcacgccattctcctgcctcagcctccccagtagctgggactacaggtgcccatcaccacgcctggctaattttttgtatttttttttttttagtagagacagggtttcactgttttttagccaggatggtctcgatctcctgacctcgtgatccgcccacctcggcctcccaaagtgctgggattacaggcgtgagccaccgtgcccggccctccctcttttttttttttttttttttttagatggcgtttcgctcttgttgcccaggctggagtgcagtggtgccatctcggctcaccgcgatctccgcctcccaggttcaagcaattctccagcctcagtctcccgagtagctgggattacaggcgcccgccaccacacccggctaattttgtatttttagtagagacggggtttcaccatgttggtcaggctgttcttgaactcctgacctcaggtgatctgcccacctcgccctcccaaagtgctgcaatgacaggcgtgagccaccctgcccgtccggggaagctctcttcaaagccaggtctcggctgcccaggagacaggtctatgcttttctctgaagatgattttgagggctccaaattgaaaaggggaaggggcaggatattgagaagtatgcggttttcacctcaacaaagggtacagaagaaaaattgtgagctgcagtgcagtggtgcacctctacctcccagatcacacagacaaaatggggtacagggatgatcagaggtgcattcgtgtctggtgggccggggtgactgcacctgtaagaaattttttttgtttatttattttttgttatttgagacggactctcgctctgtcacccaggctggagtgcaatggcacgatctcagctcactacaacctctgcctcctgggttcaagcgattctcctgcctcagcctcccgagtagctgggattacattagacatgcatcacgcttggccaatttttgtatttttctttttatttatttatttatttattttgagatggagtttcgctgtgtcacccaggctggagttcaatggcacgatcttggctcactgcaacctccgtctcccaggctcaagcgattctcctgcctcagcctcctgagtagctacgattacagacatgcatcatgcttggccattttttaaatatttttatttatttatttattttgagacagggtctcactctgtcacccaggctggagtgcaatggcacgatctcggctcactgcaacctccgcctcccgggttcaagcgattctcctgcctcagcctcccgagtagctgggattacagacatgcatcacgcttggccaatttttgtatttttatttttatttatttatttatttattttgagatggagtttcgctgtgtcacccaggctggagtgcaatggcacgatcttggctcactgcaacctccgtctcccaggctcaagcgattctcctgcctcagcctcctgagtagctgggattacagacatgcatcatgcttggccattttttaaatatttttatttatttatttattttgacacagggtctcactctgtcacccaggctggagtgcaatggcacaatctcggctcactgcaacctccgtctcccaggctcaagcgattctcctgcctcagactcccaggtagataggattacaggcacccaccaccatgcctggctaattttgtattttttttttagcagagatgaggtttcaccatgttagtgaggcttgtctcgaactcctgacctcagatgatgcgcccgcctcggcctcccaaagtgctgggatgacaggtgtgagccaccgtgcctggcccaatttttgtatttttggtagagacggggtttcaccatgttggtcaggctggtctcgaactcccaacctcaggtgatcctcccgtgtcggcctcccaaagtgctgggatgacaggcgtgagccaccgcatccggcccatggtggcaaagttttaacagctcaccagaaatttccttgtgggcaaaacatagggcaggcaggttgctttcatctcagagccatcttagttaagaaccaaaaacagggaggcaggtttgctgggcccagttctcagcttgactgttccctttggctaaatgcatttggacacccgaagagatttaatttcctttcacatgtccgtcaacgattcaccgcagacgcaaacctgtgtgtctctccaggttctgacgacgggaacctcggctctgtgtacatttatgtgctcctaatcgtgggaacccttgtctgtggcatcgtcctcggcttcctctttaaaaggtaacctgtgaaacacctgggcctccccaatgaaaacaggccaggccgggaggaaagcgctttgtccagtctctgtctctgtctctgagaaagagaaacacagccttggccgggcgtgttggctcatgcctgtaatcccagcactctgggaggccgaggcgggtggatcacgaggtcaggagatcgagaccatcctggctaacacagtgaaaccccgtctctactaaaaaattagcccggcgtggtcgcgggcgcctgtagtcccagctactcgggaggctgaggcaggagaatcgcttgaacccgggaggtggaggttgcagtgagccgagattgcaccactgcactccagcctgggcgacagggcgagactccatctcaaaacaaacaaaagaacggagaaaacgggagatcctacaggaatacacagtgatgctcacagggaatctttctagaatcttccctcagcccctcgggcacagggatgggaatggaacaggcagtcagctgtgggcagcttcagggagtctgaagtcactgctgttgaagggctgagctccagaggggaaacgcctgccttgatcccactagccttgaagagcgtggtttctgggttggaggtgggtttttttttgtttgtttgtttttttgttttttgttttgagacagacttttgctcttgttgcccaggctggagtgcagtgttgcaatctcggctcactgcaacctccacctcccgggttcacgccattctcctgcctcagcctcccgagtagctgggattacaggcatgcaccacgatgctcacctaatttttgtatttttagtagagatggggtttcaccacgttggccaggctggtctctaactcttgacctcaggtgatccacccgccttcgcctcccaaagtgctgggattacaggtgtgagccaccatgcctggcctagttccttaagatgtttgtcatttggtgatttttttttgtttttttgagatggagtctcactctgtcacccaggctggagtgcagtggtgcaatctcggctcactgcaacctccacctcccaggttcaagcaattctcctgcctcagcctcctgaatagctgggattacaggcaagcaccacgatactcagctaatttttgtatttttagtagagacggggtttcaccacgttggccaggctggtctcaaacctcaagtgatccacccgcctcggcctcccaaagtgctgggattacaggtgtgagccactgcacccggcctagttccttaagattttcgtcacttggtgattcttagtgaagttttgcatagttgagcgcagacaccccgcacgcagcatccctcggcacagggcgttgatggaaggaactctggtgacccggggttcattctcttcacactttttctctgtgtctcaggttccttaggatacagcggctgttcccgccagttccacagatcaaagacaaactgaatgataaccatgaggtggaagacgaggtaggcaggggtgggcggagcagtgacctgggatggaaggtggggagtggggagcgtgggacacggcctctgggtgtcgaccatcttgcttctccaccagatgggaccgcagcgtcaccaccggtgtggctggaatctgtatcccactcctgggccttctcccgggtcggggtcttctccaaggttggggtcagagtcatctctgtgagctccatcaggagaaactgaggcagggtggtggtcaagaaaaggaggagaagacggtagagagggccaggcacggtggctcatgcctgtcatcccagcactttgggaggttgaggcatgtggatcatctgaggtcagaggttcgagaccagcctggccaacgtggtgaaaccccatctctgctaaaaatacaaaaaattagctggg

SEQ ID NO: 2856 - DNA, 41090 bp, human
cgagagaagaaaagcaggtggaaggagaggaagcggatgccgtgggggtaagctaagttctttccttctgtggtctttgagcatgtcgagtcacccgggtacatgtttctgctgtgtctgtcgatagaaaagaaagagactgaactggaacataagatttcaaacgttggctcgagccgaagtggggacagcggcccagaagactgagagccaaggaaccttgcatatgagttgtcttctgcctttgttatatgcaggtttttaaaggcaaaattaaaaaaataaaataaaataaaaagagggaggtgttgttggaggacagggagggggcttctgtgaagctgtttgctgggaattctcgttggtttacagaaaaaaacaattgattaatgattggctgtacattgctaagctacagggcgttggggtgtagtatctagcacggaattatcacgtgaattcacagctatctgtggcatccggaagccgtttcgagagatgaacgcggccgggcgtggtggctcacgcctgtaatcccagcactttgggagactgaggcgggtggatcacctgaggtcgacagttcgagaccatcctggccaacatggagaaaccccgtctctactaaaaatacaaaattagccgggcatggtggtggcaggcacctgtaatcccacctactcaggaggctgaggcaggagaatcgtttgaacccgggaggcggagcttgcagtgagctgagattgcaccactgcactccagcctgggcaacaagacgagattctgtctcaaaaaaaagaaaaagaaaaaaaaagagatgaaaagagatgaacgcagagctgaaagggggagggagtgtgatggtgttactagttactagaaaggggtcctgatccagacttcaagaacgggttctgggatcttgcccaagaaagaactggaggcaagttcacattgcaaactgaaagcaagcttattaagatagtaaaggggggccgggcacggtggctcatgcctgtaatcccaacacttttggaggctgaggcgggcggatcacctgagctcaggagttcgagatcagcttggccaacatggcaaaaccacacctttattaaaaatagaaaaaattagctaggtgtggcagtgtgtgcctgtaatcccagctacttgggaggctgaggcaggagaatcgcttgaacccgggaggcggaggttgcagtgagcccagattgcaccgttgcactccagcctgggcaacaagagcaaaactctgtccccaaaaaaagataactaaaagaaaaaagtcgtggggagagatgctccactacaagggtgactgataaaggattcatctttgtcatgactatcttttgcagtaatcaatattgtatatatacatattatatattttttattattattattttgagatcatctggctgtgtcatccaggctggagggcagtggtgcaatcacagctgactgctgtcttgaattcctgggctcaagcaatcctcccatctcggcctcccgagtagctgggtcaaaggcaaatgccaccattcctggcaaatatttgtatttttgtagggacgagggtttcactgtgtttcccgggctggtcttgaactcctagactcaatctatcttcctgccccagcctcccaaagtggtgggatgacaggtgtgggccaccgcgcctggcccaatattatcatttttaaagcaaaacggattctcacactatgaaagcttttgttctgaagatatcaacacatcaggaggtttctgtgtctgttcagtcctcggtctgtttagtaaacagtattgatctgttcacatatcttgcgtcaggaatggctgacctccagggaatgctgcccagcctgtcccagcctccctgttcccagcccctattctagatggagtccctctaagctgggcgtggtgtaatcccaggactttgggaggctgaggtgggcggatcacctgaggtcaggagttcgagaccagcctggccaacagggtgaaaccccatctctactaaaaatacccaaaattagccggggcgtggtggcgggcgcctgtaatcccaatattttggaaggctgaggtgacagaggattgcttgaggccacagcaattccagaccagcccggggcaacatcgtaagattcccccatccctcgtgtataaaaaaaagattaaattattacaaattttaaaaaagacagaaatgaagcatcttaagttaccacccagattggggtactaagagtctggatttggacagcttgttgcgcgttttataggtgtgctaaatcacatttcactctttttgttgagacagagtctcgtgctgtcgcccaggctggagggcagtggcgcgatctctgctcaccgcaacctccgcctcctgggttcaagcaattctcctgcctcagcctcctgagtagctgggattacaggcacctgccaccacgcccggctaatttttgtattttttttttttttttttttttttggagacagcgtcttgctctgtcgcccaggctggagtgcagtggtgcaatctccgctcactgcaacctccacctcccgggttcaagcaattctcctgcattagcctcctgagtagctaggattacaggcacgtgccaccatgcccagctaatttttgaatttatttatttatttttttggagacagtatcttgctctgttgcccaggctggagtgcagtggtgcgatctcggctcactgtaacctccgcctcccgggttcaagtgattctcctgcctcagcctcctgggtagctgggattacaggtgtgtgctaccatgcccggctaatttttgtatttttagtagggatggtgtttcaccatgttggccaggctggtctggaactcctgacttcaaatgatccgctcaccttgacctcccaaagggctgggattacagacatgaaccacggagcccggccggatttcactctttagatttttggtttaaactcgagaagctcttctcgagggctgaaagctcttggtcccctgtaggtttgctgtagatgacagacatgaggcagattgattaataagagaaaagacatgcactttttttttcttttttttttttgagacggagtctcgctctgtcaccgaggctggagtgcactggcatgatctcggctcactgcaacctccaccttccaggttcaactgattctcctgcctcagcctctccagtagctgggattacaggcgtgtgctaccatgcctggctaatttttctatttttagtagagacagggttgttccatattggtcaggctggtctcgaacacctgacctcaggtgatccgcctgcctcggcctcccagtgtgctaggattacaggcgtgaaccactgtacccagccagatttacacatttatagaatgtgtatacacaagattcttcagaatgaggactccaccccacaatgaggttcagaagctagtacaccacattgagactacagaaggataggggattggatcctggtacaaaaaaaaaaaggttatagggttggggggaaagaggaattctattgaggagcaatatataatttctactgcggactgaactctgatttttttctttattttattttattttattttatttttttgagacagcatctcactctgccgcccaggctggagtgcagtggtgcgatctcagctcactgcaacctccacctcctgggttcacccgattttcctgcctcagcctcccgagtagctgcgattacaggcacccgccactacgcccagctaattttctttgtatttttagtagagacggggtttcaccatgttggccaggctggtcttgaactcctgacctcaggtgatccaacctcctcggcctcccaaagtgctgggattatacgcatgagccactgcacctagcttcttctttttctttttttttttctttctttttttcttttttttttttagatggagtctaactttgtcgcccagactggagtacagtggcacaatctcagctcaccacagcctccacctcccaaggtcaagcaattctcctgcctcagcctcccaagtagctgagattacaggcacgtaccactactgcctgagtaatttttgtgtttttagtagagacaacatttcaccaggttggccaggctggtctcgaactcctgacctcaagtgatccacacgcctcagcctcccaaagtgctaggattataggcaccagccaccacaccgggcctctgactttttttatcttgcccaaattcctatctaagaggtctgaggaggcaagccctacaaaccataaattctcatcaaatgggatttattgaaccctgtatatcgtgacttactttccaacctgactctggcaaacgttacaagacagagaaaaaaaacaacatatgttgccccaaaatatgtttcttagttgtattttttttttcttttaagatggtctcattctgtttccaaggctggagtgcagtggtgcaatcttggctccctgcaacctccgtcttctaggttcaagcgattctcctgcctcctcagccttccaaatagctggcgtaatatgcatgagccatcgtgcccagataattgttttttgttttttgttttttttttagtagagatggggtttcactgtgatggccaggctggtcttgaactcctgacctcaggtgatccaaccgcctcggcctcccaaagtgctgggattataggcgtgaaccactgctcccggctggagtacaggggcataatcttggctcactgcagcctctgcttcccaggttcaagtgattctcctgcctcagtctcccgagtagctgggactacaggcgcccgccaccacgcccagctaatttttttttttttttttgtattttttttttttagtagagatggggtttcactgtgtttgccaggatggtctcgatctcctggcctcatgatctgcccgcctcggcctcccgaagtgctgggatgacaggcgtgagtcaccgcgcccggcatgaaagggtttttcattaaaaatccttgttataccgtggagccctgtgttggggtaaaatatcatgatttccctcactctccatcattcttgctttgaatctgagaaggaagcttggcggcctctattttaggatcagccgaaaatttccagaaaggggaaagaaaactcattctgtaaacacaaaaaagaagaagagaaaaaagtataagcggtacagacaaaacgcaaagatgttgcataattttccgtgagtgcaaaatgtcctgtaaaccaaaaaagaggtatctgagacaggtctcagtccatttagaaagttcattttgccgaggttaaggacgcctgcccatgacagagcctcaggaaatcgcgatgacaggtgctgtggatacacagggcacaatttgctttcatacatttttttggcggggagggagctggggatccagtcttgttctgtcacccaggctgcagtgcaatggtgcaatctcagctcactatcactgtaacctccgcctcccgtgttcaagctattctcctgccacagccttctgagtagctgggattataggcacccactaccgcgcccagctaatttttgtatttttagtagagacggggtttcaccatgttggccaggatggtctcgaactcctggcctcaaatgatccacctgcctcggcctcccaaagtgctgggattataggcgtgagccatggcgcccagccctggtatgtaatttttaaaacctttgtagtaccttatttacgaataaaatgcgaggcaggtttgcctaagacagtttccactataacctttcatgattttggggtcctgagacttatttacctttcacagtttacagcaggaaaatccgtggagacagcagatccgagaagcggcgatgtttgcgtagaaccctgtacgtgcttccttcggcctgtcggtaatgtggttggggattttcttttttttaagtgaagtctaaagaactgaaatgttttgctccataatgatgaaccaggatagaagtgagaactcagggcagaagaatctgaatgaggaactgtctgacctatgacaaatttaacatgtcacgttccctctgagacagtacacatcctcctgaagcagcgtgacaaggcacatcctcctgaagggtctccaggcagaagagacgcatgaacctgtcaaaaaaaaaaaaaaaaagagccggccgggcgcagtggctcaagcctgtaatcccagcactgtgggaggctgaggcggggggatcatgaggtcaggagttccagaccagcctggccaacatggtgaaaccccatctctgctaaaaatacaaaaattagccgggtgtagtggcagttgcctctagtcccagctactccggaggccgaggcaggagaatcgcttgaacccaggaggcgtaggttgcagtgagccaagatcgcgccactgcactccagcctgggcaacagagcgacagtccgtcccaaacactgcaaaatatttaaagagatttattctgagccaaatatgagtgagcaagaaggcccagggaaaatagtctaaagagatcctgagaacacgtatccaagctggttgagcggcagtttggttttatatgtttttgtttgtttacttattttactttattttatttatttatttatttattttgagatgaagccttgctcagtctgttaggctggagtgcagtggcgcgatctcggctcactgcaacctccgcctcccgggttcacgccattctcctgcctcagcctcccgagtagctgggactacaggcgcccaccaccatgcccagctaattttttgtatttttagtagagaaggggtttcaccgtgttagccaggatggtctcgatctcctgacttcgtgatccgcccgcctcagcctcccaaagtgttgggattacaggcacccgccaccacgcccggccaatttttgtatttttagtagcgacggggtttcaccatgttggccaggctggtctcaaacttgtgacctcacatgatctgctcacctcggcctcccaaagtgctgggattacaggcgtaagccacagcgtccagctattttattttatttgttttattttttgtgacagagtctcactctgtcgcccaggctggagtgcagtggagcgatctcagctcactgcaacctctgcctccggagctgaagcaattctcccgcctcagcctcccaagtagctggcattacagaggtacgccaccacgcctggctaaattttgtttgtttgtttgtttgtttgtttgtttgtttttgtttttcagtagacacagggtttcactatgttggccaggctggtctcgaactcctgacctcacatgatctgcctgcctcagcctccagaagtactgggattacagccgtgagccacctcacccagccagcagcttggttttatgtttgtttatatatttatttatttatttatttttaatttttggagacggagtcttgctctgttgcctgggctggagtgcagtggcatgatcttggctcacggcaacctctgcctttcgagttccagtgattctcctgcctcagcctcgcgagtagctgggagtacaggcgcccgccatcacacccggctagtatttgtatttttagtagagagagggtttcaccgtattgtccaggctggtcttgaactcctgtcctcaagtgatccacccacctgagcctctcaaagtgctgggattgcaggcgtgagcctctgtggccagccaacagacagttttgcaggaccatttcaaaatatgtcaagtaaatatattttggggtgaaatgtattttaaagtggcatatactgatttcccacagtcttgtctggggaggcatatcctggcctcctagaaagcatacacagtagcagacaggtgtggtggctcacgcctgcaatcccagccctttgggaggccgaggcaggtggatcacaaggtcaggagatcgagaccatcctggccaacatggtgaaatgctatctctactaaaaatacaaaaattagctgggcgtggtggtgcatgcctgtaatcccagctactcgagaggctgaggcaggaggaccacttgaacctggcaggtggaggttgcagtgagctgagatcacgccactgcactccagcctgggagacagagcgaggctccgtctctaaataaataaataaagcttacgcagtagctgagaagacagggaaaagaggtgaagaaatgacagaaagcttagaagtcgctcattataaccccttcctaccccatctcatgcttcccttaaagcataaacgaagggtgcttgtgttacaggaaaggggttcggatccagcccccaagagggggttcttggatctcacgcaagaaagaattcagggcggccgggcgctgtggctcacacctgtaatcccagcaccttgggaggcagaggcgggcggatcacgaggtcaggagttcgagaccagcctgaccaacatggtgaaaccccatctctactaaaaatacaaaaattagccaggtgtggtggtgcgtgcctgtagtcccagctactcgggagacagaggcaagagaatggcgtgaacccgggaggcgatgcttgcagtgagtggagatcatgccactacactccagcctgggcgatagagtaagtccatctcaaaaaaaaaaaaaaaaaaaaaaaattcggggtgagtcagcagtgcaaagccaaagcaaatttattacaaaagtaaaacagtgaaagaatagctactccagaggccgggcgcagtggctcatgcctgtaatcccagcactttgggaggtggaggtgggcagatcacctgaggtcaggagttcgagaccagcctgaccaacatggtgaaaccccatctctactaaaaatacaaaaattagccaggcatggtggtgcgtgcctgtagtcccagctactcgggaggctgaggcagtagaattgcttcaacttgggagacggaggttgcagtgagccgagatggcaccactgcactccagcctgggcaacagaatgagactcagtctcaaaaaaaaaaaaaaaaatttcagggcgagcaagtttattatgaaagtaaaatagtgaaagactaggtactccagaggccaggcgcagtggctcatgcctataatcccagcactttgggagcccgaggcaggtggatcacctgaggtcaggagttcgagaccagcctcgccaacatggtgaaaccccatctctactaaaaatacaaaaattagccaggcatggtggtgcgtgcctgtagtcccagctacttggaggctgaggcagtagaattgcttcaacttgggagacggaggttgcagtgagccaagatggcaccactgcactccagcctgggcgacagaatgagactcagtctcaaaaaaacaaaagatttcagggcgagcaagtttattatgaaagtaaagtagtggaagactagctactccagaggccaggtgcagtggctcatgcctataatcccagcactttgggagcccgaggcaggtggatcacctgaggtcaggatttcgagaccagcctcgccaacatggtgaaaccccatctctactaaaaatacaaaaattagccaggcgtgttggtgcgtgcctgtagtcccagctactcggaggctgaggcagtagaattgcttcaacttgggagacggaggttgcagtgagccgagatggcaccactgcactccagcctgggtgacagaatgagactcagtctaaaaaaaaaaaaaattcagggcaagcaagtttattatgaaagtaaaatagtgaaagactaggtaatccagaggctgggtgcagtggctcatgcctataatcccagcactttgggagcccaaggcatgtggatcacctgaggtcagaagttcgagaccagcctggccaacatggtgaaaccccatctctactaaaaatacaaaaattagccaggcgtgttggtgcgtgcctgtagtcccagctactcggaggctgaggcagtagaatcacttgaacctaggagacagaggttgcagtgagccgagatggcgccactgtactccagcctgggcgacagagtgagactccatctccaaaaaataaataaataagtcaaccaagaaggccgtacgtacagtggctcacacctgtcatcccatcactttgggaggccgaggcagggggattacttgagatcaggagtttgagaccagcctggccaacatggtgaaaccccgtctctactaaaaatacaaaaattagccaggcgtgttggtgcgtgcctgtagtcccagctactcggaggctgaggcagtagaatggcttcaacttgggagacggaggttgcagtgagccgagatggcaccactgcactccagcctgggcgacagagcaagaccgtctacaaaataataataataattaataataataataataactagtgcaagagaagtacacaaatatcccaaacatttagtgactcagcagagggggccagtctcaaggaacaggacttctacacctgttaccaccacctggggagttgtatctgaatctcaaggtcaggcccacccagacagaacatgcatctctagggtgccacaggagagtctgtccagtgcccagaaacacctgcaagacccagaagcaggctccaagaagcggggtgccacagtccagtgggggaagcggccacatccctgtcatgtgggctacagatgagttggggggcaggggcaggagaagaagaaacaggtgtggcctacatgcttttacttcctcttagcaagcgaggttcctcttgcagaggaacggtctgagagacacaaccgttttttttttttgtttgtttgcttttccttgagacagagtctccctctgtcacccaggctggagggcagtggcgcgatctcggctcactgcagcctccacctcctgggttcaagcgattctcctgcctcaacctcccgagtagctgggattacaggcacccaccaccccacccggctaatttttgtatttctagtatagatgaggtttcaccgtattagccaagctggtcccgaactcctgacctcaggcgatccgcctgccttggcctcccaaagtgctgggattacaggcgtgagccactgtgcccggccgagagacgcaatctttcagagaggaggtttggagcaggaacctcagggtggacagatgggtcccaccaggtgcagatgcttgaactaaagatgctacaaaggccgggtgcagtggttcatgcctgtaattccagcagtttgagaagctgaggcaggcagatcatctgaggtcaggagttcgagcccagcctggccaacatggcaaaacagcgtctctactaaaaatgcaaaattagcctggcataatggcgggcgcctataatcccagctacttgggaggccgaggcaggagaatcgcttgaacccgggaggcggaggttgcagtgagccaagattgcaccactgcactccagcctgggtgacaagagtgaaactccgtctcaaaaaaaaaaaaaaaaaaagaagaagaagaaaagaaatacattagtttggtccataaaggcgggacaactcaaagtgggggcttccaggctataaatgaatttaaacattttctggttgacaattggttgagtttgtagctcctcctccttctcttcttcctcctccttctccccccttcctcctcttcctcctcttcctcctcctccttcttcttctcttctttcttcttcttctctttccccttcttcttcttcttcctcctccttctcctcctcctttttcttcttcttccttatgggcttggatagaagtatattgacatggatccaccatttgtagaatcataccgagtagcttcttttctcctccttcctctccttctcctcctcctcctcctccttctcctgctccttctcctcctcctcctcctgctccttctcctcctcctcctccttctcctcctcctcctcctgcttctcctcctcctccttctcctcctcctgcttctcctcctcctccttctcctcctcctccttctcctcctcctccttctcctcctcctcattctcctcctgctccccttctcctcctccttctcctcctcctccttctcctcctgctccccttctcctcctccttctcctcctcctcctcctcctgctcctcctcctccagctccccttctcctcctactcctccttctcctccttctccttctcctccttctcctactcctccttctcctactcctccttctcctactcctccttctcctcttccttcttctcctcctcctgctccttctcctcctcttcctcctactcctccttctcttccttctcctcctcctccttctcctcctcctccttctcctcttcctccttctcctcctcctccttctcctcctcctccctctcctcctcctccgccttctcctactcctccttctcctcctccttcttctcctcctcctgctccttctcctcctcctccttctcctcctgctccttctcctcctcttcctcctactcctccttctcttccttctcctcctcctccttctcctcctcctgcacctttcctcctcctccttctttttccttttttgcataaagaagtatcaaataagagtagtttcactgccctaaacatcctctgaggtccatgtattcatccctccatctgcccaacgccaaccaactccggatctttttactgtttccatgattttgtcttttccacagtgtccaagtgttagaatgactcagtctgcagccatctcaaagtggattctttcccttagtcataagtatttaaacttcattcatgtcgttttatgtactcaccctttttttcttcctcttcttttttttttttttttcactttccttttatagctgttgcaaaagtcaagattttttaaaaaatataaaagagcagggccgggcacggtggctcacgcctgtaatcccagcactttgggaggccgaggcaggtggatcacgaggtcaggagatggagaccatcctggctaacacggtgaaagcctgtttctactaaaaaaaaaaaaaaaaaaaaaaaattagctgggtgtggtggcaggcgcctgtagtcccagctacttgggaagctgaggcaggagaatggtgtgaacctgggatgtggaggttgcagtgagccgagatcgcgccactgcactccagcctgggtgacagagcgtgactttgtctcaaaaaagaaaaaaaaagtacaaaagagcaaaacaaaacaaaagttatgaaaatgaaaacctgagccatcgtttatcttatttccccaaatccactaattattaacagaaagtaaaagctatgaaaaatgaatgaaagtgactgcaatttccttgaagtgtgttagaacctgcctttagtgtcagctatgggttccctcatgaaggtcagctgagccatgacccatgaaccatggaagcttgactctagattgaccatcttgagatgccaaagatgtccacgtcctaatcccatgtgggagacagaataatggccctgcagaccttcccagctggccatgacccctcatttgaccaggtcagcggctgaccaccatcctgggtttgtttccccaaatcacctccctggggtcccctgccaggaatgtcctgggagaggcaaccttctcactgtgtgatattttctctcctgcagctcttcccttctctctgaccagcaccatgcttctcctggtgacaagccttctgctctgtgagttaccacacccagcattcctcctgatcccagagaaatcgggtaagtatggaaacctggctgaaccttctccgcggcccctgtttagatgtcctgcatctggagacccatctggatacctgggtccatctgcatttcatctctaatgtttatgagggacccaataagcaccagccaacccaccagaagctcagagctcctcttgttctcacctccttttctgctgttaattcccatccacccattctacagatgagaaaacggaggctcagatacctccacagtttaacccaacgaccatccaggtagtgatggggccaggatgaggacccatgtctgcatggggccaaagtgttccttccttccttcgttccttcgttccttcgttccttccttccttccttccttccttccttcgttccttccttcgttccttccttccttccttccttccttccctcccttgcttccttctcttcctcctgccctccctctttccatccttccttctctccttccttccatccttctctccctcctgattcatttcttctctttctttctcttccttccttccctccttccctttctctctttcttccttccattgtttccttctttccttccttcttccgtccctcccttctttctttctctttcttccttccctccttccctctctctctttcttccttccattgtttttctttctttccttccttccctccctccctccctctctctctctctttctttctttctttctcctttttttttctccttctttgtttctttcttcctctttcttctttctttctttctttctttccttctttctttttctttcttttcagagtctccctcttgttgcccaggctggagtgcaatggctcaatctcagctcactgcaaactcagcctcccgggttcaagcgattctcctgcctcagcctcccgagtagctgggattacaggcgcctgccaccaggcccagctaatttttttgtatttttagtagagatggggttttgtcatgttggccaggctggtctcaatctcctggcctcaggtgatcccgtgcctcggcctcccaaagtgctaggattacagctatgagccgccacacccagcctcttgtttgttgacttcttaatagcagccattgtgactggcgtggaatgatagctcattgtggttttgatttgcgtttccgggagggaccctcttgactgagggtgtcagggcctctgcttcaggaaagtatttccaggtttttgtgacctggttcagggaagacagacaaagacagctttctgtttctgcaattttctcaaattccttcagctttatattaaactgccaaggttccataatttgggaagtgtgttcagagccacatcactctggataaagagcctttgcctgttctcattcaagcggttttctttctctgtctctcttttttttttttttttttttttttttgagacaggatctcgctctgtctcccaggctggagtgcagtggcgtgatctcggctcactgcagcctcagctttctgggatcaagtatcctcccactccagcctcccaagtagctgggactgcagaaatacaccaccatgccaagctaatttaaattttttttttaattttatagaggagatcttgctatgttgccaagactagtttttgatttttttttttttttgagatggagtcttactctgtcacccaggctggagtgcagtggcgcgatctcggctcactgcagcctcagctttctgggatcaagtatcctcccactccagcctcccaagtagctgggactgcagaaatacaccaccatgccaagctaatttaaatttttttttttttaaattttatagacgagatcttgctatgttgccaagactagtttttgattttttttttttttttttttttgagatggagtcttactctgtctcccaggctggagtgcagtggcgcgatctcggctcattgcaacctccacctcccgggttcaaccgattctcctgcctcagcctcctgagtagctgggattacaggtacccgccaccatgtccacctaatttttttgtatttttagtagagacagggtttcaccacattggccaggctggtctcgaactgctgacctcaggtgatccgcccacctcagcctaccaaagtgctgggattgcaggcatgagccaccgcgcctggccagtttttgatgatttctgcagtaaacatctccatgtggagaaggagcaagctgggaccacagatgtgcaccatcacacctgcctaatttaaatttttaaaaaaaaattttttttaaagagatgcgatcttgctatgttgcccaggcgggatctgaacctactgggctcaagtcagctttttgcctcagcctcccaaggtgctgggattagaggcgtgagccaccacccccagtcttcagatgatttttgaatatttctgcagtagaaatctcctttttcagaaacagccagggggctgtgaaaaggagggaagatggacaagggaggaacagatacctgaggatgtgggacgtcctggggccatgtgggtgacagaggaaaatcagcaggcttcagccctgaacttcacctcccagagccgggtgggaggacagaaaacagggccggccgggcacggtggctcacgcctgttatcccagcacttcgggaggctgaggcaggcggatcacctgaggtcggcagttcgagaccagcctgaccaacatggtgaaacccccatctctactaaaaatacaaaaattagctgggcatggtggtcggcgcctgtcatcccagctactcgggaggctgaggcaggagaatcatttgaacccgggtggtggagcttgcagcttgcagtgacctgagatcacagcactgcactccagcctgggagacaaagccagactccgtctcaaaaaaaaaaaaaaaaaaaaaaaaaaaaaaggaaaagaaaagaggaaattctgaacccagtgcccgctccttgcagatctgcgaacagtggcaccagcctctagtctcaatgtgaggtttgactccaggacgatgaatttaagctgggactgccaagaaaacacaaccttcagcaagtgtttcttaactgacaagaagaacagagtcgtggaacccagggtgagacgaatttcccattctcaacccctgtcctttacacacccctttctgagttaaaagcaacagggccggctgggcgcggcggctcacgcctgtcatcccagcactttgggaggctgaggtgggcggatcacctgaggtcgggagttcaagaccagcctgaccaacatggtgaaaccccgtctctactacaaatacaaaattagccgggcgtgctggtgcatgcctgtagtcccagctactcaggaggctgagggcagaagaattactcgaacccgggaggtggaagttgcagtgagtcgagctcgtgccattgcactccagcctgggtgacagagcgagactctgtctcataaaatgcaataaggccgggtgtggtggctcacgcttgtcatcccagcactctgggaggccgaggcaggtggatcacctgaggtcaggagttcaagaccaggctgaccaacatggtgaaaccccatctctactaaaaatacaaaaattagtcgggcatggtggcaggcatctgtaatcccagctactcgggaggctgaggcaggagaattactgaaactcgggaggcggaggttgcggtgagccgagatggtgccattgcactccagcctgggcaacaagagcaaaactctgtctccaaaaaaaaaaaaaaataataaattcaattaaataaaagcgagagggccacagacacaaacaacacaagtgtggtatttggagaaatgtcacagccataatctcacgggaaccgggaaagtgctgttagctcatgtccacaatgtgtaccagagcctgattccctgaggcagagcctatgttaccgtattttaccccaagagaagagaaatcctggcaaatgcagttggatgtgcccctgggtctgtggtggaagcaggacggagaaaagtaaagtgtcagtcacgttgtcagtgtgtcaccgtcctggttccccaagggattaaggtcagggtttttggaacacaggagacagagacagaagagcggggagaggggagggaaggagggagaaacacagagaaaggatagaaggaggagggagaggaagagagaaatatggatgatcgatagataggtgatagatgatttattgactgataggtgataatagatgattggaagattgataatcaattctataggtagatgctacacggagggatgggtggtcttgctatgttaccccagatgacatactttttttttttttttttttttttgagatggagtttccctcttgttgcccaggctggagtacactggtgtgatcttggctcactgcaacctccacctcctgggttcaagcgattctcctatctcagcctcctgagtagctgggattacaggtgcgtgccaccacgcctggctaatttttgtatttttagtagagacggggtttcaccatgttggccaggctggtctccaactcctgacctcgtgatccaccctccttggcctcccaaagtgctggcattacaggtgtgagccaccgtgtccgacctttattttttgggatggagtctcgctctgtcgcccaggctggagtgcactggcgtgatctcagctccctgcaacctgtgcctcctgggttcaagagattctcctgcctcagcctcctgagtagctgggattacaggtgcccaccaccacacctggctaatttttgtatttttagtagagacggggtttcaccatgttggccaggctgatcttgaactcctgacctcaagtgatccacccgcctcggcctcccagagtgctggcattacaggtgtgagccactatgtccgaccctttttttggggggatggagtctctgtctgtcacccaggctggagtgcactggcgtgatctcagctcactgcaacctgtgcctcctgggttcaagagagtctcctgcctcagcctcccgagtagcagggattacaggtgcctgccaccacacctggctaatttttgtatttttagtagagacggggtttcaccatgttggccaggctggtcttgaactcctgacctcaagtgatccacccgccttggcctcccagagtgctgggattacaggtgtgagccacggcacctggcctctagtctggtactttcagcactgctagagtataagattgagttttcacctgcaagctggtattcagcgtatccactcagagccctcggaggaagcttagggggatgatttcacaaagggaggcaggtgcgtgtcgccaaatccaggtaaaaaccaataccatggccgggcatggtggctcacgcctgtaatcccagcactttgggaggccgaggcgggtggatcacctgaggtcaggagtttgagaccagcctggccaacatggtgaaaccctgtctctactacaaatacacaaattagcagggtgtggtggcgggtgtctgtaatccgagctactcgggaggctgaggcgggagaattgcttgaacctggaaggcggaggttgtagtgagccgagatcacgccactgcactccagcctgggagactgtaggagacagaaggttgtttcctaatcggctctgtctggttgcaattcttcagctcagtaacaacgaatgttcgtgcacatttcgtgaaatttgtctgcatgaaggagtcacatttgaggttcacgtgaatactagtcaaagaggatttcaacagaaactgctttatccaaattcaggtaagcaagacagctcagggatccgtttacagcactggccccaccaccccgccagcatcaaagtacatcccgttgaacttcggagtgaaaattattttgtttctacctcttcccaggaagggagggtaccgctgctcagaatttctcctgtttcatctacaatgcggatttaatgaactgtacctgggcgaggggtccgacggccccccgtgacgtccagtattttttgtacatacgaaactcaaagtaagtgttcacctcatgtgaagaattatgaggaatgcagggatgggagaaaaaatcatgctggttttctttttttcctttttctttttttaagacatggtcttgctctgttgcccaggctgcaatgcaatggtgccacctcggctcactgcaacctcgacctcctgggttcaagcaattttcctgcctcagcttcccaggtagctgggattacaggcgcccgccaccacaccaggccacatctatgtatttagagacagagtcttgctctgtcgcccaggctggagtgtagtgatgtgatctcagctccctgcaacctgcgcctccctccagggttcaagtgattctcctgcctcagcctcccaagtagctgggactacaggtgcactccaccacacctgtctaatttttgtatttttagtagagacagggtttcaccatgctggccaggctggtctccaactcctgacctcaagtgatctgcctgcctcaacctccccaaagtgctgggattacaggcgtgagccactgcacctggcctgtttttttggttgttgttttgttttgtgttttttgttttgttttgtgtttctttttgttttgccttgtgtttttgtgttcttgttttgttttgtgtttctgtgtttttcttttgtttttgtgtttttttggtttcacgtttttgtggtgttttgtgtttttgtgtttttgttttttgtgtttgtttttgttttgttttgtgttttgttttgtgtttgtttttgttttgttttgtggtttttgttttgtgttgtgtttgtttttgttttgtgtttttttgtttgtgttttggtgtttttgttttgtggttttcttttgtgtttgtttttgttttgtgtttttgtgtttttgtttcattttgttttgttttgtgtttttgtgttttgttttgttttgtgtttgtttttgttttgttttgtgtttttgtgtttttgttttgtgttttgtgtttttgtgttttgttttgttttgtgtttttgtgttttgtttttgtgttttgttttgttttgtgtttttgtgttttgttttgtgtttgtttttgttttgttttgtgtttttgtgtttttgttttgtgttttgtgttttgttttgtgtttttgtgttttgttttgttttgtgtttttgttttgttttgtgtttttgatttgtgtttttgtgttttgttttgtgtttgtttttgttttgtgttttgtgtttttatgttttgttttgtgtttgttttcgttttgttttgtgtttttgttttgtgttttgtgtttttgtgggttttttttgttttgtgtttttgttttgtgtttttgtgttttgtgtttttgtgttttgttttgtgtttgtttttgttttgttttgtgtttttgtgttttgttttgttttcctgattgctctctgagcactttctaatctttcaggagaaggagggagatccggtgtccttattacatacaagactcaggaacccatgtgggatgtcacctggataacctgtcaggattaacgtctcgcaattactttctggttaacggaaccagccgagaaattggcatccaattctttgattcacttttggacacaaagaaaataggtgagaataacacatatgattttcctattgtttataggtgaaatggaatttgccttaaaatctgtgtaactgaggccacgtgcggtgtctcacacctgtaatctcagcactttgggaggccgaggcgggccgatcacctgagatcgggtgttcaaaaccagcctgaccaacatggggaaaccccatctctactaaaaatacaaaaattagccgggcatggtggcgcgtgcctgtaatcccagctactcggaaggctgaggagaatcactcaaacctaggaggcggacgttgcaatgaggtgagattgtgccactgcactccagcttgagcgacagagcaagactctgtctcaaaaacaaacaaacaaaaatctgtgtaactttggtgctgtaacaaattagaactgagctgatttaactttcctttttttgagatagagtctcgctctgtcacccaggctggagtgcagtggtgcaatctcagctcactgcaacctctgcctcccaggttcaagcgattcttctgtcttagtctccttagtagcttggattacaggtgcacaccaccacgctcggctaatttttgtatttttagtagaggcagtgtttcaccatcttggccgggctagtctcgaactcctgacctcagatgatccacctgcctcagcctcccaaagtgctgggattacaggcgtcagccactgcacctgacctccctctttacctccttccttctttccttcctccctgcctttctgcctttcttcttttttcttccttccttccttccttccctccctccctcctttccttccttccttcctccttccctcccttcttccttccctccctccctctctccctcccttcttcattccttccttcttcctctccttccttctccttcactcatttcctccttccttcctctttttcttcatttcttcctcaccagcacctcttcgtgtcccagtgccctgctcctggctggcctcttggagccagtcccatatgcccacacgctctcctcttcccaagcccaccgcatcccacccgtggactccttcatcccgttggacgttcccagcctcttcaggcttaggactctcacagaagtgtgactcctgcccaccaagcccatccccacctcccaccctggaacccctgccccagtgggtatctctcctgtacatggtagctgccccacctccacttggacccagtgtagacaggaggagaccctgtaccacctccacctggacccagtgtagacaaagaggtgtccctactccacgtccacctggatccagtgtagacaggaggagactgcaccacctccacctggacccagtgtagtcaaagagatgtccctactccacgtccacctggacccagtgtagacaggaggagaccctgtaccacctccactttacccagtgtagacagaaggagaccctgcaccacctccacctggacccagtgtagacaaagaggtgtccctactccacatttacctggacacagtgtagacaggaggagactgcaccacctccacttggacccagtgtagacaggagaccctgcaccacctccacctggacccagtgtagacaaagaggtgtccctactccacgtccacctggacccagtgtagacaggaggagactgcaccacctccacctggacccagtgtagacaaagaggtgtccctactccacatttacgtggacacagtgtagacaggaggagaccctgccccacctctacctggacccagtgtgaaggcgaccagcccttccacacatgtgggtatttctcgtcaggtgggacgagagactgagaaaagaaataagacacagagacaaagtatagagaaagaacagtgagcccaggggaccggcgctcagcatacggaggacctgcaccggtctctgagttctctcagtatttattgcttactattttcactatcttggcaaggggaatgtggcaggaggacagggtgatagtggggagaaggtcagcaggaagacatatgagcaaaggaatctgtgtcacaaataagttcaagggaagctactatgcctggatgcacacgcaggccagatttatgcttctctccacacaaacatcagtgtagcaaagagtcacagagcagtattgccaccagcatatctcgcctccagccacagggcggttttctcctgtctcagaatagaacgaatgtacgatcgggttttacacggagacattccattcccaggggcaggcaggagacggagggcttcctcttatctcaaccgcgagaggacttcctcctcggcacagaccctttatggatgtcgggctgggggacggtcaggtctttttcccttcccacgaggccatatctcagactgtctcagtggggggaaccctcagacaatacccgggctctctcgggcagaggtccctgcggctttccgcagtgcatggtgtccctggttaatagagaatggagaatggcgatgacttttaccaagcatgctgcctgcaaacctattgttaacaagacacagcacatgtttctgtgagcacagtgttggggctacagttacagcttaacagcatctcaaggcaaaacagtggttcaacatacagatcacaatggagtttcttaccttcctttctacatagacacagtaacagtctgatctttctttttgtttgtttgtttgtttttctgagacagagtctcactctgtcgcccacccaggctggagggcagtggcgggatctcggctcactgcaacctccgcctcccgggttcacgccattctcctgcctcagcctcccgagtagctgggactacaggcacccgccaccacgcccggctaatttttttggatttttagtagagacggggtttcaccgtgttagccaggatggtctcgacctcctgacctcgtgatcctcccgcctcggcctcccaaagtgctgggattacaggcgtgagccaccgcgcccagccccctgatctctctttcttttccctacacagagtagacaaagaggtgtccctactccacatttacctggacccagtgtagacaggaggagaccctgccccacctccacctggacccagcgtagacaaagaggtgtttctactccatatctacctggacccagtgtagatgggaggagaccctgccccatctccacctggacccagtgtagacaaagaggtgtccctagtccacatccacctggaccgagtgtagacaggaggagaccctgccccacctccacctggacccagtgtagacaggagaagactctgcaccacctccacctggacccagtgtagacaggaggagaccctgccccacctccacctggacccagtgtagacaggagaagactctgccccatctccacctggacccagcgtagacaaagaggtgtttctactccatatctacctggacccagtgtagatgggaggagaccctgccccacctccacctggacccagtgtagacaggagaagactgcaccacctccacctggaccgagtgtagacaggaggagaccctgccccacctctacctggacccagtgtagacaggaggagaccctgccccatctccacctggacccagtgtagtcaaagaggtgtccctactccacctccacctggacccagtgtagacaggacctactccacctccacctggacccagtgtagacaggaggagactctgcaccacctccacctggacccagtgtagacaggacctctcgggttcaggggtgtgtcctgcgccctcgttacagaacgattcaaccctcccagcaatgtcaccgtacgttgcaacacgacgcactgcctcgtacggtggaaacagcccaggacctatcagaagctgtcgtacctggactttcagtaccagctggacgtccacagaaaggtcggtgagagctccccggggctgggcaccaggagggaggcgtacgggacacgcccgcacaggagcctgggaatcccggggaagtggcctgggggaaggatgcgtgggtggtgagcggtgactctggggtgaacgcacttcgggtagcggaggaagaggtgaagggtctgtggcctgtggagccaccttgaaagaggttgcagggagggtggacaaggatgatcctgcaaccatggaaccaggaagtggaccgggaggtgtgggggacgatgccacaagcaaggagagcctctgctccacctccagctggacgcagtgtagacagaaggagaccctgccccatgtctacctggacccagtgtagataggaggacacccgaccccacctccacctacacccagtgtagacaggaggagaccctgctccacctccatggagacccagtgtagacaggaggagttcttgtcccacaactacctggacccagtgtagacagggagagagactgcctcacgtccacctcgatccagtgtagacaagaggagatcttgtctcacaacctcctggacccagtgtagacaagaagagaccctgccccatgtccacctcgagccagtgtagacaagaggagatcttgtcccacaaccacctggacccagtgtagacaagaaggagagcctgctccatgtctacctggacgacaggagaacaccctgccccaaggccagtgggacctttctggatgggttacaggaagatatctggccaggaagacttctgtgtttgcagctcctcatcctacctgtcttgtagattcggggtttgtggagggagacctgcctgccactccgcagggactccttcccattcggtgcccacaccaggggagacactgtgtgaaccatctacagtgttttagaaatggaaacagtgagccttgtgttgtgttttgttttgtttctagaatacccagcctggcacggaaaacctactggtaagtgaaaccacagaccctactgacaaccctcagcgtaaccctacggtcccctactcaccacacctagtgtaactctacagtcccctactcatgacccctacagtcccctaccgacgacctccagcgtaaccctacggtcccctactcaccacacctagtgtaactctacagtcccctactcatgacccctacagtcccctactgacgacctccagcgtaaccctacagtcccctactcaccacacctagtgtaaggaggaggagaccctgccccacctccacagagacccagtatagacaggaggagctcttgtcccacaaccacctggaccccgtgtagacaggaagagaccctgccccacgtccacctagcttaatcctacagtcccctactcaccacacctaatgtaactctacagtcccctactcatgacccctacagtcccctaccgatgacctccagcgtaaccctacagtcccctactcaccacatctagtgtaactctacagtcccctactcacgacccccggagtaatcctacagtctcctactcacgacgcctacagttccctattcatgacccctagcgtaaccatacagtcccctacccatgagccctggcataaccctacaatcccctactcaccacacctagcataaacctacagtcccctacccatgacccctggagtaaccctacagtcccctagtcactacacctagtgtaactaaccatacagttccctatccatgacctctggcggaaccctacactcccctactcacaacccctagtgtaaccctacagtctcctacccatgacccctggcggaactgtacagtcccctactcacgacccctacactctcctacccatgacccctggcggaaccctacagtcccctactcacgacccgtacagtctcctacccatgacccctggcagaaccctacagtcccctactcacgacccctacactctcctacccatgacccctggcagaaccgtacagtcccctactcacgacccctacagtctcctacccatgacccctggcggaactgtacagtcccctactcacgacccctacagtctcctacccatgacccctggcggaactgtacagtcccctactcacgacccctacactctcctacccatgacccctggcggaaccctacagtcccctactcacgacccctacagtctcctacccatgacccctggaggaaccctacagtcccctactcacgacccctacagtctcctacccatgacccctggcggaactgtacagtcccctactcacgacccctacagtctcctacccatgacccctggcggaaccctacagtcccctactcacgacccgtacagtctcctacccatgacccctggcagaaccctacagtcccctactcacgacccctacactctcctacccatgacccctggcggaaccgtacagtcccctactcacgacccctacagtctcctacccatgacccctggcggaaccgtacagtcccctactcacgacccctacactctcctacccaagacccctggcggaaccctacagtcccctactcacgacccctacactttcctacccatgacccctggcggaaccctacagtcccctactcacgacccctacactctcctacccatgacccctggcggaaccctacagtcccctactcacgacccctacagtctcctacacatgacccctggcggaaccctacagtcccctactcacgacccctacagtctcctacccatgacccctggaggaaccctacagtcccctactcacgacccctacagtctcctacccatgacccctggcggaactgtacagtcccctactcacgacccctacagtctcctacccatgacccctggcggaaccctacagtcccctactcacgacccgtacagtctcctacccatgacccctggcagaaccctacagtcccctactcacgacccctacactctcctacccataacccctggcggaaccgtacagtcccctactcacgacccctacagtctcctacccatgacccctggcggaaccctacagtcccctactcacgacccctacagtctcctacccatgacccctggaggaaccctacagtcccctactcacgacccctacagtctcctactcatgacccctggagtaaccctacagtcccctactcacgacccctacagtctcctactcatgacccctggagtaaccctacagtcccctattcaggagccgtagtgtgaccctacaatcccctactcacaacccccggtggaaccctacagtcccctacccatgacccctggtggaaccctacagtcccctactcacgacccctacactctcctacccatgacccctggcggaaccctacagtcccctactcacgacccctacagtctcctacccatgacccctggcagaaccctacagtcccctactcacgacccctacactctcctacccatgacccctggcagaaccctacagtcccctactcacgacccctacagtctcctactcatgacccctggagtaaccctacagtcccctattcaggagccgtagtgtgaccctacaatcccctactcacaacccccggtggaaccctacagtcccctacccatgacctctggtggaaccctacagtcccctactcacgacccctacactctcctacccatgacccctggtggaaccctacagtcccctactcacgacccctacactctcctacccatgacctctggtggaaccctacagtcccctactcacgacccctacactctcctacccatgacccctggcggaaccctacagtcccctactcacgacccctacagtctcctacccatgacccctggcagaaccctacagtcccctactcacgacccctacactctcctacccatgacccctggcagaaccctacagtcccctactcacgacccctacagtctcctactcatgacccctggagtaaccctacagtcccctattcaggagccgtagtgtgaccctacaatcccctactcacaacccccggtggaaccctacagtcccctacccatgacctctggtggaaccctacagtcccctactcacgacccctacactctcctacccatgacccctggtggaaccctacagtcccctactcacgacccctacactctcctacccatgacctctggtggaaccctacagtcccctactcacgacccctagtgtaaccccacatgacccccagtgtaaccctatagtcccctacccacgacctatgtctgcctagacccagtgtgatcaggaggagaccccacctcacctccccctagacccagtgtagacaagaaggagagcctgccccacgtctacctggatccagtgtagacaggagaatactctgcccgacatacagttgaaccactcacaaccctagcgtcaccctacagtctccacgaaccctacagtcttggtttatgggactcttagtgccagtgtggcccaggggtggacacggtggatcctgaaccagaggatgcagatctcacacgggtgagggccccctcatagttctcactgggcagggtctgctcttggcctcaaccttcgtgtcccaatggttggaatatttatgctcagcctgttctactgattttcccattttattcctctttcctctacgtgggttaagaatatattctagtgactgtctaaggagattatgtctccctctaaaatgcttttagagtgagtactgttgccgggtatttaccaagtctcgcggccactctgaccctcggtatcctcctctgtccgatgagtatgctagacttggggatcttaatatcccttgctaaactatccgtctgaaggtctgttaatatcagttgttgatcctgaatcatttatttatgtatgtatttatttttgagacggagtctcgctctgtcccccaggctggagtgcagtggtgcgatctcggctcactgcaagctccacctcccagcgattgtcctgcctcagcctccctacagagattctacagtctcagcctgtagctgggactacaggcacccacccccacacctggccaacaatttctgtttcagaaaataaaattttagccaggcacggtggctcacgcctgtcatcccagcaccttgggaggctgaggtgggcggatcacttgaggtcagcagttcaagaccagcctgggcaacatggagaaaccccatctctactaaaaatacaaaacgtacccatgcgtggtggcgggcgcctgtaatcccagctacgtgggaggctgaggcaggagaatggcgtgaacccgggaagcggaggttgcggtgagcccagatcatgccattgcactccagcctgggcgacagagcgagagtgtctcaaataaaataaaataaaagaggccgggcgtggtggctcatgcctgtaatcccagcactttgtgaggccgaggcggtcggatcacgaggtgaggagatcgagaccatcctggccaacatggtgaaaccccgtctccactaaaaatacaacaaaaattagccgggcgtggtggtgggcacctgtagtcccaactactggggaggctgaggcaggagaatggtgtgaaccctggaggtggaggttgtagtgagccaagatcgcgccactgcactgcagcctgggtgacagagggagactccgtctcaaaaaataaataaataaaataaaataaaaaagcttaaagcctacatcacccaaattttcccaacttgtctcccatcgaaatactaacgaggcttgactctgcttagcttcgaagacccgatcagaccaagtgcattcagagtggtagaaaaaaaagaagaaaaagaaaaaaagaaaaggagaaaaaaacttaaaagacaaaagaacgaaaaaaggcaaccttttcctccacacagaagacgcctatctctaactttcttttttcctccaaagattaatgtttctggtgatttggaaaatagatacaactttccaagctctgagcccagagcaaaacacagtgtgaagatcagagctgcagacgtccgcatcttgaattggagctcctggagtgaagccattgaatttggtaagcgttgggcggaggtaagggatgtttgtgccgtctgcggccaccctgcagcaggcacagaggtcaggtgctctgtcctgggcgctgagatcgagttgagcacgtcgctgggagtagtgtcaggctctgagcttatcgctgaggctcaaaagaaggaggtggtctcgtacttggtcccgcaacattgctttgctgatgttttttcaggacggatgagttggctcccttaataaccagagaagggccaggtgcagcggttcacgcctgtaatcccagcaatttgggaggctgaggccggcggatcaccggaggtcaggagtttgagaccagcctggccaacatggtgaaaccccgtctctactaaaaatacaaaattagcccagcattgtggcaggtgcctgtaatcccagctactcgggaggctgaggcaggagaatcacttgaacccaggaggcggaggttgcactgagctgggatcacgccattgcactccagcctgggtgacagcgtgagactccgtctcaaaaaaaaaaagaaaaaaaaatacaaaaactaaccaggattggtggcacattcctgtaatcccagctactcaggaggctgagggcaggagaatgacttgaacccgggaggtggaggttgcagtgagctggggtcacgccattgcactccagcctgggtgacagagtgagactctgtctcaaaaaaaaaaaaaaaaaaaaaaagaaaaagtagaaggaggtggtctcatactcatacggggtcatgcaacattgctttgctggtgtttttttcagggtggatgagctagaatcccttaatagccagagaaggaccccactgatagccctcctaaagtcccacctccctctgctccactgggaaacaatcagtcagtctttgtccggtcaaaccgtcaccattccggctccctggccaaggggaagctctctccctctttttttcttttttttttttttttttttgagacggcgtttcgctcttgtcgcaggctggagtccagtggcgcaatctcggctcactgcaagctccacctcctgggttcacgccattctcctgcctcagcctccccagtagctgggactacaggtgcccatcaccacgcctggctaattttttgtatttttttttttttagtagagacagggtttcactgttttttagccaggatggtctcgatctcctgacctcgtgatccgcccacctcggcctcccaaagtgctgggattacaggcgtgagccaccgtgcccggccctccctcttttttttttttttttttttttagatggcgtttcgctcttgttgcccaggctggagtgcagtggtgccatctcggctcaccgcgatctccgcctcccaggttcaagcaattctccagcctcagtctcccgagtagctgggattacaggcgcccgccaccacacccggctaattttgtatttttagtagagacggggtttcaccatgttggtcaggctgttcttgaactcctgacctcaggtgatctgcccacctcgccctcccaaagtgctgcaatgacaggcgtgagccaccctgcccgtccggggaagctctcttcaaagccaggtctcggctgcccaggagacaggtctatgcttttctctgaagatgattttgagggctccaaattgaaaaggggaaggggcaggatattgagaagtatgcggttttcacctcaacaaagggtacagaagaaaaattgtgagctgcagtgcagtggtgcacctctacctcccagatcacacagacaaaatggggtacagggatgatcagaggtgcattcgtgtctggtgggccggggtgactgcacctgtaagaaattttttttgtttatttattttttgttatttgagacggactctcgctctgtcacccaggctggagtgcaatggcacgatctcagctcactacaacctctgcctcctgggttcaagcgattctcctgcctcagcctcccgagtagctgggattacattagacatgcatcacgcttggccaatttttgtatttttctttttatttatttatttatttattttgagatggagtttcgctgtgtcacccaggctggagttcaatggcacgatcttggctcactgcaacctccgtctcccaggctcaagcgattctcctgcctcagcctcctgagtagctacgattacagacatgcatcatgcttggccattttttaaatatttttatttatttatttattttgagacagggtctcactctgtcacccaggctggagtgcaatggcacgatctcggctcactgcaacctccgcctcccgggttcaagcgattctcctgcctcagcctcccgagtagctgggattacagacatgcatcacgcttggccaatttttgtatttttatttttatttatttatttatttattttgagatggagtttcgctgtgtcacccaggctggagtgcaatggcacgatcttggctcactgcaacctccgtctcccaggctcaagcgattctcctgcctcagcctcctgagtagctgggattacagacatgcatcatgcttggccattttttaaatatttttatttatttatttattttgacacagggtctcactctgtcacccaggctggagtgcaatggcacaatctcggctcactgcaacctccgtctcccaggctcaagcgattctcctgcctcagactcccaggtagataggattacaggcacccaccaccatgcctggctaattttgtattttttttttagcagagatgaggtttcaccatgttagtgaggcttgtctcgaactcctgacctcagatgatgcgcccgcctcggcctcccaaagtgctgggatgacaggtgtgagccaccgtgcctggcccaatttttgtatttttggtagagacggggtttcaccatgttggtcaggctggtctcgaactcccaacctcaggtgatcctcccgtgtcggcctcccaaagtgctgggatgacaggcgtgagccaccgcatccggcccatggtggcaaagttttaacagctcaccagaaatttccttgtgggcaaaacatagggcaggcaggttgctttcatctcagagccatcttagttaagaaccaaaaacagggaggcaggtttgctgggcccagttctcagcttgactgttccctttggctaaatgcatttggacacccgaagagatttaatttcctttcacatgtccgtcaacgattcaccgcagacgcaaacctgtgtgtctctccaggttctgacgacgggaacctcggctctgtgtacatttatgtgctcctaatcgtgggaacccttgtctgtggcatcgtcctcggcttcctctttaaaaggtaacctgtgaaacacctgggcctccccaatgaaaacaggccaggccgggaggaaagcgctttgtccagtctctgtctctgtctctgagaaagagaaacacagccttggccgggcgtgttggctcatgcctgtaatcccagcactctgggaggccgaggcgggtggatcacgaggtcaggagatcgagaccatcctggctaacacagtgaaaccccgtctctactaaaaaattagcccggcgtggtcgcgggcgcctgtagtcccagctactcgggaggctgaggcaggagaatcgcttgaacccgggaggtggaggttgcagtgagccgagattgcaccactgcactccagcctgggcgacagggcgagactccatctcaaaacaaacaaaagaacggagaaaacgggagatcctacaggaatacacagtgatgctcacagggaatctttctagaatcttccctcagcccctcgggcacagggatgggaatggaacaggcagtcagctgtgggcagcttcagggagtctgaagtcactgctgttgaagggctgagctccagaggggaaacgcctgccttgatcccactagccttgaagagcgtggtttctgggttggaggtgggtttttttttgtttgtttgtttttttgttttttgttttgagacagacttttgctcttgttgcccaggctggagtgcagtgttgcaatctcggctcactgcaacctccacctcccgggttcacgccattctcctgcctcagcctcccgagtagctgggattacaggcatgcaccacgatgctcacctaatttttgtatttttagtagagatggggtttcaccacgttggccaggctggtctctaactcttgacctcaggtgatccacccgccttcgcctcccaaagtgctgggattacaggtgtgagccaccatgcctggcctagttccttaagatgtttgtcatttggtgatttttttttgtttttttgagatggagtctcactctgtcacccaggctggagtgcagtggtgcaatctcggctcactgcaacctccacctcccaggttcaagcaattctcctgcctcagcctcctgaatagctgggattacaggcaagcaccacgatactcagctaatttttgtatttttagtagagacggggtttcaccacgttggccaggctggtctcaaacctcaagtgatccacccgcctcggcctcccaaagtgctgggattacaggtgtgagccactgcacccggcctagttccttaagattttcgtcacttggtgattcttagtgaagttttgcatagttgagcgcagacaccccgcacgcagcatccctcggcacagggcgttgatggaaggaactctggtgacccggggttcattctcttcacactttttctctgtgtctcaggttccttaggatacagcggctgttcccgccagttccacagatcaaagacaaactgaatgataaccatgaggtggaagacgaggtaggcaggggtgggcggagcagtgacctgggatggaaggtggggagtggggagcgtgggacacggcctctgggtgtcgaccatcttgcttctccaccagatgggaccgcagcgtcaccaccggtgtggctggaatctgtatcccactcctgggccttctcccgggtcggggtcttctccaaggttggggtcagagtcatctctgtgagctccatcaggagaaactgaggcagggtggtggtcaagaaaaggaggagaagacggtagagagggccaggcacggtggctcatgcctgtcatcccagcactttgggaggttgaggcatgtggatcatctgaggtcagaggttcgagaccagcctggccaacgtggtgaaaccccatctctgctaaaaatacaaaaaattagctgggtgtggtggtgtacgcctgaaatcccagtgactcgggaggctggggcagtagaacggcttgaacccagggggcggaggttgcagtgagccgagatcgcaccactgcactccagcctgggtgacagagcgagactccatctcaaaagaaaaaagaaggtagagaggagaggcagaaatagagacaagagacagaggcagagaaagatggagggagagagatggaggagagagagaggaatgtagaagagaatgaggagacacaaaagagagggaaacaggcagacagactgacagaaacaaaggcagacacacagacagagaaacagagagagggagggagaaaagggagaaggaaagagagagacacgagacacagatggagaaacagagacagataaacaacaaacataaagacccaggcgggggccggtcgcggtgactcacatctgtcatcccagcactttgggaggccgaggcgggtggatcacttgaggtcgggagttcgagaccagcctgaccaacctgaagaaacctcgtctctactaaaattgcaaaaattagccaggtgtggtggcgcacacctgtaatcccacctactctggaggctgaggcaggagaatcacttgaacccaggaggcggaggctgcagtgagccgagatcgcaccattgcactctaacctgggcaacagagcaaaactctctatcaaaaacaaaacaaaacaaaaaaatcatccccagcagggagaggagagagacagagaggaacagaggcacagagaggggagagagacaaagacagagagacacagagaaagacacagaaaaagagagagagagggagaaggagacatagagacagggacaaagagaaaaagacggacagagagagaaacagagagacataggtggacacagagaggggagagagagagagagacagaaagagacagagagcaagggatgggagtggaagagagagacagatggaggaaaaagacagagagggaggcagataaaagacacacagagacaccgagagagacagggaagacagaggagtcggacttagtctcagcgagagcccagagagggtgaacaagggcgaggaaccatgtgacctgcaccctgagaccccattggcgctcctctcccacccacctctctccggctcagggactgcgtcttatgttgcagtaggctggcaggctggaaagtcaggccagggctgatgctgcatcccagaggcagaactgtcctgcattctcagagtgggagatgaaatttttaaaaaggaaataaaactcttgtcggggaacctcagcttttatcctttagacgtttgactgattagaccaggcccactcttctcctttacactttcggctgattgaatgaggcccacccttccccctttacaccttcgactgattagatgaggcccaccattcccctttagaccttcgactgatcagatgaagcccacccttcccctttagaccttcagcttattagataaggcccacccttaccctttagactttcaactgattaaatgaggcccactctccccgtttagacctttgactgattagatgaagcccacgcttctcctttggaccttcaactgattagatgaggcccacccttcccccttcagcctttcgactgattagatgaggcccaccctcccctttataccttcgactgattagatgaggcccaccctcccctttataccttcgactgattagatgaggcccaccctcccctttataccttcgactgattagatgaggcccgtccttcccccatttagatcttcaactgattagatgaggcccacctttccctttttagacctttgactgattagatgaggcctacccttctccctttagacctttgactgattagatgaggcctacccttctccctttagacctttgactgattagatgagacccacccttcccatttagaccttcaactcattagatgaagcccacccttccccccttcccctttagaccttcagcttattaattagacaaggcccaccccctttagaccttcaactgattagatgaggcccacccctcttcagaccttcaactgattagatgaggcccaccccctttagacctttgactgattagataaggcccacccacattctccagtccaatctcttttcctggaaatcagctgattgtggacttgacatctacaaagccccttcgtagcagccgctgagtcatggtttcattcaataactggggactgtagcctagtcacggggacacgtcattggtgccgggtatcagagacgaaggccaagagatgaaagagaaacagagactgaacccaaaagaggcagacacacaggaagatggagatagagacccagagatgggggtggaagaaggtgagagggggaggaaagagagacagagagggagacagagaaaagaggcagagagaccgagagagaggctgaacagcaagaccccagagagggtgactaagggtgagagacttgcgtgacccacatcccaagaccccgtgggtggccctctcccacccacctctctccagctcaggggctgtgtcttcctcccatggggaactccagttgcagcccagggttgcccccagcgccctcttctctgccacataggtaacatcctcctggttgccacttgcacacccccatcctagacctggccatctgtcattccattaccttccacccccacgccagcctcctccccggcccccgctttccactgacccccaggggtcccccacatcgaggtgccaggatgacggcttcaggcttcaaccttcccttctctgagctccatcagctccaggggcttagcacctgctgtaccctgcccaggtttcatgctcacaagctcttccaaagaccaccctgttcatcgtcaactatgaggtcccatgggtggatctgtctcagatctttaccccaggaaaaacccatggccaggtgcagtggctcatgcctgtcatcccagcactttgggaggccgaggcgagtggatcacctcgaggtcaggagtttgagaccagcctggccaacatggtaaaaccccatctccactgaaagtacaaaatttagctggtggcggctaaagggggaaaggtgggcctcatctaatcagtcgaaggtctaaagggggaagagtgggcctcatctgatcagtcaaatttgtggtggcgggcgcctgtaatcccagctactcaggaggctgaggcaggagaatcgcttgaacccgggaggccgaggttgcagtgagctgagatgacaccactgcactccagcctgggcaatagaatgagactccgtctcgagggagaaaaagaaaataaacacagcccactgagtcccaggctgagctcgtgaagatctgacagcctgaaccctcctttttctcagatcatctgggaggaattcaccccagaggaagggaaaggctaccgcgaagaggtcttgaccgtgaaggaaattacctgagacccagagggtgtaggaatggcatggacatctccgcctccgcgacacgggggaactgttttcttgatgatgctgtgaacctttatatcattttctatgtttttatttaaaaacatgacatttggggccaggcgcggtggctcacgcctgtaatcccagcactttgggaggccaaggcaggcggatcacctgaggtcaggagttcaagaccagcctgcccaacatggtgaaaccccatctggactaaaaatgcagaaatttacccaggcacggcggcggacgcccatcatcccagctacttgggaggctgaggcaggagaattgcttgaacccgtgaggcggaggttgtagtgagccaagatcgcaccattgcacaccaacctgcgtgacagagcaagattgcatctcaaaacaaacaataataataaataataaaaacctga

SEQ ID NO: 2857 - DNA, 41135 bp, human; identical to SEQ ID NO: 2847

SEQ ID NO: 2858 - DNA, 13385 bp, human
gagaagaaaagcaggtggaaggagaggaagcggatgccgtgggggtaagctaagttctttccttctgtggtctttgagcatgtcgagtcacccgggtacatgtttctgctgtgtctgtcgatagaaaagaaagagactgaactggaacataagatttcaaacgttggctcgagccgaagtggggacagcggcccagaagactgagagccaaggaaccttgcatatgagttgtcttctgcctttgttatatgcaggtttttaaaggcaaaattaaaaaaataaaataaaataaaaagagggaggtgttgttggaggacagggagggggcttctgtgaagctgtttgctgggaattctcgttggtttacagaaaaaaacaattgattaatgattggctgtacattgctaagctacagggcgttggggtgtagtatctagcacggaattatcacgtgaattcacagctatctgtggcatccggaagccgtttcgagagatgaacgcggccgggcgtggtggctcacgcctgtaatcccagcactttgggagactgaggcgggtggatcacctgaggtcgacagttcgagaccatcctggccaacatggagaaaccccgtctctactaaaaatacaaaattagccgggcatggtggtggcaggcacctgtaatcccacctactcaggaggctgaggcaggagaatcgtttgaacccgggaggcggagcttgcagtgagctgagattgcaccactgcactccagcctgggcaacaagacgagattctgtctcaaaaaaaagaaaaagaaaaaaaaagagatgaaaagagatgaacgcagagctgaaagggggagggagtgtgatggtgttactagttactagaaaggggtcctgatccagacttcaagaacgggttctgggatcttgcccaagaaagaactggaggcaagttcacattgcaaactgaaagcaagcttattaagatagtaaaggggggccgggcacggtggctcatgcctgtaatcccaacacttttggaggctgaggcgggcggatcacctgagctcaggagttcgagatcagcttggccaacatggcaaaaccacacctttattaaaaatagaaaaaattagctaggtgtggcagtgtgtgcctgtaatcccagctacttgggaggctgaggcaggagaatcgcttgaacccgggaggcggaggttgcagtgagcccagattgcaccgttgcactccagcctgggcaacaagagcaaaactctgtccccaaaaaaagataactaaaagaaaaaagtcgtggggagagatgctccactacaagggtgactgataaaggattcatctttgtcatgactatcttttgcagtaatcaatattgtatatatacatattatatattttttattattattattttgagatcatctggctgtgtcatccaggctggagggcagtggtgcaatcacagctgactgctgtcttgaattcctgggctcaagcaatcctcccatctcggcctcccgagtagctgggtcaaaggcaaatgccaccattcctggcaaatatttgtatttttgtagggacgagggtttcactgtgtttcccgggctggtcttgaactcctagactcaatctatcttcctgccccagcctcccaaagtggtgggatgacaggtgtgggccaccgcgcctggcccaatattatcatttttaaagcaaaacggattctcacactatgaaagcttttgttctgaagatatcaacacatcaggaggtttctgtgtctgttcagtcctcggtctgtttagtaaacagtattgatctgttcacatatcttgcgtcaggaatggctgacctccagggaatgctgcccagcctgtcccagcctccctgttcccagcccctattctagatggagtccctctaagctgggcgtggtgtaatcccaggactttgggaggctgaggtgggcggatcacctgaggtcaggagttcgagaccagcctggccaacagggtgaaaccccatctctactaaaaatacccaaaattagccggggcgtggtggcgggcgcctgtaatcccaatattttggaaggctgaggtgacagaggattgcttgaggccacagcaattccagaccagcccggggcaacatcgtaagattcccccatccctcgtgtataaaaaaaagattaaattattacaaattttaaaaaagacagaaatgaagcatcttaagttaccacccagattggggtactaagagtctggatttggacagcttgttgcgcgttttataggtgtgctaaatcacatttcactctttttgttgagacagagtctcgtgctgtcgcccaggctggagggcagtggcgcgatctctgctcaccgcaacctccgcctcctgggttcaagcaattctcctgcctcagcctcctgagtagctgggattacaggcacctgccaccacgcccggctaatttttgtattttttttttttttttttttttttggagacagcgtcttgctctgtcgcccaggctggagtgcagtggtgcaatctccgctcactgcaacctccacctcccgggttcaagcaattctcctgcattagcctcctgagtagctaggattacaggcacgtgccaccatgcccagctaatttttgaatttatttatttatttttttggagacagtatcttgctctgttgcccaggctggagtgcagtggtgcgatctcggctcactgtaacctccgcctcccgggttcaagtgattctcctgcctcagcctcctgggtagctgggattacaggtgtgtgctaccatgcccggctaatttttgtatttttagtagggatggtgtttcaccatgttggccaggctggtctggaactcctgacttcaaatgatccgctcaccttgacctcccaaagggctgggattacagacatgaaccacggagcccggccggatttcactctttagatttttggtttaaactcgagaagctcttctcgagggctgaaagctcttggtcccctgtaggtttgctgtagatgacagacatgaggcagattgattaataagagaaaagacatgcactttttttttcttttttttttttgagacggagtctcgctctgtcaccgaggctggagtgcactggcatgatctcggctcactgcaacctccaccttccaggttcaactgattctcctgcctcagcctctccagtagctgggattacaggcgtgtgctaccatgcctggctaatttttctatttttagtagagacagggttgttccatattggtcaggctggtctcgaacacctgacctcaggtgatccgcctgcctcggcctcccagtgtgctaggattacaggcgtgaaccactgtacccagccagatttacacatttatagaatgtgtatacacaagattcttcagaatgaggactccaccccacaatgaggttcagaagctagtacaccacattgagactacagaaggataggggattggatcctggtacaaaaaaaaaaaggttatagggttggggggaaagaggaattctattgaggagcaatatataatttctactgcggactgaactctgatttttttctttattttattttattttattttatttttttgagacagcatctcactctgccgcccaggctggagtgcagtggtgcgatctcagctcactgcaacctccacctcctgggttcacccgattttcctgcctcagcctcccgagtagctgcgattacaggcacccgccactacgcccagctaattttctttgtatttttagtagagacggggtttcaccatgttggccaggctggtcttgaactcctgacctcaggtgatccaacctcctcggcctcccaaagtgctgggattatacgcatgagccactgcacctagcttcttctttttctttttttttttctttctttttttcttttttttttttagatggagtctaactttgtcgcccagactggagtacagtggcacaatctcagctcaccacagcctccacctcccaaggtcaagcaattctcctgcctcagcctcccaagtagctgagattacaggcacgtaccactactgcctgagtaatttttgtgtttttagtagagacaacatttcaccaggttggccaggctggtctcgaactcctgacctcaagtgatccacacgcctcagcctcccaaagtgctaggattataggcaccagccaccacaccgggcctctgactttttttatcttgcccaaattcctatctaagaggtctgaggaggcaagccctacaaaccataaattctcatcaaatgggatttattgaaccctgtatatcgtgacttactttccaacctgactctggcaaacgttacaagacagagaaaaaaaacaacatatgttgccccaaaatatgtttcttagttgtattttttttttcttttaagatggtctcattctgtttccaaggctggagtgcagtggtgcaatcttggctccctgcaacctccgtcttctaggttcaagcgattctcctgcctcctcagccttccaaatagctggcgtaatatgcatgagccatcgtgcccagataattgttttttgttttttgttttttttttagtagagatggggtttcactgtgatggccaggctggtcttgaactcctgacctcaggtgatccaaccgcctcggcctcccaaagtgctgggattataggcgtgaaccactgctcccggctggagtacaggggcataatcttggctcactgcagcctctgcttcccaggttcaagtgattctcctgcctcagtctcccgagtagctgggactacaggcgcccgccaccacgcccagctaatttttttttttttttttgtattttttttttttagtagagatggggtttcactgtgtttgccaggatggtctcgatctcctggcctcatgatctgcccgcctcggcctcccgaagtgctgggatgacaggcgtgagtcaccgcgcccggcatgaaagggtttttcattaaaaatccttgttataccgtggagccctgtgttggggtaaaatatcatgatttccctcactctccatcattcttgctttgaatctgagaaggaagcttggcggcctctattttaggatcagccgaaaatttccagaaaggggaaagaaaactcattctgtaaacacaaaaaagaagaagagaaaaaagtataagcggtacagacaaaacgcaaagatgttgcataattttccgtgagtgcaaaatgtcctgtaaaccaaaaaagaggtatctgagacaggtctcagtccatttagaaagttcattttgccgaggttaaggacgcctgcccatgacagagcctcaggaaatcgcgatgacaggtgctgtggatacacagggcacaatttgctttcatacatttttttggcggggagggagctggggatccagtcttgttctgtcacccaggctgcagtgcaatggtgcaatctcagctcactatcactgtaacctccgcctcccgtgttcaagctattctcctgccacagccttctgagtagctgggattataggcacccactaccgcgcccagctaatttttgtatttttagtagagacggggtttcaccatgttggccaggatggtctcgaactcctggcctcaaatgatccacctgcctcggcctcccaaagtgctgggattataggcgtgagccatggcgcccagccctggtatgtaatttttaaaacctttgtagtaccttatttacgaataaaatgcgaggcaggtttgcctaagacagtttccactataacctttcatgattttggggtcctgagacttatttacctttcacagtttacagcaggaaaatccgtggagacagcagatccgagaagcggcgatgtttgcgtagaaccctgtacgtgcttccttcggcctgtcggtaatgtggttggggattttcttttttttaagtgaagtctaaagaactgaaatgttttgctccataatgatgaaccaggatagaagtgagaactcagggcagaagaatctgaatgaggaactgtctgacctatgacaaatttaacatgtcacgttccctctgagacagtacacatcctcctgaagcagcgtgacaaggcacatcctcctgaagggtctccaggcagaagagacgcatgaacctgtcaaaaaaaaaaaaaaaaagagccggccgggcgcagtggctcaagcctgtaatcccagcactgtgggaggctgaggcggggggatcatgaggtcaggagttccagaccagcctggccaacatggtgaaaccccatctctgctaaaaatacaaaaattagccgggtgtagtggcagttgcctctagtcccagctactccggaggccgaggcaggagaatcgcttgaacccaggaggcgtaggttgcagtgagccaagatcgcgccactgcactccagcctgggcaacagagcgacagtccgtcccaaacactgcaaaatatttaaagagatttattctgagccaaatatgagtgagcaagaaggcccagggaaaatagtctaaagagatcctgagaacacgtatccaagctggttgagcggcagtttggttttatatgtttttgtttgtttacttattttactttattttatttatttatttatttattttgagatgaagccttgctcagtctgttaggctggagtgcagtggcgcgatctcggctcactgcaacctccgcctcccgggttcacgccattctcctgcctcagcctcccgagtagctgggactacaggcgcccaccaccatgcccagctaattttttgtatttttagtagagaaggggtttcaccgtgttagccaggatggtctcgatctcctgacttcgtgatccgcccgcctcagcctcccaaagtgttgggattacaggcacccgccaccacgcccggccaatttttgtatttttagtagcgacggggtttcaccatgttggccaggctggtctcaaacttgtgacctcacatgatctgctcacctcggcctcccaaagtgctgggattacaggcgtaagccacagcgtccagctattttattttatttgttttattttttgtgacagagtctcactctgtcgcccaggctggagtgcagtggagcgatctcagctcactgcaacctctgcctccggagctgaagcaattctcccgcctcagcctcccaagtagctggcattacagaggtacgccaccacgcctggctaaattttgtttgtttgtttgtttgtttgtttgtttgtttttgtttttcagtagacacagggtttcactatgttggccaggctggtctcgaactcctgacctcacatgatctgcctgcctcagcctccagaagtactgggattacagccgtgagccacctcacccagccagcagcttggttttatgtttgtttatatatttatttatttatttatttttaatttttggagacggagtcttgctctgttgcctgggctggagtgcagtggcatgatcttggctcacggcaacctctgcctttcgagttccagtgattctcctgcctcagcctcgcgagtagctgggagtacaggcgcccgccatcacacccggctagtatttgtatttttagtagagagagggtttcaccgtattgtccaggctggtcttgaactcctgtcctcaagtgatccacccacctgagcctctcaaagtgctgggattgcaggcgtgagcctctgtggccagccaacagacagttttgcaggaccatttcaaaatatgtcaagtaaatatattttggggtgaaatgtattttaaagtggcatatactgatttcccacagtcttgtctggggaggcatatcctggcctcctagaaagcatacacagtagcagacaggtgtggtggctcacgcctgcaatcccagccctttgggaggccgaggcaggtggatcacaaggtcaggagatcgagaccatcctggccaacatggtgaaatgctatctctactaaaaatacaaaaattagctgggcgtggtggtgcatgcctgtaatcccagctactcgagaggctgaggcaggaggaccacttgaacctggcaggtggaggttgcagtgagctgagatcacgccactgcactccagcctgggagacagagcgaggctccgtctctaaataaataaataaagcttacgcagtagctgagaagacagggaaaagaggtgaagaaatgacagaaagcttagaagtcgctcattataaccccttcctaccccatctcatgcttcccttaaagcataaacgaagggtgcttgtgttacaggaaaggggttcggatccagcccccaagagggggttcttggatctcacgcaagaaagaattcagggcggccgggcgctgtggctcacacctgtaatcccagcaccttgggaggcagaggcgggcggatcacgaggtcaggagttcgagaccagcctgaccaacatggtgaaaccccatctctactaaaaatacaaaaattagccaggtgtggtggtgcgtgcctgtagtcccagctactcgggagacagaggcaagagaatggcgtgaacccgggaggcgatgcttgcagtgagtggagatcatgccactacactccagcctgggcgatagagtaagtccatctcaaaaaaaaaaaaaaaaaaaaaaaattcggggtgagtcagcagtgcaaagccaaagcaaatttattacaaaagtaaaacagtgaaagaatagctactccagaggccgggcgcagtggctcatgcctgtaatcccagcactttgggaggtggaggtgggcagatcacctgaggtcaggagttcgagaccagcctgaccaacatggtgaaaccccatctctactaaaaatacaaaaattagccaggcatggtggtgcgtgcctgtagtcccagctactcgggaggctgaggcagtagaattgcttcaacttgggagacggaggttgcagtgagccgagatggcaccactgcactccagcctgggcaacagaatgagactcagtctcaaaaaaaaaaaaaaaaatttcagggcgagcaagtttattatgaaagtaaaatagtgaaagactaggtactccagaggccaggcgcagtggctcatgcctataatcccagcactttgggagcccgaggcaggtggatcacctgaggtcaggagttcgagaccagcctcgccaacatggtgaaaccccatctctactaaaaatacaaaaattagccaggcatggtggtgcgtgcctgtagtcccagctacttggaggctgaggcagtagaattgcttcaacttgggagacggaggttgcagtgagccaagatggcaccactgcactccagcctgggcgacagaatgagactcagtctcaaaaaaacaaaagatttcagggcgagcaagtttattatgaaagtaaagtagtggaagactagctactccagaggccaggtgcagtggctcatgcctataatcccagcactttgggagcccgaggcaggtggatcacctgaggtcaggatttcgagaccagcctcgccaacatggtgaaaccccatctctactaaaaatacaaaaattagccaggcgtgttggtgcgtgcctgtagtcccagctactcggaggctgaggcagtagaattgcttcaacttgggagacggaggttgcagtgagccgagatggcaccactgcactccagcctgggtgacagaatgagactcagtctaaaaaaaaaaaaaattcagggcaagcaagtttattatgaaagtaaaatagtgaaagactaggtaatccagaggctgggtgcagtggctcatgcctataatcccagcactttgggagcccaaggcatgtggatcacctgaggtcagaagttcgagaccagcctggccaacatggtgaaaccccatctctactaaaaatacaaaaattagccaggcgtgttggtgcgtgcctgtagtcccagctactcggaggctgaggcagtagaatcacttgaacctaggagacagaggttgcagtgagccgagatggcgccactgtactccagcctgggcgacagagtgagactccatctccaaaaaataaataaataagtcaaccaagaaggccgtacgtacagtggctcacacctgtcatcccatcactttgggaggccgaggcagggggattacttgagatcaggagtttgagaccagcctggccaacatggtgaaaccccgtctctactaaaaatacaaaaattagccaggcgtgttggtgcgtgcctgtagtcccagctactcggaggctgaggcagtagaatggcttcaacttgggagacggaggttgcagtgagccgagatggcaccactgcactccagcctgggcgacagagcaagaccgtctacaaaataataataataattaataataataataataactagtgcaagagaagtacacaaatatcccaaacatttagtgactcagcagagggggccagtctcaaggaacaggacttctacacctgttaccaccacctggggagttgtatctgaatctcaaggtcaggcccacccagacagaacatgcatctctagggtgccacaggagagtctgtccagtgcccagaaacacctgcaagacccagaagcaggctccaagaagcggggtgccacagtccagtgggggaagcggccacatccctgtcatgtgggctacagatgagttggggggcaggggcaggagaagaagaaacaggtgtggcctacatgcttttacttcctcttagcaagcgaggttcctcttgcagaggaacggtctgagagacacaaccgttttttttttttgtttgtttgcttttccttgagacagagtctccctctgtcacccaggctggagggcagtggcgcgatctcggctcactgcagcctccacctcctgggttcaagcgattctcctgcctcaacctcccgagtagctgggattacaggcacccaccaccccacccggctaatttttgtatttctagtatagatgaggtttcaccgtattagccaagctggtcccgaactcctgacctcaggcgatccgcctgccttggcctcccaaagtgctgggattacaggcgtgagccactgtgcccggccgagagacgcaatctttcagagaggaggtttggagcaggaacctcagggtggacagatgggtcccaccaggtgcagatgcttgaactaaagatgctacaaaggccgggtgcagtggttcatgcctgtaattccagcagtttgagaagctgaggcaggcagatcatctgaggtcaggagttcgagcccagcctggccaacatggcaaaacagcgtctctactaaaaatgcaaaattagcctggcataatggcgggcgcctataatcccagctacttgggaggccgaggcaggagaatcgcttgaacccgggaggcggaggttgcagtgagccaagattgcaccactgcactccagcctgggtgacaagagtgaaactccgtctcaaaaaaaaaaaaaaaaaaagaagaagaagaaaagaaatacattagtttggtccataaaggcgggacaactcaaagtgggggcttccaggctataaatgaatttaaacattttctggttgacaattggttgagtttgtagctcctcctccttctcttcttcctcctccttctccccccttcctcctcttcctcctcttcctcctcctccttcttcttctcttctttcttcttcttctctttccccttcttcttcttcttcctcctccttctcctcctcctttttcttcttcttccttatgggcttggatagaagtatattgacatggatccaccatttgtagaatcataccgagtagcttcttttctcctccttcctctccttctcctcctcctcctcctccttctcctgctccttctcctcctcctcctcctgctccttctcctcctcctcctccttctcctcctcctcctcctgcttctcctcctcctccttctcctcctcctgcttctcctcctcctccttctcctcctcctccttctcctcctcctccttctcctcctcctcattctcctcctgctccccttctcctcctccttctcctcctcctccttctcctcctgctccccttctcctcctccttctcctcctcctcctcctcctgctcctcctcctccagctccccttctcctcctactcctccttctcctccttctccttctcctccttctcctactcctccttctcctactcctccttctcctactcctccttctcctcttccttcttctcctcctcctgctccttctcctcctcttcctcctactcctccttctcttccttctcctcctcctccttctcctcctcctccttctcctcttcctccttctcctcctcctccttctcctcctcctccctctcctcctcctccgccttctcctactcctccttctcctcctccttcttctcctcctcctgctccttctcctcctcctccttctcctcctgctccttctcctcctcttcctcctactcctccttctcttccttctcctcctcctccttctcctcctcctgcacctttcctcctcctccttctttttccttttttgcataaagaagtatcaaataagagtagtttcactgccctaaacatcctctgaggtccatgtattcatccctccatctgcccaacgccaaccaactccggatctttttactgtttccatgattttgtcttttccacagtgtccaagtgttagaatgactcagtctgcagccatctcaaagtggattctttcccttagtcataagtatttaaacttcattcatgtcgttttatgtactcaccctttttttcttcctcttcttttttttttttttttcactttccttttatagctgttgcaaaagtcaagattttttaaaaaatataaaagagcagggccgggcacggtggctcacgcctgtaatcccagcactttgggaggccgaggcaggtggatcacgaggtcaggagatggagaccatcctggctaacacggtgaaagcctgtttctactaaaaaaaaaaaaaaaaaaaaaaaattagctgggtgtggtggcaggcgcctgtagtcccagctacttgggaagctgaggcaggagaatggtgtgaacctgggatgtggaggttgcagtgagccgagatcgcgccactgcactccagcctgggtgacagagcgtgactttgtctcaaaaaagaaaaaaaaa

SEQ ID NO: 2859 - DNA, 2988 bp, human
gatcacagcactgcactccagcctgggagacaaagccagactccgtctcaaaaaaaaaaaaaaaaaaaaaaaaaaaaaaggaaaagaaaagaggaaattctgaacccagtgcccgctccttgcagatctgcgaacagtggcaccagcctctagtctcaatgtgaggtttgactccaggacgatgaatttaagctgggactgccaagaaaacacaaccttcagcaagtgtttcttaactgacaagaagaacagagtcgtggaacccagggtgagacgaatttcccattctcaacccctgtcctttacacacccctttctgagttaaaagcaacagggccggctgggcgcggcggctcacgcctgtcatcccagcactttgggaggctgaggtgggcggatcacctgaggtcgggagttcaagaccagcctgaccaacatggtgaaaccccgtctctactacaaatacaaaattagccgggcgtgctggtgcatgcctgtagtcccagctactcaggaggctgagggcagaagaattactcgaacccgggaggtggaagttgcagtgagtcgagctcgtgccattgcactccagcctgggtgacagagcgagactctgtctcataaaatgcaataaggccgggtgtggtggctcacgcttgtcatcccagcactctgggaggccgaggcaggtggatcacctgaggtcaggagttcaagaccaggctgaccaacatggtgaaaccccatctctactaaaaatacaaaaattagtcgggcatggtggcaggcatctgtaatcccagctactcgggaggctgaggcaggagaattactgaaactcgggaggcggaggttgcggtgagccgagatggtgccattgcactccagcctgggcaacaagagcaaaactctgtctccaaaaaaaaaaaaaaataataaattcaattaaataaaagcgagagggccacagacacaaacaacacaagtgtggtatttggagaaatgtcacagccataatctcacgggaaccgggaaagtgctgttagctcatgtccacaatgtgtaccagagcctgattccctgaggcagagcctatgttaccgtattttaccccaagagaagagaaatcctggcaaatgcagttggatgtgcccctgggtctgtggtggaagcaggacggagaaaagtaaagtgtcagtcacgttgtcagtgtgtcaccgtcctggttccccaagggattaaggtcagggtttttggaacacaggagacagagacagaagagcggggagaggggagggaaggagggagaaacacagagaaaggatagaaggaggagggagaggaagagagaaatatggatgatcgatagataggtgatagatgatttattgactgataggtgataatagatgattggaagattgataatcaattctataggtagatgctacacggagggatgggtggtcttgctatgttaccccagatgacatactttttttttttttttttttttttgagatggagtttccctcttgttgcccaggctggagtacactggtgtgatcttggctcactgcaacctccacctcctgggttcaagcgattctcctatctcagcctcctgagtagctgggattacaggtgcgtgccaccacgcctggctaatttttgtatttttagtagagacggggtttcaccatgttggccaggctggtctccaactcctgacctcgtgatccaccctccttggcctcccaaagtgctggcattacaggtgtgagccaccgtgtccgacctttattttttgggatggagtctcgctctgtcgcccaggctggagtgcactggcgtgatctcagctccctgcaacctgtgcctcctgggttcaagagattctcctgcctcagcctcctgagtagctgggattacaggtgcccaccaccacacctggctaatttttgtatttttagtagagacggggtttcaccatgttggccaggctgatcttgaactcctgacctcaagtgatccacccgcctcggcctcccagagtgctggcattacaggtgtgagccactatgtccgaccctttttttggggggatggagtctctgtctgtcacccaggctggagtgcactggcgtgatctcagctcactgcaacctgtgcctcctgggttcaagagagtctcctgcctcagcctcccgagtagcagggattacaggtgcctgccaccacacctggctaatttttgtatttttagtagagacggggtttcaccatgttggccaggctggtcttgaactcctgacctcaagtgatccacccgccttggcctcccagagtgctgggattacaggtgtgagccacggcacctggcctctagtctggtactttcagcactgctagagtataagattgagttttcacctgcaagctggtattcagcgtatccactcagagccctcggaggaagcttagggggatgatttcacaaagggaggcaggtgcgtgtcgccaaatccaggtaaaaaccaataccatggccgggcatggtggctcacgcctgtaatcccagcactttgggaggccgaggcgggtggatcacctgaggtcaggagtttgagaccagcctggccaacatggtgaaaccctgtctctactacaaatacacaaattagcagggtgtggtggcgggtgtctgtaatccgagctactcgggaggctgaggcgggagaattgcttgaacctggaaggcggaggttgtagtgagccgagatcacgccactgcactccagcctgggagactgtaggagacagaaggttgtttcctaatcggctctgtctggttgcaattcttcagctcagtaacaacgaatgttcgtgcacatttcgtgaaatttgtctgcatgaaggagtcacatttgaggttcacgtgaatactagtcaaagaggatttcaacagaaactgctttatccaaattc

SEQ ID NO: 2860 - DNA, 41089 bp, human; identical to SEQ ID NO: 2844

SEQ ID NO: 2861 - DNA, 26952 bp, human
tctctctgaccagcaccatgcttctcctggtgacaagccttctgctctgtgagttaccacacccagcattcctcctgatcccagagaaatcgggtaagtatggaaacctggctgaaccttctccgcggcccctgtttagatgtcctgcatctggagacccatctggatacctgggtccatctgcatttcatctctaatgtttatgagggacccaataagcaccagccaacccaccagaagctcagagctcctcttgttctcacctccttttctgctgttaattcccatccacccattctacagatgagaaaacggaggctcagatacctccacagtttaacccaacgaccatccaggtagtgatggggccaggatgaggacccatgtctgcatggggccaaagtgttccttccttccttcgttccttcgttccttcgttccttccttccttccttccttccttccttcgttccttccttcgttccttccttccttccttccttccttccctcccttgcttccttctcttcctcctgccctccctctttccatccttccttctctccttccttccatccttctctccctcctgattcatttcttctctttctttctcttccttccttccctccttccctttctctctttcttccttccattgtttccttctttccttccttcttccgtccctcccttctttctttctctttcttccttccctccttccctctctctctttcttccttccattgtttttctttctttccttccttccctccctccctccctctctctctctctttctttctttctttctcctttttttttctccttctttgtttctttcttcctctttcttctttctttctttctttctttccttctttctttttctttcttttcagagtctccctcttgttgcccaggctggagtgcaatggctcaatctcagctcactgcaaactcagcctcccgggttcaagcgattctcctgcctcagcctcccgagtagctgggattacaggcgcctgccaccaggcccagctaatttttttgtatttttagtagagatggggttttgtcatgttggccaggctggtctcaatctcctggcctcaggtgatcccgtgcctcggcctcccaaagtgctaggattacagctatgagccgccacacccagcctcttgtttgttgacttcttaatagcagccattgtgactggcgtggaatgatagctcattgtggttttgatttgcgtttccgggagggaccctcttgactgagggtgtcagggcctctgcttcaggaaagtatttccaggtttttgtgacctggttcagggaagacagacaaagacagctttctgtttctgcaattttctcaaattccttcagctttatattaaactgccaaggttccataatttgggaagtgtgttcagagccacatcactctggataaagagcctttgcctgttctcattcaagcggttttctttctctgtctctcttttttttttttttttttttttttttgagacaggatctcgctctgtctcccaggctggagtgcagtggcgtgatctcggctcactgcagcctcagctttctgggatcaagtatcctcccactccagcctcccaagtagctgggactgcagaaatacaccaccatgccaagctaatttaaattttttttttaattttatagaggagatcttgctatgttgccaagactagtttttgatttttttttttttttgagatggagtcttactctgtcacccaggctggagtgcagtggcgcgatctcggctcactgcagcctcagctttctgggatcaagtatcctcccactccagcctcccaagtagctgggactgcagaaatacaccaccatgccaagctaatttaaatttttttttttttaaattttatagacgagatcttgctatgttgccaagactagtttttgattttttttttttttttttttttgagatggagtcttactctgtctcccaggctggagtgcagtggcgcgatctcggctcattgcaacctccacctcccgggttcaaccgattctcctgcctcagcctcctgagtagctgggattacaggtacccgccaccatgtccacctaatttttttgtatttttagtagagacagggtttcaccacattggccaggctggtctcgaactgctgacctcaggtgatccgcccacctcagcctaccaaagtgctgggattgcaggcatgagccaccgcgcctggccagtttttgatgatttctgcagtaaacatctccatgtggagaaggagcaagctgggaccacagatgtgcaccatcacacctgcctaatttaaatttttaaaaaaaaattttttttaaagagatgcgatcttgctatgttgcccaggcgggatctgaacctactgggctcaagtcagctttttgcctcagcctcccaaggtgctgggattagaggcgtgagccaccacccccagtcttcagatgatttttgaatatttctgcagtagaaatctcctttttcagaaacagccagggggctgtgaaaaggagggaagatggacaagggaggaacagatacctgaggatgtgggacgtcctggggccatgtgggtgacagaggaaaatcagcaggcttcagccctgaacttcacctcccagagccgggtgggaggacagaaaacagggccggccgggcacggtggctcacgcctgttatcccagcacttcgggaggctgaggcaggcggatcacctgaggtcggcagttcgagaccagcctgaccaacatggtgaaacccccatctctactaaaaatacaaaaattagctgggcatggtggtcggcgcctgtcatcccagctactcgggaggctgaggcaggagaatcatttgaacccgggtggtggagcttgcagcttgcagtgacctgagatcacagcactgcactccagcctgggagacaaagccagactccgtctcaaaaaaaaaaaaaaaaaaaaaaaaaaaaaaggaaaagaaaagaggaaattctgaacccagtgcccgctccttgcagatctgcgaacagtggcaccagcctctagtctcaatgtgaggtttgactccaggacgatgaatttaagctgggactgccaagaaaacacaaccttcagcaagtgtttcttaactgacaagaagaacagagtcgtggaacccagggtgagacgaatttcccattctcaacccctgtcctttacacacccctttctgagttaaaagcaacagggccggctgggcgcggcggctcacgcctgtcatcccagcactttgggaggctgaggtgggcggatcacctgaggtcgggagttcaagaccagcctgaccaacatggtgaaaccccgtctctactacaaatacaaaattagccgggcgtgctggtgcatgcctgtagtcccagctactcaggaggctgagggcagaagaattactcgaacccgggaggtggaagttgcagtgagtcgagctcgtgccattgcactccagcctgggtgacagagcgagactctgtctcataaaatgcaataaggccgggtgtggtggctcacgcttgtcatcccagcactctgggaggccgaggcaggtggatcacctgaggtcaggagttcaagaccaggctgaccaacatggtgaaaccccatctctactaaaaatacaaaaattagtcgggcatggtggcaggcatctgtaatcccagctactcgggaggctgaggcaggagaattactgaaactcgggaggcggaggttgcggtgagccgagatggtgccattgcactccagcctgggcaacaagagcaaaactctgtctccaaaaaaaaaaaaaaataataaattcaattaaataaaagcgagagggccacagacacaaacaacacaagtgtggtatttggagaaatgtcacagccataatctcacgggaaccgggaaagtgctgttagctcatgtccacaatgtgtaccagagcctgattccctgaggcagagcctatgttaccgtattttaccccaagagaagagaaatcctggcaaatgcagttggatgtgcccctgggtctgtggtggaagcaggacggagaaaagtaaagtgtcagtcacgttgtcagtgtgtcaccgtcctggttccccaagggattaaggtcagggtttttggaacacaggagacagagacagaagagcggggagaggggagggaaggagggagaaacacagagaaaggatagaaggaggagggagaggaagagagaaatatggatgatcgatagataggtgatagatgatttattgactgataggtgataatagatgattggaagattgataatcaattctataggtagatgctacacggagggatgggtggtcttgctatgttaccccagatgacatactttttttttttttttttttttttgagatggagtttccctcttgttgcccaggctggagtacactggtgtgatcttggctcactgcaacctccacctcctgggttcaagcgattctcctatctcagcctcctgagtagctgggattacaggtgcgtgccaccacgcctggctaatttttgtatttttagtagagacggggtttcaccatgttggccaggctggtctccaactcctgacctcgtgatccaccctccttggcctcccaaagtgctggcattacaggtgtgagccaccgtgtccgacctttattttttgggatggagtctcgctctgtcgcccaggctggagtgcactggcgtgatctcagctccctgcaacctgtgcctcctgggttcaagagattctcctgcctcagcctcctgagtagctgggattacaggtgcccaccaccacacctggctaatttttgtatttttagtagagacggggtttcaccatgttggccaggctgatcttgaactcctgacctcaagtgatccacccgcctcggcctcccagagtgctggcattacaggtgtgagccactatgtccgaccctttttttggggggatggagtctctgtctgtcacccaggctggagtgcactggcgtgatctcagctcactgcaacctgtgcctcctgggttcaagagagtctcctgcctcagcctcccgagtagcagggattacaggtgcctgccaccacacctggctaatttttgtatttttagtagagacggggtttcaccatgttggccaggctggtcttgaactcctgacctcaagtgatccacccgccttggcctcccagagtgctgggattacaggtgtgagccacggcacctggcctctagtctggtactttcagcactgctagagtataagattgagttttcacctgcaagctggtattcagcgtatccactcagagccctcggaggaagcttagggggatgatttcacaaagggaggcaggtgcgtgtcgccaaatccaggtaaaaaccaataccatggccgggcatggtggctcacgcctgtaatcccagcactttgggaggccgaggcgggtggatcacctgaggtcaggagtttgagaccagcctggccaacatggtgaaaccctgtctctactacaaatacacaaattagcagggtgtggtggcgggtgtctgtaatccgagctactcgggaggctgaggcgggagaattgcttgaacctggaaggcggaggttgtagtgagccgagatcacgccactgcactccagcctgggagactgtaggagacagaaggttgtttcctaatcggctctgtctggttgcaattcttcagctcagtaacaacgaatgttcgtgcacatttcgtgaaatttgtctgcatgaaggagtcacatttgaggttcacgtgaatactagtcaaagaggatttcaacagaaactgctttatccaaattcaggtaagcaagacagctcagggatccgtttacagcactggccccaccaccccgccagcatcaaagtacatcccgttgaacttcggagtgaaaattattttgtttctacctcttcccaggaagggagggtaccgctgctcagaatttctcctgtttcatctacaatgcggatttaatgaactgtacctgggcgaggggtccgacggccccccgtgacgtccagtattttttgtacatacgaaactcaaagtaagtgttcacctcatgtgaagaattatgaggaatgcagggatgggagaaaaaatcatgctggttttctttttttcctttttctttttttaagacatggtcttgctctgttgcccaggctgcaatgcaatggtgccacctcggctcactgcaacctcgacctcctgggttcaagcaattttcctgcctcagcttcccaggtagctgggattacaggcgcccgccaccacaccaggccacatctatgtatttagagacagagtcttgctctgtcgcccaggctggagtgtagtgatgtgatctcagctccctgcaacctgcgcctccctccagggttcaagtgattctcctgcctcagcctcccaagtagctgggactacaggtgcactccaccacacctgtctaatttttgtatttttagtagagacagggtttcaccatgctggccaggctggtctccaactcctgacctcaagtgatctgcctgcctcaacctccccaaagtgctgggattacaggcgtgagccactgcacctggcctgtttttttggttgttgttttgttttgtgttttttgttttgttttgtgtttctttttgttttgccttgtgtttttgtgttcttgttttgttttgtgtttctgtgtttttcttttgtttttgtgtttttttggtttcacgtttttgtggtgttttgtgtttttgtgtttttgttttttgtgtttgtttttgttttgttttgtgttttgttttgtgtttgtttttgttttgttttgtggtttttgttttgtgttgtgtttgtttttgttttgtgtttttttgtttgtgttttggtgtttttgttttgtggttttcttttgtgtttgtttttgttttgtgtttttgtgtttttgtttcattttgttttgttttgtgtttttgtgttttgttttgttttgtgtttgtttttgttttgttttgtgtttttgtgtttttgttttgtgttttgtgtttttgtgttttgttttgttttgtgtttttgtgttttgtttttgtgttttgttttgttttgtgtttttgtgttttgttttgtgtttgtttttgttttgttttgtgtttttgtgtttttgttttgtgttttgtgttttgttttgtgtttttgtgttttgttttgttttgtgtttttgttttgttttgtgtttttgatttgtgtttttgtgttttgttttgtgtttgtttttgttttgtgttttgtgtttttatgttttgttttgtgtttgttttcgttttgttttgtgtttttgttttgtgttttgtgtttttgtgggttttttttgttttgtgtttttgttttgtgtttttgtgttttgtgtttttgtgttttgttttgtgtttgtttttgttttgttttgtgtttttgtgttttgttttgttttcctgattgctctctgagcactttctaatctttcaggagaaggagggagatccggtgtccttattacatacaagactcaggaacccatgtgggatgtcacctggataacctgtcaggattaacgtctcgcaattactttctggttaacggaaccagccgagaaattggcatccaattctttgattcacttttggacacaaagaaaataggtgagaataacacatatgattttcctattgtttataggtgaaatggaatttgccttaaaatctgtgtaactgaggccacgtgcggtgtctcacacctgtaatctcagcactttgggaggccgaggcgggccgatcacctgagatcgggtgttcaaaaccagcctgaccaacatggggaaaccccatctctactaaaaatacaaaaattagccgggcatggtggcgcgtgcctgtaatcccagctactcggaaggctgaggagaatcactcaaacctaggaggcggacgttgcaatgaggtgagattgtgccactgcactccagcttgagcgacagagcaagactctgtctcaaaaacaaacaaacaaaaatctgtgtaactttggtgctgtaacaaattagaactgagctgatttaactttcctttttttgagatagagtctcgctctgtcacccaggctggagtgcagtggtgcaatctcagctcactgcaacctctgcctcccaggttcaagcgattcttctgtcttagtctccttagtagcttggattacaggtgcacaccaccacgctcggctaatttttgtatttttagtagaggcagtgtttcaccatcttggccgggctagtctcgaactcctgacctcagatgatccacctgcctcagcctcccaaagtgctgggattacaggcgtcagccactgcacctgacctccctctttacctccttccttctttccttcctccctgcctttctgcctttcttcttttttcttccttccttccttccttccctccctccctcctttccttccttccttcctccttccctcccttcttccttccctccctccctctctccctcccttcttcattccttccttcttcctctccttccttctccttcactcatttcctccttccttcctctttttcttcatttcttcctcaccagcacctcttcgtgtcccagtgccctgctcctggctggcctcttggagccagtcccatatgcccacacgctctcctcttcccaagcccaccgcatcccacccgtggactccttcatcccgttggacgttcccagcctcttcaggcttaggactctcacagaagtgtgactcctgcccaccaagcccatccccacctcccaccctggaacccctgccccagtgggtatctctcctgtacatggtagctgccccacctccacttggacccagtgtagacaggaggagaccctgtaccacctccacctggacccagtgtagacaaagaggtgtccctactccacgtccacctggatccagtgtagacaggaggagactgcaccacctccacctggacccagtgtagtcaaagagatgtccctactccacgtccacctggacccagtgtagacaggaggagaccctgtaccacctccactttacccagtgtagacagaaggagaccctgcaccacctccacctggacccagtgtagacaaagaggtgtccctactccacatttacctggacacagtgtagacaggaggagactgcaccacctccacttggacccagtgtagacaggagaccctgcaccacctccacctggacccagtgtagacaaagaggtgtccctactccacgtccacctggacccagtgtagacaggaggagactgcaccacctccacctggacccagtgtagacaaagaggtgtccctactccacatttacgtggacacagtgtagacaggaggagaccctgccccacctctacctggacccagtgtgaaggcgaccagcccttccacacatgtgggtatttctcgtcaggtgggacgagagactgagaaaagaaataagacacagagacaaagtatagagaaagaacagtgagcccaggggaccggcgctcagcatacggaggacctgcaccggtctctgagttctctcagtatttattgcttactattttcactatcttggcaaggggaatgtggcaggaggacagggtgatagtggggagaaggtcagcaggaagacatatgagcaaaggaatctgtgtcacaaataagttcaagggaagctactatgcctggatgcacacgcaggccagatttatgcttctctccacacaaacatcagtgtagcaaagagtcacagagcagtattgccaccagcatatctcgcctccagccacagggcggttttctcctgtctcagaatagaacgaatgtacgatcgggttttacacggagacattccattcccaggggcaggcaggagacggagggcttcctcttatctcaaccgcgagaggacttcctcctcggcacagaccctttatggatgtcgggctgggggacggtcaggtctttttcccttcccacgaggccatatctcagactgtctcagtggggggaaccctcagacaatacccgggctctctcgggcagaggtccctgcggctttccgcagtgcatggtgtccctggttaatagagaatggagaatggcgatgacttttaccaagcatgctgcctgcaaacctattgttaacaagacacagcacatgtttctgtgagcacagtgttggggctacagttacagcttaacagcatctcaaggcaaaacagtggttcaacatacagatcacaatggagtttcttaccttcctttctacatagacacagtaacagtctgatctttctttttgtttgtttgtttgtttttctgagacagagtctcactctgtcgcccacccaggctggagggcagtggcgggatctcggctcactgcaacctccgcctcccgggttcacgccattctcctgcctcagcctcccgagtagctgggactacaggcacccgccaccacgcccggctaatttttttggatttttagtagagacggggtttcaccgtgttagccaggatggtctcgacctcctgacctcgtgatcctcccgcctcggcctcccaaagtgctgggattacaggcgtgagccaccgcgcccagccccctgatctctctttcttttccctacacagagtagacaaagaggtgtccctactccacatttacctggacccagtgtagacaggaggagaccctgccccacctccacctggacccagcgtagacaaagaggtgtttctactccatatctacctggacccagtgtagatgggaggagaccctgccccatctccacctggacccagtgtagacaaagaggtgtccctagtccacatccacctggaccgagtgtagacaggaggagaccctgccccacctccacctggacccagtgtagacaggagaagactctgcaccacctccacctggacccagtgtagacaggaggagaccctgccccacctccacctggacccagtgtagacaggagaagactctgccccatctccacctggacccagcgtagacaaagaggtgtttctactccatatctacctggacccagtgtagatgggaggagaccctgccccacctccacctggacccagtgtagacaggagaagactgcaccacctccacctggaccgagtgtagacaggaggagaccctgccccacctctacctggacccagtgtagacaggaggagaccctgccccatctccacctggacccagtgtagtcaaagaggtgtccctactccacctccacctggacccagtgtagacaggacctactccacctccacctggacccagtgtagacaggaggagactctgcaccacctccacctggacccagtgtagacaggacctctcgggttcaggggtgtgtcctgcgccctcgttacagaacgattcaaccctcccagcaatgtcaccgtacgttgcaacacgacgcactgcctcgtacggtggaaacagcccaggacctatcagaagctgtcgtacctggactttcagtaccagctggacgtccacagaaaggtcggtgagagctccccggggctgggcaccaggagggaggcgtacgggacacgcccgcacaggagcctgggaatcccggggaagtggcctgggggaaggatgcgtgggtggtgagcggtgactctggggtgaacgcacttcgggtagcggaggaagaggtgaagggtctgtggcctgtggagccaccttgaaagaggttgcagggagggtggacaaggatgatcctgcaaccatggaaccaggaagtggaccgggaggtgtgggggacgatgccacaagcaaggagagcctctgctccacctccagctggacgcagtgtagacagaaggagaccctgccccatgtctacctggacccagtgtagataggaggacacccgaccccacctccacctacacccagtgtagacaggaggagaccctgctccacctccatggagacccagtgtagacaggaggagttcttgtcccacaactacctggacccagtgtagacagggagagagactgcctcacgtccacctcgatccagtgtagacaagaggagatcttgtctcacaacctcctggacccagtgtagacaagaagagaccctgccccatgtccacctcgagccagtgtagacaagaggagatcttgtcccacaaccacctggacccagtgtagacaagaaggagagcctgctccatgtctacctggacgacaggagaacaccctgccccaaggccagtgggacctttctggatgggttacaggaagatatctggccaggaagacttctgtgtttgcagctcctcatcctacctgtcttgtagattcggggtttgtggagggagacctgcctgccactccgcagggactccttcccattcggtgcccacaccaggggagacactgtgtgaaccatctacagtgttttagaaatggaaacagtgagccttgtgttgtgttttgttttgtttctagaatacccagcctggcacggaaaacctactggtaagtgaaaccacagaccctactgacaaccctcagcgtaaccctacggtcccctactcaccacacctagtgtaactctacagtcccctactcatgacccctacagtcccctaccgacgacctccagcgtaaccctacggtcccctactcaccacacctagtgtaactctacagtcccctactcatgacccctacagtcccctactgacgacctccagcgtaaccctacagtcccctactcaccacacctagtgtaaggaggaggagaccctgccccacctccacagagacccagtatagacaggaggagctcttgtcccacaaccacctggaccccgtgtagacaggaagagaccctgccccacgtccacctagcttaatcctacagtcccctactcaccacacctaatgtaactctacagtcccctactcatgacccctacagtcccctaccgatgacctccagcgtaaccctacagtcccctactcaccacatctagtgtaactctacagtcccctactcacgacccccggagtaatcctacagtctcctactcacgacgcctacagttccctattcatgacccctagcgtaaccatacagtcccctacccatgagccctggcataaccctacaatcccctactcaccacacctagcataaacctacagtcccctacccatgacccctggagtaaccctacagtcccctagtcactacacctagtgtaactaaccatacagttccctatccatgacctctggcggaaccctacactcccctactcacaacccctagtgtaaccctacagtctcctacccatgacccctggcggaactgtacagtcccctactcacgacccctacactctcctacccatgacccctggcggaaccctacagtcccctactcacgacccgtacagtctcctacccatgacccctggcagaaccctacagtcccctactcacgacccctacactctcctacccatgacccctggcagaaccgtacagtcccctactcacgacccctacagtctcctacccatgacccctggcggaactgtacagtcccctactcacgacccctacagtctcctacccatgacccctggcggaactgtacagtcccctactcacgacccctacactctcctacccatgacccctggcggaaccctacagtcccctactcacgacccctacagtctcctacccatgacccctggaggaaccctacagtcccctactcacgacccctacagtctcctacccatgacccctggcggaactgtacagtcccctactcacgacccctacagtctcctacccatgacccctggcggaaccctacagtcccctactcacgacccgtacagtctcctacccatgacccctggcagaaccctacagtcccctactcacgacccctacactctcctacccatgacccctggcggaaccgtacagtcccctactcacgacccctacagtctcctacccatgacccctggcggaaccgtacagtcccctactcacgacccctacactctcctacccaagacccctggcggaaccctacagtcccctactcacgacccctacactttcctacccatgacccctggcggaaccctacagtcccctactcacgacccctacactctcctacccatgacccctggcggaaccctacagtcccctactcacgacccctacagtctcctacacatgacccctggcggaaccctacagtcccctactcacgacccctacagtctcctacccatgacccctggaggaaccctacagtcccctactcacgacccctacagtctcctacccatgacccctggcggaactgtacagtcccctactcacgacccctacagtctcctacccatgacccctggcggaaccctacagtcccctactcacgacccgtacagtctcctacccatgacccctggcagaaccctacagtcccctactcacgacccctacactctcctacccataacccctggcggaaccgtacagtcccctactcacgacccctacagtctcctacccatgacccctggcggaaccctacagtcccctactcacgacccctacagtctcctacccatgacccctggaggaaccctacagtcccctactcacgacccctacagtctcctactcatgacccctggagtaaccctacagtcccctactcacgacccctacagtctcctactcatgacccctggagtaaccctacagtcccctattcaggagccgtagtgtgaccctacaatcccctactcacaacccccggtggaaccctacagtcccctacccatgacccctggtggaaccctacagtcccctactcacgacccctacactctcctacccatgacccctggcggaaccctacagtcccctactcacgacccctacagtctcctacccatgacccctggcagaaccctacagtcccctactcacgacccctacactctcctacccatgacccctggcagaaccctacagtcccctactcacgacccctacagtctcctactcatgacccctggagtaaccctacagtcccctattcaggagccgtagtgtgaccctacaatcccctactcacaacccccggtggaaccctacagtcccctacccatgacctctggtggaaccctacagtcccctactcacgacccctacactctcctacccatgacccctggtggaaccctacagtcccctactcacgacccctacactctcctacccatgacctctggtggaaccctacagtcccctactcacgacccctacactctcctacccatgacccctggcggaaccctacagtcccctactcacgacccctacagtctcctacccatgacccctggcagaaccctacagtcccctactcacgacccctacactctcctacccatgacccctggcagaaccctacagtcccctactcacgacccctacagtctcctactcatgacccctggagtaaccctacagtcccctattcaggagccgtagtgtgaccctacaatcccctactcacaacccccggtggaaccctacagtcccctacccatgacctctggtggaaccctacagtcccctactcacgacccctacactctcctacccatgacccctggtggaaccctacagtcccctactcacgacccctacactctcctacccatgacctctggtggaaccctacagtcccctactcacgacccctagtgtaaccccacatgacccccagtgtaaccctatagtcccctacccacgacctatgtctgcctagacccagtgtgatcaggaggagaccccacctcacctccccctagacccagtgtagacaagaaggagagcctgccccacgtctacctggatccagtgtagacaggagaatactctgcccgacatacagttgaaccactcacaaccctagcgtcaccctacagtctccacgaaccctacagtcttggtttatgggactcttagtgccagtgtggcccaggggtggacacggtggatcctgaaccagaggatgcagatctcacacgggtgagggccccctcatagttctcactgggcagggtctgctcttggcctcaaccttcgtgtcccaatggttggaatatttatgctcagcctgttctactgattttcccattttattcctctttcctctacgtgggttaagaatatattctagtgactgtctaaggagattatgtctccctctaaaatgcttttagagtgagtactgttgccgggtatttaccaagtctcgcggccactctgaccctcggtatcctcctctgtccgatgagtatgctagacttggggatcttaatatcccttgctaaactatccgtctgaaggtctgttaatatcagttgttgatcctgaatcatttatttatgtatgtatttatttttgagacggagtctcgctctgtcccccaggctggagtgcagtggtgcgatctcggctcactgcaagctccacctcccagcgattgtcctgcctcagcctccctacagagattctacagtctcagcctgtagctgggactacaggcacccacccccacacctggccaacaatttctgtttcagaaaataaaattttagccaggcacggtggctcacgcctgtcatcccagcaccttgggaggctgaggtgggcggatcacttgaggtcagcagttcaagaccagcctgggcaacatggagaaaccccatctctactaaaaatacaaaacgtacccatgcgtggtggcgggcgcctgtaatcccagctacgtgggaggctgaggcaggagaatggcgtgaacccgggaagcggaggttgcggtgagcccagatcatgccattgcactccagcctgggcgacagagcgagagtgtctcaaataaaataaaataaaagaggccgggcgtggtggctcatgcctgtaatcccagcactttgtgaggccgaggcggtcggatcacgaggtgaggagatcgagaccatcctggccaacatggtgaaaccccgtctccactaaaaatacaacaaaaattagccgggcgtggtggtgggcacctgtagtcccaactactggggaggctgaggcaggagaatggtgtgaaccctggaggtggaggttgtagtgagccaagatcgcgccactgcactgcagcctgggtgacagagggagactccgtctcaaaaaataaataaataaaataaaataaaaaagcttaaagcctacatcacccaaattttcccaacttgtctcccatcgaaatactaacgaggcttgactctgcttagcttcgaagacccgatcagaccaagtgcattcagagtggtagaaaaaaaagaagaaaaagaaaaaaagaaaaggagaaaaaaacttaaaagacaaaagaacgaaaaaaggcaaccttttcctccacacagaagacgcctatctctaactttcttttttcctccaaagattaatgtttctggtgatttggaaaatagatacaactttccaagctctgagcccagagcaaaacacagtgtgaagatcagagctgcagacgtccgcatcttgaattggagctcctggagtgaagccattgaatttggtaagcgttgggcggaggtaagggatgtttgtgccgtctgcggccaccctgcagcaggcacagaggtcaggtgctctgtcctgggcgctgagatcgagttgagcacgtcgctgggagtagtgtcaggctctgagcttatcgctgaggctcaaaagaaggaggtggtctcgtacttggtcccgcaacattgctttgctgatgttttttcaggacggatgagttggctcccttaataaccagagaagggccaggtgcagcggttcacgcctgtaatcccagcaatttgggaggctgaggccggcggatcaccggaggtcaggagtttgagaccagcctggccaacatggtgaaaccccgtctctactaaaaatacaaaattagcccagcattgtggcaggtgcctgtaatcccagctactcgggaggctgaggcaggagaatcacttgaacccaggaggcggaggttgcactgagctgggatcacgccattgcactccagcctgggtgacagcgtgagactccgtctcaaaaaaaaaaagaaaaaaaaatacaaaaactaaccaggattggtggcacattcctgtaatcccagctactcaggaggctgagggcaggagaatgacttgaacccgggaggtggaggttgcagtgagctggggtcacgccattgcactccagcctgggtgacagagtgagactctgtctcaaaaaaaaaaaaaaaaaaaaaaagaaaaagtagaaggaggtggtctcatactcatacggggtcatgcaacattgctttgctggtgtttttttcagggtggatgagctagaatcccttaatagccagagaaggaccccactgatagccctcctaaagtcccacctccctctgctccactgggaaacaatcagtcagtctttgtccggtcaaaccgtcaccattccggctccctggccaaggggaagctctctccctctttttttcttttttttttttttttttttgagacggcgtttcgctcttgtcgcaggctggagtccagtggcgcaatctcggctcactgcaagctccacctcctgggttcacgccattctcctgcctcagcctccccagtagctgggactacaggtgcccatcaccacgcctggctaattttttgtatttttttttttttagtagagacagggtttcactgttttttagccaggatggtctcgatctcctgacctcgtgatccgcccacctcggcctcccaaagtgctgggattacaggcgtgagccaccgtgcccggccctccctcttttttttttttttttttttttagatggcgtttcgctcttgttgcccaggctggagtgcagtggtgccatctcggctcaccgcgatctccgcctcccaggttcaagcaattctccagcctcagtctcccgagtagctgggattacaggcgcccgccaccacacccggctaattttgtatttttagtagagacggggtttcaccatgttggtcaggctgttcttgaactcctgacctcaggtgatctgcccacctcgccctcccaaagtgctgcaatgacaggcgtgagccaccctgcccgtccggggaagctctcttcaaagccaggtctcggctgcccaggagacaggtctatgcttttctctgaagatgattttgagggctccaaattgaaaaggggaaggggcaggatattgagaagtatgcggttttcacctcaacaaagggtacagaagaaaaattgtgagctgcagtgcagtggtgcacctctacctcccagatcacacagacaaaatggggtacagggatgatcagaggtgcattcgtgtctggtgggccggggtgactgcacctgtaagaaattttttttgtttatttattttttgttatttgagacggactctcgctctgtcacccaggctggagtgcaatggcacgatctcagctcactacaacctctgcctcctgggttcaagcgattctcctgcctcagcctcccgagtagctgggattacattagacatgcatcacgcttggccaatttttgtatttttctttttatttatttatttatttattttgagatggagtttcgctgtgtcacccaggctggagttcaatggcacgatcttggctcactgcaacctccgtctcccaggctcaagcgattctcctgcctcagcctcctgagtagctacgattacagacatgcatcatgcttggccattttttaaatatttttatttatttatttattttgagacagggtctcactctgtcacccaggctggagtgcaatggcacgatctcggctcactgcaacctccgcctcccgggttcaagcgattctcctgcctcagcctcccgagtagctgggattacagacatgcatcacgcttggccaatttttgtatttttatttttatttatttatttatttattttgagatggagtttcgctgtgtcacccaggctggagtgcaatggcacgatcttggctcactgcaacctccgtctcccaggctcaagcgattctcctgcctcagcctcctgagtagctgggattacagacatgcatcatgcttggccattttttaaatatttttatttatttatttattttgacacagggtctcactctgtcacccaggctggagtgcaatggcacaatctcggctcactgcaacctccgtctcccaggctcaagcgattctcctgcctcagactcccaggtagataggattacaggcacccaccaccatgcctggctaattttgtattttttttttagcagagatgaggtttcaccatgttagtgaggcttgtctcgaactcctgacctcagatgatgcgcccgcctcggcctcccaaagtgctgggatgacaggtgtgagccaccgtgcctggcccaatttttgtatttttggtagagacggggtttcaccatgttggtcaggctggtctcgaactcccaacctcaggtgatcctcccgtgtcggcctcccaaagtgctgggatgacaggcgtgagccaccgcatccggcccatggtggcaaagttttaacagctcaccagaaatttccttgtgggcaaaacatagggcaggcaggttgctttcatctcagagccatcttagttaagaaccaaaaacagggaggcaggtttgctgggcccagttctcagcttgactgttccctttggctaaatgcatttggacacccgaagagatttaatttcctttcacatgtccgtcaacgattcaccgcagacgcaaacctgtgtgtctctccaggttctgacgacgggaacctcggctctgtgtacatttatgtgctcctaatcgtgggaacccttgtctgtggcatcgtcctcggcttcctctttaaaaggtaacctgtgaaacacctgggcctccccaatgaaaacaggccaggccgggaggaaagcgctttgtccagtctctgtctctgtctctgagaaagagaaacacagccttggccgggcgtgttggctcatgcctgtaatcccagcactctgggaggccgaggcgggtggatcacgaggtcaggagatcgagaccatcctggctaacacagtgaaaccccgtctctactaaaaaattagcccggcgtggtcgcgggcgcctgtagtcccagctactcgggaggctgaggcaggagaatcgcttgaacccgggaggtggaggttgcagtgagccgagattgcaccactgcactccagcctgggcgacagggcgagactccatctcaaaacaaacaaaagaacggagaaaacgggagatcctacaggaatacacagtgatgctcacagggaatctttctagaatcttccctcagcccctcgggcacagggatgggaatggaacaggcagtcagctgtgggcagcttcagggagtctgaagtcactgctgttgaagggctgagctccagaggggaaacgcctgccttgatcccactagccttgaagagcgtggtttctgggttggaggtgggtttttttttgtttgtttgtttttttgttttttgttttgagacagacttttgctcttgttgcccaggctggagtgcagtgttgcaatctcggctcactgcaacctccacctcccgggttcacgccattctcctgcctcagcctcccgagtagctgggattacaggcatgcaccacgatgctcacctaatttttgtatttttagtagagatggggtttcaccacgttggccaggctggtctctaactcttgacctcaggtgatccacccgccttcgcctcccaaagtgctgggattacaggtgtgagccaccatgcctggcctagttccttaagatgtttgtcatttggtgatttttttttgtttttttgagatggagtctcactctgtcacccaggctggagtgcagtggtgcaatctcggctcactgcaacctccacctcccaggttcaagcaattctcctgcctcagcctcctgaatagctgggattacaggcaagcaccacgatactcagctaatttttgtatttttagtagagacggggtttcaccacgttggccaggctggtctcaaacctcaagtgatccacccgcctcggcctcccaaagtgctgggattacaggtgtgagccactgcacccggcctagttccttaagattttcgtcacttggtgattcttagtgaagttttgcatagttgagcgcagacaccccgcacgcagcatccctcggcacagggcgttgatggaaggaactctggtgacccggggttcattctcttcacactttttctctgtgtctcaggttccttaggatacagcggctgttcccgccagttccacagatcaaagacaaactgaatgataaccatgaggtggaagacgaggtaggcaggggtgggcggagcagtgacctgggatggaaggtggggagtggggagcgtgggacacggcctctgggtgtcgaccatcttgcttctccaccagatgggaccgcagcgtcaccaccggtgtggctggaatctgtatcccactcctgggccttctcccgggtcggggtcttctccaaggttggggtcagagtcatctctgtgagctccatcaggagaaactgaggcagggtggtggtcaagaaaaggaggagaagacggtagagagggccaggcacggtggctcatgcctgtcatcccagcactttgggaggttgaggcatgtggatcatctgaggtcagaggttcgagaccagcctggccaacgtggtgaaaccccatctctgctaaaaatacaaaaaattagctgggtgtggtggtgtacgcctgaaatcccagtgactcgggaggctggggcagtagaacggcttgaacccagggggcggaggttgcagtgagccgagatcgcaccactgcactccagcctgggtgacagagcgagactccatctcaaaagaaaaaagaaggtagagaggagaggcagaaatagagacaagagacagaggcagagaaagatggagggagagagatggaggagagagagaggaatgtagaagagaatgaggagacacaaaagagagggaaacaggcagacagactgacagaaacaaaggcagacacacagacagagaaacagagagagggagggagaaaagggagaaggaaagagagagacacgagacacagatggagaaacagagacagataaacaacaaacataaagacccaggcgggggccggtcgcggtgactcacatctgtcatcccagcactttgggaggccgaggcgggtggatcacttgaggtcgggagttcgagaccagcctgaccaacctgaagaaacctcgtctctactaaaattgcaaaaattagccaggtgtggtggcgcacacctgtaatcccacctactctggaggctgaggcaggagaatcacttgaacccaggaggcggaggctgcagtgagccgagatcgcaccattgcactctaacctgggcaacagagcaaaactctctatcaaaaacaaaacaaaacaaaaaaatcatccccagcagggagaggagagagacagagaggaacagaggcacagagaggggagagagacaaagacagagagacacagagaaagacacagaaaaagagagagagagggagaaggagacatagagacagggacaaagagaaaaagacggacagagagagaaacagagagacataggtggacacagagaggggagagagagagagagacagaaagagacagagagcaagggatgggagtggaagagagagacagatggaggaaaaagacagagagggaggcagataaaagacacacagagacaccgagagagacagggaagacagaggagtcggacttagtctcagcgagagcccagagagggtgaacaagggcgaggaaccatgtgacctgcaccctgagaccccattggcgctcctctcccacccacctctctccggctcagggactgcgtcttatgttgcagtaggctggcaggctggaaagtcaggccagggctgatgctgcatcccagaggcagaactgtcctgcattctcagagtgggagatgaaatttttaaaaaggaaataaaactcttgtcggggaacctcagcttttatcctttagacgtttgactgattagaccaggcccactcttctcctttacactttcggctgattgaatgaggcccacccttccccctttacaccttcgactgattagatgaggcccaccattcccctttagaccttcgactgatcagatgaagcccacccttcccctttagaccttcagcttattagataaggcccacccttaccctttagactttcaactgattaaatgaggcccactctccccgtttagacctttgactgattagatgaagcccacgcttctcctttggaccttcaactgattagatgaggcccacccttcccccttcagcctttcgactgattagatgaggcccaccctcccctttataccttcgactgattagatgaggcccaccctcccctttataccttcgactgattagatgaggcccaccctcccctttataccttcgactgattagatgaggcccgtccttcccccatttagatcttcaactgattagatgaggcccacctttccctttttagacctttgactgattagatgaggcctacccttctccctttagacctttgactgattagatgaggcctacccttctccctttagacctttgactgattagatgagacccacccttcccatttagaccttcaactcattagatgaagcccacccttccccccttcccctttagaccttcagcttattaattagacaaggcccaccccctttagaccttcaactgattagatgaggcccacccctcttcagaccttcaactgattagatgaggcccaccccctttagacctttgactgattagataaggcccacccacattctccagtccaatctcttttcctggaaatcagctgattgtggacttgacatctacaaagccccttcgtagcagccgctgagtcatggtttcattcaataactggggactgtagcctagtcacggggacacgtcattggtgccgggtatcagagacgaaggccaagagatgaaagagaaacagagactgaacccaaaagaggcagacacacaggaagatggagatagagacccagagatgggggtggaagaaggtgagagggggaggaaagagagacagagagggagacagagaaaagaggcagagagaccgagagagaggctgaacagcaagaccccagagagggtgactaagggtgagagacttgcgtgacccacatcccaagaccccgtgggtggccctctcccacccacctctctccagctcaggggctgtgtcttcctcccatggggaactccagttgcagcccagggttgcccccagcgccctcttctctgccacataggtaacatcctcctggttgccacttgcacacccccatcctagacctggccatctgtcattccattaccttccacccccacgccagcctcctccccggcccccgctttccactgacccccaggggtcccccacatcgaggtgccaggatgacggcttcaggcttcaaccttcccttctctgagctccatcagctccaggggcttagcacctgctgtaccctgcccaggtttcatgctcacaagctcttccaaagaccaccctgttcatcgtcaactatgaggtcccatgggtggatctgtctcagatctttaccccaggaaaaacccatggccaggtgcagtggctcatgcctgtcatcccagcactttgggaggccgaggcgagtggatcacctcgaggtcaggagtttgagaccagcctggccaacatggtaaaaccccatctccactgaaagtacaaaatttagctggtggcggctaaagggggaaaggtgggcctcatctaatcagtcgaaggtctaaagggggaagagtgggcctcatctgatcagtcaaatttgtggtggcgggcgcctgtaatcccagctactcaggaggctgaggcaggagaatcgcttgaacccgggaggccgaggttgcagtgagctgagatgacaccactgcactccagcctgggcaatagaatgagactccgtctcgagggagaaaaagaaaataaacacagcccactgagtcccaggctgagctcgtgaagatctgacagcctgaaccctcctttttctcagatcatctgggaggaattcaccccagaggaagggaaaggctaccgcgaagaggtcttgaccgtgaaggaaattacctgagacccagagggtgtaggaatggcatggacatctccgcctccgcgacacgggggaactgttttcttgatgatgctgtgaacctttatatcattttctatgtttttatttaaaaacatgacatttggggccaggcgcggtggctcacgcctgtaatcccag

SEQ ID NO: 2862 - DNA, 41573 bp, human; identical to SEQ ID NO: 2845

SEQ ID NO: 2863 - DNA, 27257 bp, human
tcttcccttctctctgaccagcaccatgcttctcctggtgacaagccttctgctctgtgagttaccacacccagcattcctcctgatcccagagaaatcgggtaagtatggaaacctggctgaaccttctccgcggcccctgtttagatgtcctgcatctggagacccatctggatacctgggtccatctgcatttcatctctaatgtttatgagggacccaataagcaccagccaacccaccagaagctcagagctcctcttgttctcacctccttttctgctgttaattcccatccacccattctacagatgagaaaacggaggctcagatacctccacagtttaacccaacgaccatccaggtagtgatggggccaggatgaggacccatgtctgcatggggccaaagtgttccttccttccttcgttccttcgttccttcgttccttccttccttccttccttccttccttcgttccttccttcgttccttccttccttccttccttccttccctcccttgcttccttctcttcctcctgccctccctctttccatccttccttctctccttccttccatccttctctccctcctgattcatttcttctctttctttctcttccttccttccctccttccctttctctctttcttccttccattgtttccttctttccttccttcttccgtccctcccttctttctttctctttcttccttccctccttccctctctctctttcttccttccattgtttttctttctttccttccttccctccctccctccctctctctctctctttctttctttctttctcctttttttttctccttctttgtttctttcttcctctttcttctttctttctttctttctttccttctttctttttctttcttttcagagtctccctcttgttgcccaggctggagtgcaatggctcaatctcagctcactgcaaactcagcctcccgggttcaagcgattctcctgcctcagcctcccgagtagctgggattacaggcgcctgccaccaggcccagctaatttttttgtatttttagtagagatggggttttgtcatgttggccaggctggtctcaatctcctggcctcaggtgatcccgtgcctcggcctcccaaagtgctaggattacagctatgagccgccacacccagcctcttgtttgttgacttcttaatagcagccattgtgactggcgtggaatgatagctcattgtggttttgatttgcgtttccgggagggaccctcttgactgagggtgtcagggcctctgcttcaggaaagtatttccaggtttttgtgacctggttcagggaagacagacaaagacagctttctgtttctgcaattttctcaaattccttcagctttatattaaactgccaaggttccataatttgggaagtgtgttcagagccacatcactctggataaagagcctttgcctgttctcattcaagcggttttctttctctgtctctcttttttttttttttttttttttttttgagacaggatctcgctctgtctcccaggctggagtgcagtggcgtgatctcggctcactgcagcctcagctttctgggatcaagtatcctcccactccagcctcccaagtagctgggactgcagaaatacaccaccatgccaagctaatttaaattttttttttaattttatagaggagatcttgctatgttgccaagactagtttttgatttttttttttttttgagatggagtcttactctgtcacccaggctggagtgcagtggcgcgatctcggctcactgcagcctcagctttctgggatcaagtatcctcccactccagcctcccaagtagctgggactgcagaaatacaccaccatgccaagctaatttaaatttttttttttttaaattttatagacgagatcttgctatgttgccaagactagtttttgattttttttttttttttttttttgagatggagtcttactctgtctcccaggctggagtgcagtggcgcgatctcggctcattgcaacctccacctcccgggttcaaccgattctcctgcctcagcctcctgagtagctgggattacaggtacccgccaccatgtccacctaatttttttgtatttttagtagagacagggtttcaccacattggccaggctggtctcgaactgctgacctcaggtgatccgcccacctcagcctaccaaagtgctgggattgcaggcatgagccaccgcgcctggccagtttttgatgatttctgcagtaaacatctccatgtggagaaggagcaagctgggaccacagatgtgcaccatcacacctgcctaatttaaatttttaaaaaaaaattttttttaaagagatgcgatcttgctatgttgcccaggcgggatctgaacctactgggctcaagtcagctttttgcctcagcctcccaaggtgctgggattagaggcgtgagccaccacccccagtcttcagatgatttttgaatatttctgcagtagaaatctcctttttcagaaacagccagggggctgtgaaaaggagggaagatggacaagggaggaacagatacctgaggatgtgggacgtcctggggccatgtgggtgacagaggaaaatcagcaggcttcagccctgaacttcacctcccagagccgggtgggaggacagaaaacagggccggccgggcacggtggctcacgcctgttatcccagcacttcgggaggctgaggcaggcggatcacctgaggtcggcagttcgagaccagcctgaccaacatggtgaaacccccatctctactaaaaatacaaaaattagctgggcatggtggtcggcgcctgtcatcccagctactcgggaggctgaggcaggagaatcatttgaacccgggtggtggagcttgcagcttgcagtgacctgagatcacagcactgcactccagcctgggagacaaagccagactccgtctcaaaaaaaaaaaaaaaaaaaaaaaaaaaaaaggaaaagaaaagaggaaattctgaacccagtgcccgctccttgcagatctgcgaacagtggcaccagcctctagtctcaatgtgaggtttgactccaggacgatgaatttaagctgggactgccaagaaaacacaaccttcagcaagtgtttcttaactgacaagaagaacagagtcgtggaacccagggtgagacgaatttcccattctcaacccctgtcctttacacacccctttctgagttaaaagcaacagggccggctgggcgcggcggctcacgcctgtcatcccagcactttgggaggctgaggtgggcggatcacctgaggtcgggagttcaagaccagcctgaccaacatggtgaaaccccgtctctactacaaatacaaaattagccgggcgtgctggtgcatgcctgtagtcccagctactcaggaggctgagggcagaagaattactcgaacccgggaggtggaagttgcagtgagtcgagctcgtgccattgcactccagcctgggtgacagagcgagactctgtctcataaaatgcaataaggccgggtgtggtggctcacgcttgtcatcccagcactctgggaggccgaggcaggtggatcacctgaggtcaggagttcaagaccaggctgaccaacatggtgaaaccccatctctactaaaaatacaaaaattagtcgggcatggtggcaggcatctgtaatcccagctactcgggaggctgaggcaggagaattactgaaactcgggaggcggaggttgcggtgagccgagatggtgccattgcactccagcctgggcaacaagagcaaaactctgtctccaaaaaaaaaaaaaaataataaattcaattaaataaaagcgagagggccacagacacaaacaacacaagtgtggtatttggagaaatgtcacagccataatctcacgggaaccgggaaagtgctgttagctcatgtccacaatgtgtaccagagcctgattccctgaggcagagcctatgttaccgtattttaccccaagagaagagaaatcctggcaaatgcagttggatgtgcccctgggtctgtggtggaagcaggacggagaaaagtaaagtgtcagtcacgttgtcagtgtgtcaccgtcctggttccccaagggattaaggtcagggtttttggaacacaggagacagagacagaagagcggggagaggggagggaaggagggagaaacacagagaaaggatagaaggaggagggagaggaagagagaaatatggatgatcgatagataggtgatagatgatttattgactgataggtgataatagatgattggaagattgataatcaattctataggtagatgctacacggagggatgggtggtcttgctatgttaccccagatgacatactttttttttttttttttttttttgagatggagtttccctcttgttgcccaggctggagtacactggtgtgatcttggctcactgcaacctccacctcctgggttcaagcgattctcctatctcagcctcctgagtagctgggattacaggtgcgtgccaccacgcctggctaatttttgtatttttagtagagacggggtttcaccatgttggccaggctggtctccaactcctgacctcgtgatccaccctccttggcctcccaaagtgctggcattacaggtgtgagccaccgtgtccgacctttattttttgggatggagtctcgctctgtcgcccaggctggagtgcactggcgtgatctcagctccctgcaacctgtgcctcctgggttcaagagattctcctgcctcagcctcctgagtagctgggattacaggtgcccaccaccacacctggctaatttttgtatttttagtagagacggggtttcaccatgttggccaggctgatcttgaactcctgacctcaagtgatccacccgcctcggcctcccagagtgctggcattacaggtgtgagccactatgtccgaccctttttttggggggatggagtctctgtctgtcacccaggctggagtgcactggcgtgatctcagctcactgcaacctgtgcctcctgggttcaagagagtctcctgcctcagcctcccgagtagcagggattacaggtgcctgccaccacacctggctaatttttgtatttttagtagagacggggtttcaccatgttggccaggctggtcttgaactcctgacctcaagtgatccacccgccttggcctcccagagtgctgggattacaggtgtgagccacggcacctggcctctagtctggtactttcagcactgctagagtataagattgagttttcacctgcaagctggtattcagcgtatccactcagagccctcggaggaagcttagggggatgatttcacaaagggaggcaggtgcgtgtcgccaaatccaggtaaaaaccaataccatggccgggcatggtggctcacgcctgtaatcccagcactttgggaggccgaggcgggtggatcacctgaggtcaggagtttgagaccagcctggccaacatggtgaaaccctgtctctactacaaatacacaaattagcagggtgtggtggcgggtgtctgtaatccgagctactcgggaggctgaggcgggagaattgcttgaacctggaaggcggaggttgtagtgagccgagatcacgccactgcactccagcctgggagactgtaggagacagaaggttgtttcctaatcggctctgtctggttgcaattcttcagctcagtaacaacgaatgttcgtgcacatttcgtgaaatttgtctgcatgaaggagtcacatttgaggttcacgtgaatactagtcaaagaggatttcaacagaaactgctttatccaaattcaggtaagcaagacagctcagggatccgtttacagcactggccccaccaccccgccagcatcaaagtacatcccgttgaacttcggagtgaaaattattttgtttctacctcttcccaggaagggagggtaccgctgctcagaatttctcctgtttcatctacaatgcggatttaatgaactgtacctgggcgaggggtccgacggccccccgtgacgtccagtattttttgtacatacgaaactcaaagtaagtgttcacctcatgtgaagaattatgaggaatgcagggatgggagaaaaaatcatgctggttttctttttttcctttttctttttttaagacatggtcttgctctgttgcccaggctgcaatgcaatggtgccacctcggctcactgcaacctcgacctcctgggttcaagcaattttcctgcctcagcttcccaggtagctgggattacaggcgcccgccaccacaccaggccacatctatgtatttagagacagagtcttgctctgtcgcccaggctggagtgtagtgatgtgatctcagctccctgcaacctgcgcctccctccagggttcaagtgattctcctgcctcagcctcccaagtagctgggactacaggtgcactccaccacacctgtctaatttttgtatttttagtagagacagggtttcaccatgctggccaggctggtctccaactcctgacctcaagtgatctgcctgcctcaacctccccaaagtgctgggattacaggcgtgagccactgcacctggcctgtttttttggttgttgttttgttttgtgttttttgttttgttttgtgtttctttttgttttgccttgtgtttttgtgttcttgttttgttttgtgtttctgtgtttttcttttgtttttgtgtttttttggtttcacgtttttgtggtgttttgtgtttttgtgtttttgttttttgtgtttgtttttgttttgttttgtgttttgttttgtgtttgtttttgttttgttttgtggtttttgttttgtgttgtgtttgtttttgttttgtgtttttttgtttgtgttttggtgtttttgttttgtggttttcttttgtgtttgtttttgttttgtgtttttgtgtttttgtttcattttgttttgttttgtgtttttgtgttttgttttgttttgtgtttgtttttgttttgttttgtgtttttgtgtttttgttttgtgttttgtgtttttgtgttttgttttgttttgtgtttttgtgttttgtttttgtgttttgttttgttttgtgtttttgtgttttgttttgtgtttgtttttgttttgttttgtgtttttgtgtttttgttttgtgttttgtgttttgttttgtgtttttgtgttttgttttgttttgtgtttttgttttgttttgtgtttttgatttgtgtttttgtgttttgttttgtgtttgtttttgttttgtgttttgtgtttttatgttttgttttgtgtttgttttcgttttgttttgtgtttttgttttgtgttttgtgtttttgtgggttttttttgttttgtgtttttgttttgtgtttttgtgttttgtgtttttgtgttttgttttgtgtttgtttttgttttgttttgtgtttttgtgttttgttttgttttcctgattgctctctgagcactttctaatctttcaggagaaggagggagatccggtgtccttattacatacaagactcaggaacccatgtgggatgtcacctggataacctgtcaggattaacgtctcgcaattactttctggttaacggaaccagccgagaaattggcatccaattctttgattcacttttggacacaaagaaaataggtgagaataacacatatgattttcctattgtttataggtgaaatggaatttgccttaaaatctgtgtaactgaggccacgtgcggtgtctcacacctgtaatctcagcactttgggaggccgaggcgggccgatcacctgagatcgggtgttcaaaaccagcctgaccaacatggggaaaccccatctctactaaaaatacaaaaattagccgggcatggtggcgcgtgcctgtaatcccagctactcggaaggctgaggagaatcactcaaacctaggaggcggacgttgcaatgaggtgagattgtgccactgcactccagcttgagcgacagagcaagactctgtctcaaaaacaaacaaacaaaaatctgtgtaactttggtgctgtaacaaattagaactgagctgatttaactttcctttttttgagatagagtctcgctctgtcacccaggctggagtgcagtggtgcaatctcagctcactgcaacctctgcctcccaggttcaagcgattcttctgtcttagtctccttagtagcttggattacaggtgcacaccaccacgctcggctaatttttgtatttttagtagaggcagtgtttcaccatcttggccgggctagtctcgaactcctgacctcagatgatccacctgcctcagcctcccaaagtgctgggattacaggcgtcagccactgcacctgacctccctctttacctccttccttctttccttcctccctgcctttctgcctttcttcttttttcttccttccttccttccttccctccctccctcctttccttccttccttcctccttccctcccttcttccttccctccctccctctctccctcccttcttcattccttccttcttcctctccttccttctccttcactcatttcctccttccttcctctttttcttcatttcttcctcaccagcacctcttcgtgtcccagtgccctgctcctggctggcctcttggagccagtcccatatgcccacacgctctcctcttcccaagcccaccgcatcccacccgtggactccttcatcccgttggacgttcccagcctcttcaggcttaggactctcacagaagtgtgactcctgcccaccaagcccatccccacctcccaccctggaacccctgccccagtgggtatctctcctgtacatggtagctgccccacctccacttggacccagtgtagacaggaggagaccctgtaccacctccacctggacccagtgtagacaaagaggtgtccctactccacgtccacctggatccagtgtagacaggaggagactgcaccacctccacctggacccagtgtagtcaaagagatgtccctactccacgtccacctggacccagtgtagacaggaggagaccctgtaccacctccactttacccagtgtagacagaaggagaccctgcaccacctccacctggacccagtgtagacaaagaggtgtccctactccacatttacctggacacagtgtagacaggaggagactgcaccacctccacttggacccagtgtagacaggagaccctgcaccacctccacctggacccagtgtagacaaagaggtgtccctactccacgtccacctggacccagtgtagacaggaggagactgcaccacctccacctggacccagtgtagacaaagaggtgtccctactccacatttacgtggacacagtgtagacaggaggagaccctgccccacctctacctggacccagtgtgaaggcgaccagcccttccacacatgtgggtatttctcgtcaggtgggacgagagactgagaaaagaaataagacacagagacaaagtatagagaaagaacagtgagcccaggggaccggcgctcagcatacggaggacctgcaccggtctctgagttctctcagtatttattgcttactattttcactatcttggcaaggggaatgtggcaggaggacagggtgatagtggggagaaggtcagcaggaagacatatgagcaaaggaatctgtgtcacaaataagttcaagggaagctactatgcctggatgcacacgcaggccagatttatgcttctctccacacaaacatcagtgtagcaaagagtcacagagcagtattgccaccagcatatctcgcctccagccacagggcggttttctcctgtctcagaatagaacgaatgtacgatcgggttttacacggagacattccattcccaggggcaggcaggagacggagggcttcctcttatctcaaccgcgagaggacttcctcctcggcacagaccctttatggatgtcgggctgggggacggtcaggtctttttcccttcccacgaggccatatctcagactgtctcagtggggggaaccctcagacaatacccgggctctctcgggcagaggtccctgcggctttccgcagtgcatggtgtccctggttaatagagaatggagaatggcgatgacttttaccaagcatgctgcctgcaaacctattgttaacaagacacagcacatgtttctgtgagcacagtgttggggctacagttacagcttaacagcatctcaaggcaaaacagtggttcaacatacagatcacaatggagtttcttaccttcctttctacatagacacagtaacagtctgatctttctttttgtttgtttgtttgtttttctgagacagagtctcactctgtcgcccacccaggctggagggcagtggcgggatctcggctcactgcaacctccgcctcccgggttcacgccattctcctgcctcagcctcccgagtagctgggactacaggcacccgccaccacgcccggctaatttttttggatttttagtagagacggggtttcaccgtgttagccaggatggtctcgacctcctgacctcgtgatcctcccgcctcggcctcccaaagtgctgggattacaggcgtgagccaccgcgcccagccccctgatctctctttcttttccctacacagagtagacaaagaggtgtccctactccacatttacctggacccagtgtagacaggaggagaccctgccccacctccacctggacccagcgtagacaaagaggtgtttctactccatatctacctggacccagtgtagatgggaggagaccctgccccatctccacctggacccagtgtagacaaagaggtgtccctagtccacatccacctggaccgagtgtagacaggaggagaccctgccccacctccacctggacccagtgtagacaggagaagactctgcaccacctccacctggacccagtgtagacaggaggagaccctgccccacctccacctggacccagtgtagacaggagaagactctgccccatctccacctggacccagcgtagacaaagaggtgtttctactccatatctacctggacccagtgtagatgggaggagaccctgccccacctccacctggacccagtgtagacaggagaagactgcaccacctccacctggaccgagtgtagacaggaggagaccctgccccacctctacctggacccagtgtagacaggaggagaccctgccccatctccacctggacccagtgtagtcaaagaggtgtccctactccacctccacctggacccagtgtagacaggacctactccacctccacctggacccagtgtagacaggaggagactctgcaccacctccacctggacccagtgtagacaggacctctcgggttcaggggtgtgtcctgcgccctcgttacagaacgattcaaccctcccagcaatgtcaccgtacgttgcaacacgacgcactgcctcgtacggtggaaacagcccaggacctatcagaagctgtcgtacctggactttcagtaccagctggacgtccacagaaaggtcggtgagagctccccggggctgggcaccaggagggaggcgtacgggacacgcccgcacaggagcctgggaatcccggggaagtggcctgggggaaggatgcgtgggtggtgagcggtgactctggggtgaacgcacttcgggtagcggaggaagaggtgaagggtctgtggcctgtggagccaccttgaaagaggttgcagggagggtggacaaggatgatcctgcaaccatggaaccaggaagtggaccgggaggtgtgggggacgatgccacaagcaaggagagcctctgctccacctccagctggacgcagtgtagacagaaggagaccctgccccatgtctacctggacccagtgtagataggaggacacccgaccccacctccacctacacccagtgtagacaggaggagaccctgctccacctccatggagacccagtgtagacaggaggagttcttgtcccacaactacctggacccagtgtagacagggagagagactgcctcacgtccacctcgatccagtgtagacaagaggagatcttgtctcacaacctcctggacccagtgtagacaagaagagaccctgccccatgtccacctcgagccagtgtagacaagaggagatcttgtcccacaaccacctggacccagtgtagacaagaaggagagcctgctccatgtctacctggacgacaggagaacaccctgccccaaggccagtgggacctttctggatgggttacaggaagatatctggccaggaagacttctgtgtttgcagctcctcatcctacctgtcttgtagattcggggtttgtggagggagacctgcctgccactccgcagggactccttcccattcggtgcccacaccaggggagacactgtgtgaaccatctacagtgttttagaaatggaaacagtgagccttgtgttgtgttttgttttgtttctagaatacccagcctggcacggaaaacctactggtaagtgaaaccacagaccctactgacaaccctcagcgtaaccctacggtcccctactcaccacacctagtgtaactctacagtcccctactcatgacccctacagtcccctaccgacgacctccagcgtaaccctacggtcccctactcaccacacctagtgtaactctacagtcccctactcatgacccctacagtcccctactgacgacctccagcgtaaccctacagtcccctactcaccacacctagtgtaaggaggaggagaccctgccccacctccacagagacccagtatagacaggaggagctcttgtcccacaaccacctggaccccgtgtagacaggaagagaccctgccccacgtccacctagcttaatcctacagtcccctactcaccacacctaatgtaactctacagtcccctactcatgacccctacagtcccctaccgatgacctccagcgtaaccctacagtcccctactcaccacatctagtgtaactctacagtcccctactcacgacccccggagtaatcctacagtctcctactcacgacgcctacagttccctattcatgacccctagcgtaaccatacagtcccctacccatgagccctggcataaccctacaatcccctactcaccacacctagcataaacctacagtcccctacccatgacccctggagtaaccctacagtcccctagtcactacacctagtgtaactaaccatacagttccctatccatgacctctggcggaaccctacactcccctactcacaacccctagtgtaaccctacagtctcctacccatgacccctggcggaactgtacagtcccctactcacgacccctacactctcctacccatgacccctggcggaaccctacagtcccctactcacgacccgtacagtctcctacccatgacccctggcagaaccctacagtcccctactcacgacccctacactctcctacccatgacccctggcagaaccgtacagtcccctactcacgacccctacagtctcctacccatgacccctggcggaactgtacagtcccctactcacgacccctacagtctcctacccatgacccctggcggaactgtacagtcccctactcacgacccctacactctcctacccatgacccctggcggaaccctacagtcccctactcacgacccctacagtctcctacccatgacccctggaggaaccctacagtcccctactcacgacccctacagtctcctacccatgacccctggcggaactgtacagtcccctactcacgacccctacagtctcctacccatgacccctggcggaaccctacagtcccctactcacgacccgtacagtctcctacccatgacccctggcagaaccctacagtcccctactcacgacccctacactctcctacccatgacccctggcggaaccgtacagtcccctactcacgacccctacagtctcctacccatgacccctggcggaaccgtacagtcccctactcacgacccctacactctcctacccaagacccctggcggaaccctacagtcccctactcacgacccctacactttcctacccatgacccctggcggaaccctacagtcccctactcacgacccctacactctcctacccatgacccctggcggaaccctacagtcccctactcacgacccctacagtctcctacacatgacccctggcggaaccctacagtcccctactcacgacccctacagtctcctacccatgacccctggaggaaccctacagtcccctactcacgacccctacagtctcctacccatgacccctggcggaactgtacagtcccctactcacgacccctacagtctcctacccatgacccctggcggaaccctacagtcccctactcacgacccgtacagtctcctacccatgacccctggcagaaccctacagtcccctactcacgacccctacactctcctacccataacccctggcggaaccgtacagtcccctactcacgacccctacagtctcctacccatgacccctggcggaaccctacagtcccctactcacgacccctacagtctcctacccatgacccctggaggaaccctacagtcccctactcacgacccctacagtctcctactcatgacccctggagtaaccctacagtcccctactcacgacccctacagtctcctactcatgacccctggagtaaccctacagtcccctattcaggagccgtagtgtgaccctacaatcccctactcacaacccccggtggaaccctacagtcccctacccatgacccctggtggaaccctacagtcccctactcacgacccctacactctcctacccatgacccctggcggaaccctacagtcccctactcacgacccctacagtctcctacccatgacccctggcagaaccctacagtcccctactcacgacccctacactctcctacccatgacccctggcagaaccctacagtcccctactcacgacccctacagtctcctactcatgacccctggagtaaccctacagtcccctattcaggagccgtagtgtgaccctacaatcccctactcacaacccccggtggaaccctacagtcccctacccatgacctctggtggaaccctacagtcccctactcacgacccctacactctcctacccatgacccctggtggaaccctacagtcccctactcacgacccctacactctcctacccatgacctctggtggaaccctacagtcccctactcacgacccctacactctcctacccatgacccctggcggaaccctacagtcccctactcacgacccctacagtctcctacccatgacccctggcagaaccctacagtcccctactcacgacccctacactctcctacccatgacccctggcagaaccctacagtcccctactcacgacccctacagtctcctactcatgacccctggagtaaccctacagtcccctattcaggagccgtagtgtgaccctacaatcccctactcacaacccccggtggaaccctacagtcccctacccatgacctctggtggaaccctacagtcccctactcacgacccctacactctcctacccatgacccctggtggaaccctacagtcccctactcacgacccctacactctcctacccatgacctctggtggaaccctacagtcccctactcacgacccctagtgtaaccccacatgacccccagtgtaaccctatagtcccctacccacgacctatgtctgcctagacccagtgtgatcaggaggagaccccacctcacctccccctagacccagtgtagacaagaaggagagcctgccccacgtctacctggatccagtgtagacaggagaatactctgcccgacatacagttgaaccactcacaaccctagcgtcaccctacagtctccacgaaccctacagtcttggtttatgggactcttagtgccagtgtggcccaggggtggacacggtggatcctgaaccagaggatgcagatctcacacgggtgagggccccctcatagttctcactgggcagggtctgctcttggcctcaaccttcgtgtcccaatggttggaatatttatgctcagcctgttctactgattttcccattttattcctctttcctctacgtgggttaagaatatattctagtgactgtctaaggagattatgtctccctctaaaatgcttttagagtgagtactgttgccgggtatttaccaagtctcgcggccactctgaccctcggtatcctcctctgtccgatgagtatgctagacttggggatcttaatatcccttgctaaactatccgtctgaaggtctgttaatatcagttgttgatcctgaatcatttatttatgtatgtatttatttttgagacggagtctcgctctgtcccccaggctggagtgcagtggtgcgatctcggctcactgcaagctccacctcccagcgattgtcctgcctcagcctccctacagagattctacagtctcagcctgtagctgggactacaggcacccacccccacacctggccaacaatttctgtttcagaaaataaaattttagccaggcacggtggctcacgcctgtcatcccagcaccttgggaggctgaggtgggcggatcacttgaggtcagcagttcaagaccagcctgggcaacatggagaaaccccatctctactaaaaatacaaaacgtacccatgcgtggtggcgggcgcctgtaatcccagctacgtgggaggctgaggcaggagaatggcgtgaacccgggaagcggaggttgcggtgagcccagatcatgccattgcactccagcctgggcgacagagcgagagtgtctcaaataaaataaaataaaagaggccgggcgtggtggctcatgcctgtaatcccagcactttgtgaggccgaggcggtcggatcacgaggtgaggagatcgagaccatcctggccaacatggtgaaaccccgtctccactaaaaatacaacaaaaattagccgggcgtggtggtgggcacctgtagtcccaactactggggaggctgaggcaggagaatggtgtgaaccctggaggtggaggttgtagtgagccaagatcgcgccactgcactgcagcctgggtgacagagggagactccgtctcaaaaaataaataaataaaataaaataaaaaagcttaaagcctacatcacccaaattttcccaacttgtctcccatcgaaatactaacgaggcttgactctgcttagcttcgaagacccgatcagaccaagtgcattcagagtggtagaaaaaaaagaagaaaaagaaaaaaagaaaaggagaaaaaaacttaaaagacaaaagaacgaaaaaaggcaaccttttcctccacacagaagacgcctatctctaactttcttttttcctccaaagattaatgtttctggtgatttggaaaatagatacaactttccaagctctgagcccagagcaaaacacagtgtgaagatcagagctgcagacgtccgcatcttgaattggagctcctggagtgaagccattgaatttggtaagcgttgggcggaggtaagggatgtttgtgccgtctgcggccaccctgcagcaggcacagaggtcaggtgctctgtcctgggcgctgagatcgagttgagcacgtcgctgggagtagtgtcaggctctgagcttatcgctgaggctcaaaagaaggaggtggtctcgtacttggtcccgcaacattgctttgctgatgttttttcaggacggatgagttggctcccttaataaccagagaagggccaggtgcagcggttcacgcctgtaatcccagcaatttgggaggctgaggccggcggatcaccggaggtcaggagtttgagaccagcctggccaacatggtgaaaccccgtctctactaaaaatacaaaattagcccagcattgtggcaggtgcctgtaatcccagctactcgggaggctgaggcaggagaatcacttgaacccaggaggcggaggttgcactgagctgggatcacgccattgcactccagcctgggtgacagcgtgagactccgtctcaaaaaaaaaaagaaaaaaaaatacaaaaactaaccaggattggtggcacattcctgtaatcccagctactcaggaggctgagggcaggagaatgacttgaacccgggaggtggaggttgcagtgagctggggtcacgccattgcactccagcctgggtgacagagtgagactctgtctcaaaaaaaaaaaaaaaaaaaaaaagaaaaagtagaaggaggtggtctcatactcatacggggtcatgcaacattgctttgctggtgtttttttcagggtggatgagctagaatcccttaatagccagagaaggaccccactgatagccctcctaaagtcccacctccctctgctccactgggaaacaatcagtcagtctttgtccggtcaaaccgtcaccattccggctccctggccaaggggaagctctctccctctttttttcttttttttttttttttttttgagacggcgtttcgctcttgtcgcaggctggagtccagtggcgcaatctcggctcactgcaagctccacctcctgggttcacgccattctcctgcctcagcctccccagtagctgggactacaggtgcccatcaccacgcctggctaattttttgtatttttttttttttagtagagacagggtttcactgttttttagccaggatggtctcgatctcctgacctcgtgatccgcccacctcggcctcccaaagtgctgggattacaggcgtgagccaccgtgcccggccctccctcttttttttttttttttttttttagatggcgtttcgctcttgttgcccaggctggagtgcagtggtgccatctcggctcaccgcgatctccgcctcccaggttcaagcaattctccagcctcagtctcccgagtagctgggattacaggcgcccgccaccacacccggctaattttgtatttttagtagagacggggtttcaccatgttggtcaggctgttcttgaactcctgacctcaggtgatctgcccacctcgccctcccaaagtgctgcaatgacaggcgtgagccaccctgcccgtccggggaagctctcttcaaagccaggtctcggctgcccaggagacaggtctatgcttttctctgaagatgattttgagggctccaaattgaaaaggggaaggggcaggatattgagaagtatgcggttttcacctcaacaaagggtacagaagaaaaattgtgagctgcagtgcagtggtgcacctctacctcccagatcacacagacaaaatggggtacagggatgatcagaggtgcattcgtgtctggtgggccggggtgactgcacctgtaagaaattttttttgtttatttattttttgttatttgagacggactctcgctctgtcacccaggctggagtgcaatggcacgatctcagctcactacaacctctgcctcctgggttcaagcgattctcctgcctcagcctcccgagtagctgggattacattagacatgcatcacgcttggccaatttttgtatttttctttttatttatttatttatttattttgagatggagtttcgctgtgtcacccaggctggagttcaatggcacgatcttggctcactgcaacctccgtctcccaggctcaagcgattctcctgcctcagcctcctgagtagctacgattacagacatgcatcatgcttggccattttttaaatatttttatttatttatttattttgagacagggtctcactctgtcacccaggctggagtgcaatggcacgatctcggctcactgcaacctccgcctcccgggttcaagcgattctcctgcctcagcctcccgagtagctgggattacagacatgcatcacgcttggccaatttttgtatttttatttttatttatttatttatttattttgagatggagtttcgctgtgtcacccaggctggagtgcaatggcacgatcttggctcactgcaacctccgtctcccaggctcaagcgattctcctgcctcagcctcctgagtagctgggattacagacatgcatcatgcttggccattttttaaatatttttatttatttatttattttgacacagggtctcactctgtcacccaggctggagtgcaatggcacaatctcggctcactgcaacctccgtctcccaggctcaagcgattctcctgcctcagactcccaggtagataggattacaggcacccaccaccatgcctggctaattttgtattttttttttagcagagatgaggtttcaccatgttagtgaggcttgtctcgaactcctgacctcagatgatgcgcccgcctcggcctcccaaagtgctgggatgacaggtgtgagccaccgtgcctggcccaatttttgtatttttggtagagacggggtttcaccatgttggtcaggctggtctcgaactcccaacctcaggtgatcctcccgtgtcggcctcccaaagtgctgggatgacaggcgtgagccaccgcatccggcccatggtggcaaagttttaacagctcaccagaaatttccttgtgggcaaaacatagggcaggcaggttgctttcatctcagagccatcttagttaagaaccaaaaacagggaggcaggtttgctgggcccagttctcagcttgactgttccctttggctaaatgcatttggacacccgaagagatttaatttcctttcacatgtccgtcaacgattcaccgcagacgcaaacctgtgtgtctctccaggttctgacgacgggaacctcggctctgtgtacatttatgtgctcctaatcgtgggaacccttgtctgtggcatcgtcctcggcttcctctttaaaaggtaacctgtgaaacacctgggcctccccaatgaaaacaggccaggccgggaggaaagcgctttgtccagtctctgtctctgtctctgagaaagagaaacacagccttggccgggcgtgttggctcatgcctgtaatcccagcactctgggaggccgaggcgggtggatcacgaggtcaggagatcgagaccatcctggctaacacagtgaaaccccgtctctactaaaaaattagcccggcgtggtcgcgggcgcctgtagtcccagctactcgggaggctgaggcaggagaatcgcttgaacccgggaggtggaggttgcagtgagccgagattgcaccactgcactccagcctgggcgacagggcgagactccatctcaaaacaaacaaaagaacggagaaaacgggagatcctacaggaatacacagtgatgctcacagggaatctttctagaatcttccctcagcccctcgggcacagggatgggaatggaacaggcagtcagctgtgggcagcttcagggagtctgaagtcactgctgttgaagggctgagctccagaggggaaacgcctgccttgatcccactagccttgaagagcgtggtttctgggttggaggtgggtttttttttgtttgtttgtttttttgttttttgttttgagacagacttttgctcttgttgcccaggctggagtgcagtgttgcaatctcggctcactgcaacctccacctcccgggttcacgccattctcctgcctcagcctcccgagtagctgggattacaggcatgcaccacgatgctcacctaatttttgtatttttagtagagatggggtttcaccacgttggccaggctggtctctaactcttgacctcaggtgatccacccgccttcgcctcccaaagtgctgggattacaggtgtgagccaccatgcctggcctagttccttaagatgtttgtcatttggtgatttttttttgtttttttgagatggagtctcactctgtcacccaggctggagtgcagtggtgcaatctcggctcactgcaacctccacctcccaggttcaagcaattctcctgcctcagcctcctgaatagctgggattacaggcaagcaccacgatactcagctaatttttgtatttttagtagagacggggtttcaccacgttggccaggctggtctcaaacctcaagtgatccacccgcctcggcctcccaaagtgctgggattacaggtgtgagccactgcacccggcctagttccttaagattttcgtcacttggtgattcttagtgaagttttgcatagttgagcgcagacaccccgcacgcagcatccctcggcacagggcgttgatggaaggaactctggtgacccggggttcattctcttcacactttttctctgtgtctcaggttccttaggatacagcggctgttcccgccagttccacagatcaaagacaaactgaatgataaccatgaggtggaagacgaggtaggcaggggtgggcggagcagtgacctgggatggaaggtggggagtggggagcgtgggacacggcctctgggtgtcgaccatcttgcttctccaccagatgggaccgcagcgtcaccaccggtgtggctggaatctgtatcccactcctgggccttctcccgggtcggggtcttctccaaggttggggtcagagtcatctctgtgagctccatcaggagaaactgaggcagggtggtggtcaagaaaaggaggagaagacggtagagagggccaggcacggtggctcatgcctgtcatcccagcactttgggaggttgaggcatgtggatcatctgaggtcagaggttcgagaccagcctggccaacgtggtgaaaccccatctctgctaaaaatacaaaaaattagctgggtgtggtggtgtacgcctgaaatcccagtgactcgggaggctggggcagtagaacggcttgaacccagggggcggaggttgcagtgagccgagatcgcaccactgcactccagcctgggtgacagagcgagactccatctcaaaagaaaaaagaaggtagagaggagaggcagaaatagagacaagagacagaggcagagaaagatggagggagagagatggaggagagagagaggaatgtagaagagaatgaggagacacaaaagagagggaaacaggcagacagactgacagaaacaaaggcagacacacagacagagaaacagagagagggagggagaaaagggagaaggaaagagagagacacgagacacagatggagaaacagagacagataaacaacaaacataaagacccaggcgggggccggtcgcggtgactcacatctgtcatcccagcactttgggaggccgaggcgggtggatcacttgaggtcgggagttcgagaccagcctgaccaacctgaagaaacctcgtctctactaaaattgcaaaaattagccaggtgtggtggcgcacacctgtaatcccacctactctggaggctgaggcaggagaatcacttgaacccaggaggcggaggctgcagtgagccgagatcgcaccattgcactctaacctgggcaacagagcaaaactctctatcaaaaacaaaacaaaacaaaaaaatcatccccagcagggagaggagagagacagagaggaacagaggcacagagaggggagagagacaaagacagagagacacagagaaagacacagaaaaagagagagagagggagaaggagacatagagacagggacaaagagaaaaagacggacagagagagaaacagagagacataggtggacacagagaggggagagagagagagagacagaaagagacagagagcaagggatgggagtggaagagagagacagatggaggaaaaagacagagagggaggcagataaaagacacacagagacaccgagagagacagggaagacagaggagtcggacttagtctcagcgagagcccagagagggtgaacaagggcgaggaaccatgtgacctgcaccctgagaccccattggcgctcctctcccacccacctctctccggctcagggactgcgtcttatgttgcagtaggctggcaggctggaaagtcaggccagggctgatgctgcatcccagaggcagaactgtcctgcattctcagagtgggagatgaaatttttaaaaaggaaataaaactcttgtcggggaacctcagcttttatcctttagacgtttgactgattagaccaggcccactcttctcctttacactttcggctgattgaatgaggcccacccttccccctttacaccttcgactgattagatgaggcccaccattcccctttagaccttcgactgatcagatgaagcccacccttcccctttagaccttcagcttattagataaggcccacccttaccctttagactttcaactgattaaatgaggcccactctccccgtttagacctttgactgattagatgaagcccacgcttctcctttggaccttcaactgattagatgaggcccacccttcccccttcagcctttcgactgattagatgaggcccaccctcccctttataccttcgactgattagatgaggcccaccctcccctttataccttcgactgattagatgaggcccaccctcccctttataccttcgactgattagatgaggcccgtccttcccccatttagatcttcaactgattagatgaggcccacctttccctttttagacctttgactgattagatgaggcctacccttctccctttagacctttgactgattagatgaggcctacccttctccctttagacctttgactgattagatgagacccacccttcccatttagaccttcaactcattagatgaagcccacccttccccccttcccctttagaccttcagcttattaattagacaaggcccaccccctttagaccttcaactgattagatgaggcccacccctcttcagaccttcaactgattagatgaggcccaccccctttagacctttgactgattagataaggcccacccacattctccagtccaatctcttttcctggaaatcagctgattgtggacttgacatctacaaagccccttcgtagcagccgctgagtcatggtttcattcaataactggggactgtagcctagtcacggggacacgtcattggtgccgggtatcagagacgaaggccaagagatgaaagagaaacagagactgaacccaaaagaggcagacacacaggaagatggagatagagacccagagatgggggtggaagaaggtgagagggggaggaaagagagacagagagggagacagagaaaagaggcagagagaccgagagagaggctgaacagcaagaccccagagagggtgactaagggtgagagacttgcgtgacccacatcccaagaccccgtgggtggccctctcccacccacctctctccagctcaggggctgtgtcttcctcccatggggaactccagttgcagcccagggttgcccccagcgccctcttctctgccacataggtaacatcctcctggttgccacttgcacacccccatcctagacctggccatctgtcattccattaccttccacccccacgccagcctcctccccggcccccgctttccactgacccccaggggtcccccacatcgaggtgccaggatgacggcttcaggcttcaaccttcccttctctgagctccatcagctccaggggcttagcacctgctgtaccctgcccaggtttcatgctcacaagctcttccaaagaccaccctgttcatcgtcaactatgaggtcccatgggtggatctgtctcagatctttaccccaggaaaaacccatggccaggtgcagtggctcatgcctgtcatcccagcactttgggaggccgaggcgagtggatcacctcgaggtcaggagtttgagaccagcctggccaacatggtaaaaccccatctccactgaaagtacaaaatttagctggtggcggctaaagggggaaaggtgggcctcatctaatcagtcgaaggtctaaagggggaagagtgggcctcatctgatcagtcaaatttgtggtggcgggcgcctgtaatcccagctactcaggaggctgaggcaggagaatcgcttgaacccgggaggccgaggttgcagtgagctgagatgacaccactgcactccagcctgggcaatagaatgagactccgtctcgagggagaaaaagaaaataaacacagcccactgagtcccaggctgagctcgtgaagatctgacagcctgaaccctcctttttctcagatcatctgggaggaattcaccccagaggaagggaaaggctaccgcgaagaggtcttgaccgtgaaggaaattacctgagacccagagggtgtaggaatggcatggacatctccgcctccgcgacacgggggaactgttttcttgatgatgctgtgaacctttatatcattttctatgtttttatttaaaaacatgacatttggggccaggcgcggtggctcacgcctgtaatcccagcactttgggaggccaaggcaggcggatcacctgaggtcaggagttcaagaccagcctgcccaacatggtgaaaccccatctggactaaaaatgcagaaatttacccaggcacggcggcggacgcccatcatcccagctacttgggaggctgaggcaggagaattgcttgaacccgtgaggcggaggttgtagtgagccaagatcgcaccattgcacaccaacctgcgtgacagagcaagattgcatctcaaaacaaacaataataataaataataaaaacctgatatttggctgggc

SEQ ID NO: 2864 - DNA, 25577 bp, human; identical to SEQ ID NO: 2846

SEQ ID NO: 2865 - DNA, 41135 bp, human; identical to SEQ ID NO: 2847

SEQ ID NO: 2866 - DNA, 41122 bp, human; identical to SEQ ID NO: 2848

SEQ ID NO: 2867 - DNA, 41135 bp, human; identical to SEQ ID NO: 2847

SEQ ID NO: 2868 - DNA, 41089 bp, human; identical to SEQ ID NO: 2844

SEQ ID NO: 2869 - DNA, 41089 bp, human; identical to SEQ ID NO: 2844

SEQ ID NO: 2870 - DNA, 21597 bp, human; identical to SEQ ID NO: 2852

SEQ ID NO: 2871 - DNA, 31729 bp, human; identical to SEQ ID NO: 2853

SEQ ID NO: 2872 - DNA, 41135 bp, human; identical to SEQ ID NO: 2847

SEQ ID NO: 2873 - DNA, 37109 bp, human; identical to SEQ ID NO: 2855

SEQ ID NO: 2874 - DNA, 41090 bp, human; identical to SEQ ID NO: 2856

SEQ ID NO: 2875 - DNA, 41135 bp, human; identical to SEQ ID NO: 2847

SEQ ID NO: 2876 - DNA, 40699 bp, human
tggtcctcctttggctcacgctgctcctgatcgccctgccctgtctcctgcaaacgaaggaaggtaagaactggagaaaaaatgcacgtgccacctggggagcggtgggggtagacagacacacaatgtcagcgtgccgtccttcagggaaacttttcatgctgagctcatggcagagtctcatgcagtggtcgggaatgactcagacacttccctgtacccgtcaccaagttccctgtaatgcagcatcttgcaaaacggtaatacgacctcacaggcagggacctgatcgtgacacagatgccatgtgaggtgttttgatgaaactcacacgctgggatcaacagcaccaataacaatttccagtttccttcattgtttatcttactttttcattttcttattatttttattttggagacagggtcttactgtcttgcccaggctggagtgcaatagtgtgatctcggctcactgcaacctctgcctcccggattcaagcgattcttctgcctcagcctcccgaggagctgagattacagtcgcgcaccaccatacccggctaatttctgtatttttgatagagacgggatttcactatgtcggtcaggctggtctagaactgctgaccacaagtgatccgtctgccttggcctcccaaagtgctgggattacaggtgtgagccacagcgcccggccttttttttcattggtttttacagtctattactgcagggtttcactttaccttgaatttcttttaactttaatttgcttttcattctttaacttcttttttttttttttttttgacacagagtttcattctggtcgcccaggctggagtgtaatagcgtgaccatggctcactgcaacctctacctgctgggttcaattgattctcctgtctcagcctcccaagcacctgggattacaggtgtccgccaccacgcccagctaatttttctgtttttactagagacggggtttcaccgtgttagacaggatggtctcgatctcctgacctcatgatccgcctgcctcggggttgggattacacactttgggaggccaaggcaggtggacgatcacaaggtcaggagttcgtgaccagcctgactaacacggtgaaaccccgtctctactaaaaatacaaaaatcagctgggcgtggtggcgggcgcctgtaatcccagttactcgggaggctgaggcaggagagtcgcttgaacccgggaggaggaggttgcagtgagcctagatcacgccattgcactccagcctgggcgacagagtgagactccgtctcaaaatgaatgaatgaatgaatgaatttcttataagaatttttttccccagacagtttgttttaagggataaattatccttctaagttagaagaaaataatgccagaagtctagacattcttatgctttggtcccgcttatcaaaccaaggttgctgaccttgataaccactcaagatccttacagtttataaagtcatttcctcaagttttctaagtggccgatcagagataaaccctagagaaatagttgatgtatgtttctagctttgggtgaccagcaaaatgtgatagaatattgccttttactggccgggtgcaacggctcacgtctgtaatcccagcactttgggaggctgaggcgggtggatcacttgaggtcaggagttcaaaaccagcttggccatcatggtgaaaccccgtctgtactaaaaatacaaaaaaattagctgggcgcggtgctgtgcacctgtaatccctgctactcaggaggctgaggcaggagaatcacttgaacccgggaggcggaggttgccgtgagccaagatcacgccattgcactccaacctgggtgacagagcgaggctccatctcaaaaaaaaaaaaaaaaaaagaatattgcctttaacatctttgtacaggtcatttatgaaatatcttgagctctgtgatggctaagagagaccttctttttctttctttcttttttttttttttgagacggagtttttttgtttttttgagatggagtctcgctctgttacccaggctggagtgcagtggcacgatctcagctcaccgcaacctccgcctcccgagttccagtgattctcctgcctcagcttcctgattagctgggattacaggcgcccgccaccacgcccaactaatttttgtatttttagtcgcgacggggtttcaccgtgttagccaggatggtcttgatcacttgacctggtgatccgcccaccttggcctcccaaagtgctgggatgacgggcgtgagccaccacgcccgtttgctttatgacttctaccagctcacagaagtctcctgtgtacatagaactccacttcccagccaggctcagtaactcacgtctgtgatcccagcactttgggaggctgaggcaggcagatcatgtgaggttgggagttcgagaccagcctggccaacatggtgaaaccccatctctagtaaaaatacaaaaattagccgagtgtggtggcaggcacctgttatcccagctgcacagcaggctgacacaggataatcgcttgaacccgggaggcggaggttgtagtgagccgagatcgcgccactgaattccagcctgggcgacagagtgagactccgtctcaaaacaaacaagcaaacaaaaatacccattacaatgttgttttaagattgttgtatatcaactgggcatggtggctcatgcttgtaatcccagcactttgagaggccgaggcggacagatcacgaggtcaggagatcgagaccatcctggccaacatggtgaaaccccatctctagtaaaaatacaaaaattagccgggcgtggtggtgggctcctgtaatcctagctactcgggaggctgaggcaggagaatcgcttgaacccgggaggtagaggttgcggtgagctgagatcgtgccactgcactccagcctgggtgacaagagcaaaactccgtctcaaaaaaataaaaaatttaaaaaaataaagaactcgacctcccaaaggtattggctaactccacgggcaaaaaaaccatacccattacaatgctgttttaagattgttgacctggtgcggtggctcatgcctgtaatcccagcactttgggaggctgaggcggacgaatcatgaggtcaggagatcgagaccatcctggctaacacggtgaaacgccatctctactaaaaatacaaaaaaaaaaaaattagccgggcgtggtggcgggcgcctgtagtcccagctactcgggaggctgaggcaggagagttgcttgaaccaggaggcggagcttgcagtgagctgagatcgtgccactgtagtccagccagggcgacaagagtgaaactccatgtcaaaaaatttaaaaaaattaaataaaagaactccacctcccaaaggtattggctaactccacgggcaaaaaaaaaaaaccataccccttacaatgccgttttaagattcttacgtatctcttcgaactccaacctgtcaccgttttagatccaaacccaccaatcacgaacctaaggatgaaagcaaaggctcagcagttgacctgggaccttaacagaaatgtgaccgatatcgagtgtgttaaagacgccgactattctatgccggtaaatcatactctctattgtttttttatttttattttatttatttatgtatttatgtatttatttattttttgagacggagtcttgctctgtcgcccaggctggactgcggtgacccgatctccgctctctgcaacctccacctcccaggtccatgccattctcctgcctcaacctcccgagtagctgggactacaggcgcccgccaccatgcccggctaatttttttgtatttttagtagagatggggtttcactgtgttagccaggagggtctcgatctcctgacctcgtgatctgcccgcctcggcctcccaaagtgctgggattacaggcgcgagtcaccgcgcatggcccagactctctaatgttgacgaacaagacgtttccgtcttctgcaggaatctcagaaccaatactgctcccatcgctggtgtcatgactacctggtttctgccccgaagtcaggtgtgggatttgaagtgactttggagggtctggttccccgtccgcgggacatctaagatggcacacactggacagggtggatgtgaaagtgaaatgaggctaagctatgactggtgcgaaacccaaccccacgctgggcgtggtggctcacgtctgtaatcccagcactttgggaggctgaggcgggcggatcatgaggtcaggagttcgagaccagtctggccaacacggtgaaacgctgtctctgctaaaaatacgaaagttagccgggcacagtggctcacaccagcactttgagaggctgaggcggatggatcacctggggccaggagttcgagactagtctgggcaacatggtgaaaccccgcctccactaaaaatataaaaattagctgggcatggtggtgggcgcctgtaatcccagttacttgggaggctgaggcaggagaatcgcttgaacccgggaggcagaggttgcattgagccgagactgtgccactgcactccagcctgggggacgagagcaagacttcatgtcaaaaaagaaaaagaaaaattagccggatgtggtggcacatgcctgtaataccagctattcaggaggctgaggcaggagaattgcttgaacctgggaggccgaggttgcactgagccgagattgtgccactgcactccagcctgggtgacagagtgagactccatctcaaaacaaaaacaaaaacaaaagcaaaaacaaaacaaaagtgtgtgctcaggaaacaaggtcctcatcacgaaatccttccaaatcccccatcttgtcatcacctgcgttctcagggtttgagaacagcgccagacctcatggggtggcccaggtgacactgtgagctatttacaagtcagtgtcttatgggaaaggagcacgtttccctgagaacctatttggtcccctccaagagctatgttcgttcaatacaattcaaatcacggcccttcatgcgtctgctcgggccaccattataaaatcctacccccagctccaaatacagtcccattgaactttgtgattttggagagtagagataaaacagtctagaatcccagagcgattttaccataccatggcaaactgactctcaactttagaaacacaaatgctgaaaaaaaaactaaggaaattttgaaaaagaaggtgaatgaaggagaacctgccttacctatatcaaaaggcactgaaaagttcatacccaatgtgcggattgctataagaatacacaagtaggccgggcgtggtggctcacgcctgtcatcccagcactttggaggccgaggcgggtggatcacgaggtcaggagatcgagaccctcctggctaacacggtgaaaccccgtctctactaaaaatataaaaattagccgggcgtggtggctggtgcctgtagtcccagctactcgggaggctgaggcaggagaatggcttgaacctgggaggcagaagcttgcagtgagccgagatcgcgccactgcactccagcctgggcgacagagcgagactctgtctcaaaaaaacaaaaacaaaagcaaacaaaacgaagaatatacaagtagattaatgaaatgtggccgggtgcggtggtgaggcaggagaattgcttgaacccgagaggtggaggttgcagtgagctgagatcgcaccactgaagtctagcctgggcaagcggagtgaggccctgtcttaacaaaaaaacaaagaaacaaaaaacaaacaaacaagaaaaaaacaaagcaaaacaaacagaaaagtatttcactaatatttactgctaagtgggattatttttattcaagcttttgtatctttagaaaaaaattgtggccgggcgcggtggctcacgcctgtcatcccagcactttgggaggccgaggagggtggatcacgaggtcaggagatcgagaccctcctggctaacacggtgaaaccccgtctctactaaaaatataaaaattagccgggcgtggtggcgggcgcctgtagtcccagctacttgggaggatgaggcaggagaatggcatgaacccgggagggagaggctacagtgagccgagatcgcgcccctgcactccagcctgggcgacagagcgagactccctctcaaaaaaaaaaaaaacagaaaaaagtcttggccgggcacggtggctcacgcctgtaatcccagcactttgggaggctgaggcaggcggatcacatgaggtcaggagttcgagaccagcctgaccaacatggtgaaaccctgtctctacccagaaaaatactttaaaaattagctgggcgtggtggcgggcacctgtaatcccaggtgctcgggaggttgaagcaggagaatggcttgaacccgggagggagaggctgcagtgagccgagatcacgccactgcactccagcgtgggcgacgagagcgaaactctgcctcaaaaaaaatctgaacatcattagcgtcaaattaagcatggtctgtcagcagccatcatagtcctatgtctctcttaggcagtgaacaatagctattgccagtttggagcaatttccttatgtgaagtgaccaactacaccgtccgagtggccaacccaccattctccacgtggatcctcttccctgagaacagtgagaaaaatgttcattgtttgtttattctctattccctccctccttccctctctccctccctctcgccttcgctgtgtcttttttcttttctttttctctttctttctttctttctttctttctttctttctttctttctttctttttctttctttctgtttctgtttctttcttcctttctttttctttctttctttccttctttcctctctttcttttctttctctttccctccctcccttctttcttttcttcacttccttccctccctccttctctccttttcctccctcctccttcccaccctacttcctctctctccttccttccctttcgttttcttttcctccctgcctcactcccttccttccttctctccctcctcttttccttccttcttccctccttccctttctctctctctctctttctctctttccccctcccctcccttcccctcctctcccctctcctttcctgacacggtcttgctctgttgcccaggctggagcgcagtggtgcaatcacagcttactgcaggcttcacctcctgagctcaaacaatccttctgcctcagcctcccacgtaggtggaactacacccatgtaccaccatgcccacctaattttttaaacacctttttttttttttagacagagtctcactctgtccaccaggctggagtgcactggcgcgatctcggctcactgcaacctctggctcccgggttcaagcgattctcctgcctcagcctcccgagtagctgggattataggcgcccaccgccacgcccagctaattcttgtatttttagtagagatggggtttcaccatgttggtcaggctggtctcaaactcctgacttcgtgatctgcccgcctcggcctcccaaagtgctgggagtacaggggtgagccaccgcgcccagccttaaatactttttgtagagatggggtgtcgctatgttacctgagctggtctcaaactcctaggctcaagtgatcctcccgcctcagtctcccaaagtgcagggattgtaagcatcagccaccacgcctggcctcttctttgttttttaattaattagaagtccatggtttatttttttgttttgttttgtttgtttttctgtgatggagtcttgttcttgtcgcccaggctggagtgcagtggtgcgatttcagcttaccgcaaactccgcctcccgggttcaagcgattctcctgcctcagcctcacaagtagctgggattacaggcacccgccaccaagcccggctaaattttgtattttaagtagagacggggcttcaccatgttggtctcgaactcctgaccttgtgatccacccgcctcagcctcccaaagtgctgggatgacaggcgggagccactgtgccgggcctcaatttaattatttttaagtttaatggatttccagggagttatgccgagtcggaaaaaaaagaccactccagagcgtgacacacacagtgatttcattaatacaactgtcttgaaatggcaaaattttacaaatagaaaacagtctcctgggttgcagggatataagcaggagtgagagctgagagaggtgggtttggctgtaaaagtgctccttggggaggccgggcgcagtggctcacgcctgtaatcccagcactttgggaggccgaggcgggcggatcacctgaggtcaggagttcgagaccagcctggccaacatggtgaaaccccgtctctactaaaaacacaaaaattagccgggcatggtggctcacgcctgtaatcccagcactttgggaggccgaggcaggcggatcacctgaggtcaggaattcgagaccagcctggctaacatggtgaaaccccatctctactaaaaatacaaaattagccaggggtggtggcacatgcctgtagtcccagctactcaggaggctgaggcaggagaatcacttgaacccgggaggcggagattgcggtgagctgagatcgtgccattgctctccagcctgggcaacaagagtgaaattccatctaaaaaaaaaaaaaaattaaaaagaaattagcggccgggcccagtggctcacacctgtaatcccagcactttgggaggccgaggtgggtggatcgcgaggtcaggagatcgagaccatcccggctaacatggtgaaaccccatctctactaaaaatacaaaattagccaggggtggtggcacatgcctgcagtcccagctactcaggaggctgaggcaggagaatcacttgaacctgggaggcggaggttgtggtgagccattgagctccagcctgggcaacaagagtgaaactctgtcttaaacacacacacagatgcacacacacgcacacacacacaaacaatgaaagaaaaacatctgtagtcccagcagtttgggaggctgaggcgggtggatcacttgaggtcaggaattcgcgaccagtctgggcaacatggtgaaaccccatctctactaaaaatacaaaaattagctgggtgtggtagtgggtgcctgttgtcccagatacttgggaggctgaggcaggagaattgcttgaacccgggaggtggaggttgcagtgagccgagatggcgccattgtactccagcctaggcgacggagcgagactctgtaaaaatgaataaataaatcattaaaagaatatgcaggatctctccatattattattattttttacaacggcttgtgtatctaccatggtctcaaaatacaaaaggcactctaaaaaggaattagagttttatttttttttttgagacggagtctcgctcttgtcacacaggctggagtgcagtgacgtggcctgggctcactgcaacctctgcctcctgggttcaagaaattctcctgcctcagcctccctagtagctgggattacagcggcccgacatcacgcccggctaatttttgtatttttagtagaggcagggtttcaccatgttagccaggccggtctcgaactccggacctcaggtgatcctcctgcctcggcctcccaaagtgctgggattacaggcgtgagccaccatgcctgggtttgtttttttatttttttgagacgaaggctcactctgtcgcccaggctggagtgcagtggcgtgatctcagctccatgcaacctctgcctcctgggttcaagaaattctcctgcctcagcctcccgagtagctgggattacagcggcccgacatcacacctggctaattttttatatttttagtagagactgggtttcaccatgttagccaggctggtctcgaactccggacctcgggtgatccacctgcctcggcctcccaaagtgctgggatcacaggcgcgtgccaccagacacagctaatttttgcatttttagtagagattgggtttctccatgttggccaggctggtctcgaactcctgacctcatgtgatccacccgcctcggcctcccaaaatgctggggtgacaggcgtgagccaccgcgcccggtcccgattcgagttctctttcatgtttgtgaacccaggtgggaagccttgggcaggtgcggagaatctgacctgctggattcatgacgtggatttcttgagctgcagctgggcggtaggcccgggggcccccgcggacgtccagtacgacctgtacttgaacgttgccaagtaggtgtgcccgtgggcagaggccgggctgtccctggtgcgggtgccatcggcgtggggtcgtcccccaaccttaccgcttaccgcagcaggcgtcaacagtacgagtgtcttcactacaaaacggatgctcagggaacacgtatcgggtgtcgtttcgatgacatctctcgactctccagcggttctcaaagttcccacatcctggtgcggggcaggagcgcagccttcggtatcccctgcacagataagtttgtcgtcttttcacagattggtgagtagcccgggacactccctcccaccctcagttctgtgataccacggctttagcgccaggccagatcccacgggaccacgtggctcccaacgcagacgttggcctctcacatttccagaggctggacgttggaggtcagcgtgctggctggctgggctcctcgggaggtctcttcctggcttggagagagggtcatcttctcactgtgtcttcacgtggtgtagagagagagagagatgaagttctggggtctcttgttagaagggcactaacaccatcatgggtcccatcatgggtcataggatccctcaccatgggtcatgggaccccccatcatgggttccatcatgggtcccatcatgggtcatagaatcccccatgatgggtttcatcatgagtcatagaaccccctatcatggattccatcatgggtcatgggaacccccatcatgggtcccatcatggttcataggatcccccatcatgggtttcatcatgagtcatagaaccccctatcatggattccatcatgggtcatgggaacccccatcatgggtcccatcattggtcataggaccccctatcatgggttccatcatgggtcatgggacaccccccatcatgggttccaccatgagtcatgggatccctcatcgtgggttccatcatgggtcatgggaccccccatcatgggttccatcatgggtaataggacccccccatcatgggttccaccatgagtcatgggatcccttatcatggattccatcatgggtcatgggaccccctatcatggattccatcatgggtcatgggacccccccatcatgggtcccatcatgagtcatgggatccctcatcatgggtttcatcatgggtcataggacccccatcatggattccatcatgggtcatgggaacctccatcatgggtcccattatgggtcatagaattccccatcatgggttccatcatgagtcatgggaccccccatcatgggttccacatgggatccctcatcattggttccatcatgggtcataggatcccccatcataggtcccatcatgggttccacatgggatcccccatcataggtcccatcatgggtcatgggaccccccccatcatgggttccatcacgggtcatgggaccccccccatcatgggttccatcacgggtcatgggaccccccccaatcatgggttccatcatgggtcatgggaacccccatcatgggtttcatcatgggtcataggatcccctatcatgggttccatcatgggtcatgggaccccccccatcacgggttccatcatgggtcatgggaacccccatcatgggtttcatcatgggtcataggatcccctatcatggattccatcatgagtcatgggatccctcatcatgggttccatcatgggtcatgggacccccccccccatcatgggtcgtgggacccccacccccatcatgggtcatgggagcccccattgtgagtcatggaatccctcatcatgggtctcatcatgggccatgggtcccaccatgggtcatgggagcccccatcatgagtcatggaatccctcatcatgggtcatgggtcccatcatgggtcatgggagcccccatcatgggtcatgggtcccatcatgggtcacgggagcccccatcatgggggtccaccctcataacttcagcccacgccagtcacctcccaaagaccccaccttctaacaccgcccaaccaggggttagagcttcagtggaggaatttgggacagaaggacacacactttcagtccacgatacccgagctccgaggaacctcccaggtggtgagaatgtcaatatgcccagagctgacgtgccctgaacccaagggcagggtgctcggatgcttcagaagaggagggggaaacgaggaagaggaggagaaggacaaggagaagagaagggaggagaggaagaacatgagcagggggaggaggaggagaaggaaaagaaacagaggaaaaggagggggaggaggtagagatggagagggaaggaagaggaggaagagaagaaaacggagaaagaggagggggaggaggaggaggaagagaaaatggagaaagaggagggggaggaggtggagatggggaggggaggaagaggaggaagagaagaaaacaggagggggaggaagagaagaaaatggagggaaaggagggggaggaggtggagatggggagagaaggagcaggaggaggagaagaaagaagaggaagaaaggaggaggagagggtggaggaggaagagggtgaaggagagagggaggagaatggagaggaggaggaggcgggggagggaagagaaggaggtgaggaggaggaaggggaggatagagaaggtggggtagaagggtggtgaggtggggagggagaaggagggggaggaggagagaggaggactggggggaggaagggggaggaggggagagaggaggagggaggagggagaaggagggggagaggatggaggaaggggagcagatggaggaaggcgagcaggagggggaggaaaaaggaggggcaggaggaagaaggagcgggaggagaggaggaggaggaggaggagaatgggcagggaggaggagagggaagaaaaggagggggaggaggaaggagggggaggagggtggagggggaggagggtggagggggaggagggtggagggggaggaggaaggagggagaaggaggggagaggatggaggaagaggagcaggagggggaggaaaaaggaggaggggcaggaggggaggaggagaaaggagagtggaggaggagggtgacaaggagaatggggaggagagaggagtggtagaaaaaggagagagaggaagagtaggagcggagggggaggaggggaggggaggggaggggagaaagaccaggagggtaggaggagggggaggaggaggagggggccagggctggacttccttccaggggcccaggggagacccagccaggcagccggacacacagggctgggctggtagtcgggtcacacctgaggatgtggaagtgcctggggttcccgggaagtggaggatgtcctgggccactgggagaggcggcacatcccctggggggcggaggtgggggaggtgagaagccaggcaggggccaggaagtggaagcttcaggaggatgtgtgcaggtcaaagtgtaggagtctgcatcttgaatgatgcagagagggcctccaaggctccagtgtgctgcaggtgggcagagggggcatgggaagtaggggttggccctgggcaggggtggggagtgggccaggctgcccagcggggctgagcctagagatggaaggggcagggacaaagatgtgcagctgccagtccttggaaaagctgaacgcctggtacttcagagaacaaaagggtggttctgaaggctgctcccaggacagtggggctccgagggtgcaaccccaaggctcactcctcccagtgcccccaacgcggctcagtcctgtgtctctgcctgtagagtttctttgttccctcttccttcctggtgtttttctctcccgctctccaaatgcataggagaagtaatttgaagtatctccagaaaaaaaaagagaaaaagaaaaagaattgatttcttgtactcctaaatcctaaaagtgtttttctcgttgctagagatattaactccacccaacatgactgcaaagtgtaataagacacattcctttatgcactggaaaatgagaagtcatttcaatcgcaaatttcgctatgagcttcagatacaaaaggtaaactttcaccccgcccccagcccccccacccccgtggacatcccttatttttggtaagtcgcactctggggccttgaaacgggcaacaatctcctctgataacgtcacagaaggcatggatcattaaaaaacaaaaacaaaaacaaaaggccgggcgctgtggctcacgcctgtcatcccagcactttgggaggctgaggcaggtggatcacaaggtcaggagatcgagaccatcctggctaacgcggtgaaaccccgtctctactaaaaatacgaaaaaaaattagctgggcgtggtggcacggtcttgtagttccagctactggggaggccgaggcaggagaattgcttgaacccaggaggtgggggttgcagtgagccgagatcgcgccattgcactccagcctgggcgacagagcgagactccgtctcaaaaaaaaaaaaaaagtttgagactgtatgtggtctgttgttttttatttttattatttctattgttatgtggttttttaattttttcttgaactttcttttttcttttgtagtgatctacagattcaatgcaagcttcccagatatttttgatccacagttcgttggatcagttgaacataaatattgatttatttattgagccactctggctctgtagcccagactggagtgcagtggcttaaatcttgactcactgcaacctctgcctcccgggttcaagtgattctcctgcctcagcctcccgagtagctgggattatgggcacccatcaccacacccagctaagtttttgtatttttagtagaaacagagtttcatcatgttggccaggctggtctcaaactcctgacctcaggtgatccacccgcctcggcctcccaaagtgctgggattacaggtgtgagccttcgtgcgcagcctatgtgttatatttagtttgtattttattttattgtattttattatttatttatttatttttgagacggagtcctgctctgtcacccaagctgtttgtttgtttgtttgtttgtttattatttttgagacggagtcctgctctgttgcccaggctggggtgcagtggcatgatctcagctcactgtaacctccgcctctcgggttcaaccaattctcagcttcagcctcctgagtagctggaattacaggcacctgccaccatgcctggctaatttttttttgtatttttagtagagatggggtttcaccatcttgtcctggctggtcttgaactcctgacctcatgatccacccgcctcagcttcccaaagtgctgggattacaggcgtgaggcactgtgccccgccatatatttattatttatgctcaaatactaattatttcatatgcaatttttctgtaagtctaaatctgctaaaaaacgttaggtctattaatttcttttatattaccaagtgttttttagccaatctgtttgggttttttttttttttaagaaaataaatggctgggtgcagtagcttacgcctgtaatcccagcactttgggaggccgaggcaggacgatcacgaggtcaggagatagagaccatcctggctaacatggtaaaaccccgtctctactaaaaatacaaaaaaaaattagctgggcgtggtggcgggcgcctgtagtcccagctacttgggaggctgaggcaggagaatggcgtaaacccagaaggcggagcttgcagcgagctgagattgtgccactgcactccatcctgggcaacagagtgagactccgtctcaggagaaaaaaaaaaaaagaaaataaatacagcacagacttctttctttcactgatttgagggagcaggcatagctgcagccacaggcagagtcgtagctagtctgatgttgcaccccctacctagttcgctggcctggcataggctgtctgtggctacccctgagtgcatctggacacagtctgggaggacggtgggtcttgtttgtccaccggcctcacaaagccccctcccaccaaggtcttgccacagtggcccataagaaaccttttgggccaggcgcgatggggcatgcctgtaatcccagcactttgggaggccgaggtgggcagatcatgaggtcaagagatcaagaccatcctggccaacatggtgaaactttgtttccactaaaaatacaaaaaattagccaggcgtggtggcacgcacctgtagtcccagctactcgggagactgaggcaaaagaatcacttgaatccgggaggcggaggttgcagtgagccgagatcacgccactgcattccagcctgggtgacggagtgagactccgtctcataaataaataaacaaacaaaccttttggtcaggtgctatttactcctaagctcattattttgcccccactgctgcccgaaggccttcccagagccctcactgttttgctggttttcctggagggagaaatttgagtttgggaggaggaggctttcagggacggtccagacactcaaaagtttgcttgcttttgtgttgcagagaatgcagcctgtaatcacagaacaggtgagtgttccctacccccagccgctgtacttgacattgcaaagggtgagttttattattattaagaataaaatgataaaaaatattaataattcttattaataaaataatgaaaatattattaataataaatgttattattcaatgttcagtgactttcattggacagactcttgagtgtcacccttactgcgatcttgcaaaattgggatatttcacatccccaaattgagggatgggaaaaggaagagtcagggatgacacctcccaaggtgtgagagccagatgctatggctggccaggtgctgtccaaacgaggtccacccatttgccccagattccttaccctgggccaggcagccccagtccagcaggaacaagctaccaaaccatagctccacccagcagagacaagcattcagacaggtggcccagacctcagacagaggaccctcccccagcccctgcctgggatctgcaggaacagacagccggaccacagcattctctgtcccctctctctctgtccatctctttccccgtatctctttctctgtctctgaatctctctgcctttctccctccctctctttctctctctctcgtctctatctccctccccctctctgtatctccctccctttttccctccctctatctttctggctctctccctgtgtctatctctccctgtccccatctctctctgtgtctctttccctccctctctcattctccttccctctctctatctttctctccctgtctctatctcccgctccgtgtctgtctctatctttctccctttctccctccatctctctctccctgtctctctctccccgttcccatctctctctctgtgtctctgtctctccctctctcattctccctccctcttttattctccctccctctctttctctctctctctctctctcctggtctctgtctcccccctccccatctctttctctgtgtctgtctctgtaaccttctccatttctccctccatctctctgtctctccctgtgtctatctcccactgtccctgtctgtttctccgtgtctgtctctgtatctctctccctttctccctccatctttctctctctcccccggtctctatcttcccttctccccatctctctctctctgtctgtctctgtatctctctccctttctccctccatctttctctctctctcccggtctctatctccccctctccccgtctctttctccgtgtctgtctctgtgtctctctccctttctccctccctccatctttctctctctctcccggtctctatttcctccctccccatctctttctctgtgtctgtctctgtatctctctccctttctccctccatctttctctctctctcctggtctctatctccccctctccctgtctctctgtgtctgtctctgtatctctctccctttctccctccctctctttatctctctctctctctctgcctctatctcccactgtccaaatctgtgtctctgtctctccctctttcattctccctctctttctctatctctctccttgtctatatctccccctctcccagtctctctgtatctctgtatctctctccctttctccttccctctcttcatctttctttttgaaacggagtttttctcttgttgcccaggctggagtgcgatggcacgatctcggctcactgcaacctccgcctcccaggttcaagcgaatctactccctcagcctcccaagtagctgggattacaggcactcgccaccatgcccaactaacttttttttttttttgtatttttagtagagacagggtttcactagtgggccaggctggtctcgaactcctgacctcaggcgatccacctgcctcatcctctcaaagtgctggaattacaggtgtgagccaccgtgcccggcccctctctttatctttctagctctctccctgtctctctctcccttcccctctctgtctctctctcccttcccctctctgtctctctctcccttcccctctctgtctctctctcccttcccctctgtctctctctcccttcccctctctgtctctctctcccttcccctctctgtctctctctcccttcccctctgtctctctctcccttcccctctctgtctctctctcccttcccctctctgtctctctctcccttcccctctctgtctctctctcccttcccctctctgtctctctctcccttcccctctctgtctctctctccctttccttctctgtctctctctcccttcccctctctctctctccattcccctgtctctatgtctctccctttctctctcccattatttctctgtgattgtctctttctttctctgcctctgtctgtctgtccccctgtattagtccattgtcacactgctgataaacatatacccaagactgggtaatttataaacaaaagagggttcctggactcacagttccatgtggctggggaggcctcacgatcacggcagaaggtgaaggaggaggaaaggcatgtcttacatgtcagcgggcaagacagaatgagacagtcgccgggcgcagtgactcatgcctgtaatcacagcaccttgggaggacgaggtgggtggaccacgaggtcaggagttcaagaccagcctggccaacatggtgaaacctagctctactaaaaataaaaaaaattacccagacgtggtggtggcaggcgcctgtggtcccagctactcgggaggctgaagcaggagaatcgcttgaacccgggaggcagaggttgcagtgagttgagatcgcgccactgcactccagcctgggtgacagagtgagactccgtctcgagaaaaaaaaaaaaaaaaaaaaaatgagagccgagagaaaggtttcccttattaaaccattagatctcgtgagacttattcactaccccgagaacagtgtggggggaaactgcccccatgattcagttatgtcctacccagtccctctcacaacacgtgggagttataagggctacaattcaagatgagatttgggtggggacacagccaaactacatcacccactctctctgtctctctgcttctgttttcctctctgtctctgtttttctttccctctctctgtctctttgtatctctgtctctctctctctgtctccgtttctatctctgtctctctctgtccatcacccactctgtctctttgtctctctatgtctctctgtttctgtttttctgtttttctctttccctctctctttgtatctatgtctttctgtctctccgtttctgtctctctctctgtccatcacccactctgtctgtctttgtctatgtctctctgtttttctgtctctttttctctttccctctctgtctcccctctctgtgtctctttgtatctccgtctctccctgtctgtttctatctctgtctctctctgtccatcacctactctgtctctttgtctctgtctgtttctgtttttctttctttttccctctgtctcccttctctgtgtctctttgtatctctgtctctctctgtttctatctgtctctctctgtccatcacccactatctctgtctatgtctgtttttctgtctctgtttttctctctccctctctctgtctcccctctctgtgtctctttgtatctctttctctctctctgtctctccctgtctgtttctatctccgtcctcctgtattagtccattttcatggactaatgaggatccttcccgcttctcccagctcctggggactctggggtccctgggcttgtggccatatcactccactctctgcctccgtctccacatggccttctcctctgcatccgtgtctcctttttatttatttatttatttattttgagacagagtctcgctctgtcacccaggctggagtgcagtggtgcgatctcagctcactgcaacctccgcctcccaggttcaagcgattcccctgcctcagcctcccgagtagctgggactacaggtgcacaccaccacgcctggctaatttttgtattattagtaaagatgggattttaccttgttgctcaggttgacctcgaactcctgacctcaggtgatctacccacctcagcctcccaaagtgctgggattacaggtgtcagccaccgcgcccggccacgtctcctcttcttataaggatattggtcattgcatttagggccccccctgatccaaaatgacatcatctcaatctatatcttaacgacatctgccatgaacaggtatttcatcataaggccccattgtaaggtgctgggggctaagactgcaacatatgaattttgggggatcacaatgcagcctcattcttttgtacccatcaaatatgaatggtcttttcttcttttttttttttttttgagacggagtctcgctctgtcacccaggctggagtgcagtggcgcaatctcggctcactgcaagctccgcctcccgggttcccgccactctcctgcctcagcctcctgagtagctgggacctcaggcgcccgccaccgggcccggctaattttttgtatttttagtagagacggggtttcactgtggtctcgatctcctgaccttgtgatctgcccgccttggccctccaaagtgctgggattacaggcgtgagccaccgcgcctggccgagctatttcatcataaggccccactgtaaggagctgggggctaagactgcaacatatgaattttgggggatcacaatgcagactcattcttttgtacccatcaaatatgaatggtcttttcttctacttttttgtttggtttttaatttcagacaggctctcactctgtcacccacgctagagtgcagtggcacagtcacggctcactgcaatctctgcctcctgggctcaagggatcctcctgcctcagccccccaagtagctgaaactacaggcgtttgccaccaggtcagctcatttaaaaaaaaatttggctgggcgcggtggctcacgctggtaatcccagccctttgggaggccgaggcgggtggatcatgaggtcaggaaatcaagaccatcctggctaacatggtgaaaccctgtctctactaaaaaaaaaaatacaaaaaattagctgggcatggtagcgggtgcctgtagtcccagctactcgggaggctgaggcaggagaatggcatgaacccgggaagcggagcttgcagtgagccgagatcacgccactgcactccagcctgggggacagagtgagactccatctcaaaaaaaaaaaaatttttttttggctggacgtggtggctcacactggtaatcccagcactttgggaggctgaggcgggtggatcaccggaggttgggagttcgagaccagcctgaccaacatggagaaaccccgactctactaaaaatacaaaattaaccgagcgtggtggtgggcgcctgtaatcccagctactcgggaggctgaggcaggagaatcgcttgaatctgggaggcggaggttgcggtgagccgagttggtgccactgcactccagcctgggcaacaagagtgaaactctgtctcaaaacaaaacaaaacaaattttcttctagagatggggtcttggtttgttgcccaggctggtctcaaactcctaagctcgaggtatccccccacctcagcctccctggtagctgggaccaaagacatgtgtcaccacgtctggtaatttttacagttttttttttttggtaaagatggggtcttgctatgttgcccaggctggtgtcaaactcctgggcttaaggaattctcccacctcagcctccaaaagtgctgtggtgagaggcataaaccgtagcacccagcccctcttttcttcttttatttatttatttatttatttatttatttatttagagacagagtctcactctgttgcccaggctgcagtgcagtggtgccatctcgcctcactgcaacctccacctctcaggtttaagctattctcctgcctcagcctcctgagtagctgggattacaggtgcctgccaccatgccaggctaatttttgtatttttagtagagacagggtttcaccatgttggccaggctggtctcgaactcctgacctcaggtgatccacctgccttggcctccctaagtgcccaggtgagagtcatgagccaccatacctggcccctcttctttattttctttcaaaccacaggtcagagacagaacctccttccagctactcaatcctggaacgtacacagtacaaataagagcccgggaaagagtgtatgaattcttgagcgcctggagcaccccccagcgcttcggtgagtgggctgtgcggggtgcgcggggtgagcggggtgagcggggtgcgcggggtgagcggggtgcgcggggtgagcggggtgcgcggggtgagcggggtgagcggggtgagccgggtgcgcggggtgagccggctgcgcggggtgagcggggtgagcggggtgagcggggtgagcggggtgcgcggggtgagcggggtgagcggggtgcgcggggtgagcggggtgagccgggtgcgcggggtgagccgggtgagcggggtgcgcggggtgagcggggtgagcggggtgcgcggggtgagccgggtgcgcggggtgagcggggtgagccgggtgcgcggggtgagcggggtgagcggggtgagccgggtgagccgggtgagccgggtgcgcggggtgagccgggtgcgcggggtgagcggggtgcgcggggtgagcggggtgcgcggggtgagccgggtgcgcggggtgagcggggtgcgcggggtgagcggggtgcgcggggtgagccgggtgcgcggggtgagcggggtgagcggggtgagccgggtgccccgggtgagcggggtgcgcggggtgagccgggtgcgcggggtgagcggggtgagcggggtgcgcggggtgagccgggtgcgcggggtgagccgggtgcgcggggtgagccgggtgagcggggtgagcggggtgcggggtgcgcggtgcgcggggtgagcggggtgcgcggggtgagccgggtgcgcggggtgagcggggtgagccgggtgccccgggtgagcggggtgcgcggggtgagccgggtgcgcggggtgagcggggtgcgcggggtgagcggggtgcgcggggtgcgcggcgtgagccgggtgcgcggggtgcgcggggtgagcggggtgcgcggggtgcgcggggtgcgcggggtgagcggggtgcgcggggtgcgcggcgtgagccgggtgcgcggggtgagcggggtgcgcggggtgagcggggtgcgcggggtgagccgggtgcgcggggtgagccgggtgagccgggtgcgcggggtgagcggggtgcgcggggtgagccgggtgagccgggtgcgcggggtgagccgggtgcgcggggtgagcggggtgcgcggggtgagccgggtgcgcggggtgagcggggtgcgcggggtgagcggggtgcgcggggtgagcggggtgcgcggggtgagccgggtgcgcggggtgagcggggtgagcggggtgagccgggtgccccgggtgagcggggtgcgcggggtgagcccggtgagccgggtgcgcggggtgagccgggtgcgcggggtgagccgggtgagcggggtgagcggggtgcgcggtgcgcggggtgagcggggtgcgcggggtgagccgggtgcgcggggtgagcggggtgagccgggtgccccgggtgagcggggtgcgcggggtgagccgggtgcgcggggtgagcggggtgcgcggagtgagcggggtgcgcggggtgcgcggcgtgagccgggtgcgcggggtgcgcggggtgagcggggtgcgcggggtgcgcggggtgcgcggggtgagcggggtgcgcggggtgcgcggcgtgagccgggtgcgcggggtgagcggggtgcgcggggtgagcggggtgcgcggggtgagccgggtgcgcggggtgagcggggtgcgcggggtgagccgggtgcgcggggtgcgcggggtgcgcggggtgcgccgggtgcgcggggtgagccgggtgcgcggggtgagcggggtgcgcggggtgcgcggggtgcgcggggtgagccgggtgcgcggggtgagcggggtgagccgggtgcgcggggtgagcggggtgagccgggtgcgcggggtgagcggggtgcgcggggtgagccgggtgcgcggggtgagcggggtgcgcggggtgagccgggtgcgcggggtgagcggggtgcgccgggtgagcggggtgagcggggtgagccgggtgcgcggggtgcgcggggtgcgccgggtgcgcggggtgagccgggtgcgcggggtgagcggggtgcgcggggtgcgcggggtgcgcggggtgagccgggtgcgcggggtgagcggggtgagccgggtgagcggggtgcgcggggtgagccgggtgcgcggggtgagcggggtgcgcggggtgagccgggtgcgcggggtgcgcggggtgagccgggtgcgcggggtgagcggggtgcgcggggtgagcggggtgcgcggggtgagccgggtgcgcggggtgagccgggtgcgcggggtgcgcggggtgcgcggcgtgagccgggtgcgcggggtgcgccgggtgcgcggggtgagcggggtgagccgggtgcgcggggtgagcggggtgcgcggggtgagcggggtgcgccgggtgagccgggtgcgcggggtgagccgggtgcgcggggtgagcggggtgcgcggggtgagccgggtgcgcggggtgagcggggtgcgccgggtgagcggggtgcgcggggtgagcggggtgcgccgggtgagcggggtgcgcgggctgagcggggtgcgccgggtgagcggggtgcgcggggtgagcggggtgcgccatcctgggtcacggaaacactcctctcctgcaaaggagaggagattcactcccccagtttctgtgaccccaaaaaggaccctgaacccgacggtgaactcacagcttgctcttactcacgagaggagacgtggaggggaaacaaggtcgtcccactgacagacaccccctgggccttgtaataaagaccgaggcgggcggatcacaaggtcaggagatcgagaccatcccggctaacacggtgaaacccggtctctacaaaaaatgtaacaaattagccaggcgtggtgatgggcgcctgtagtcccagctactcgggaggctgaggcaggagaatggcgtgaacccgggaggcggaggttgcagtgagccgagatcgcgccactgtgctccatccagcctgggcgacaagagcgagactccatctcaacaacaaaacaaaaggatcgcctcagagtagaacttctggccgggcacggtgactcatgcctgccatcccagcactttgggaggctgaggtgggtagatcacctgaggtcaggagttcgagaccagcctgaccaacatggaaaaaccctgtctctactaaaaatagaaaaattaggtcaggtgctgtggcttaagcctgtaacctcagctaccagggaggctgaggcaggagaatcgcttgaattgtgttccctcaaaattcgtgtgttgaagctttgatcccccaggacctcagaatgtgactgtgtttggagttggggtgtttaaagaggcgattaaggtaaaatgaggtcattagggtgggccctaatctaacaggactggggtccttataagaagaggagatgaggacacagacacacacagagggacgaccctgtgggacacagggagaagacggcgtctccaagcccaggagaggggcctcaggaggaaccagcactgcccacacctggatctcagacctccagcctccagggctgtgggagaatcaatgtgttttgtttctaagccgcccagcctctggtattctgtgacagcagcctgagatggactaagccatctcataagaagagacgaggacacagacacacacagagggacgaccctgtgagggcacagggagaagacggcgtctccaagcccaggagaggggcctcaggaggaaccagcactgcccacacctggatctcagacctccagcctccagggctgtgggagaatcaatgtgttttgtttctaagccgcccagcctctggtattctgtgacagcagcctgagatggactaagacatctcataagaagaggagatgaggacacagacacacacagagggacgaccctgtgagggcacagggagaagacggcgtctccaagcccaggagaggggcctcaggaggaaccagccctgcccacacctggatctcagacctccagcctccagggctgtgggagaatcaatgtgttttgtttctaagccgcccagcctctggtattctgtgacagcagcctgagatggactaagacatctcataagaagaggagatgaggacacagacacacacagagggacgaccctgtgagggcacagggagaagacggcgtctccaagcccaggagaggggcctcaggaggaaccagcactgcccacacctggatctcagacctccagcctccagggctgtgggagaatcaatgtgttttgtttctaagccgcccagcctctggtattctgtgacagcagcctgagatggactaagccatctcataagaagagacgaggacacagacacacacagagggatgaccctgtgagggcacagggagaagacggcgtctccaagcccaggagaggggcctcaggaggaaccagcactgcccacacctggatctcagacctccagcctccagggctgtgggagaatcaatgtgttttgtttctaagccgcccagcctctggtattctgtgacagcagcctgagatggactaagacatctcataagaagaggagatgaggacacagacacacacagagggatgaccctgtgagggcacagggagaagacggcgtctccaagcccaggagaggggcctcaggaggaaccagccctgcccacacctggatctcagacctccagcctccagggctgtgggagaatcaatgtgttttgtttctaagccgcccagcctctggtattctgtgacagcagcctgagatggactaagccatctcataagaagagacgaggacacagacacacacagagggacgaccctgtgaggacacagggagaagacggcgtctccaagcccaggagaggggcctcaggaggaaccagcactgcccacacctggatctcagacctccagcctccagggctgtgggagaatcagtgttttgtttctaagccgcccagcctctggtattctgtgacagcagcctgagatggactaagccatctcataagaagagacgaggacacagacacacacagagggacgaccctgtgagggcacagggagaagacggcgtctccaagcccaggagaggggcctcaggaggaaccagccctgcccacacctggatctcagacctccagcctccagggctgtgggagaatcaatgtgttttgtttctaagccgcccagcctctggtattctgtgacagcagcctgagatggagtaagacatctcataagaagaggagatgaggacacagacacacacagagggacgaccctgtgggacacagggagaagacggggtctccaagcccaggagaggggcctcaggaggaaccagccctgcccacacctggatctcagacctccagcctccagggctgtgggagaatcaatgtgttttgtttctaagccgcccagcctctggtattctgtgacagcagcctgagatggactaagccatctcataagaagagacgaggacacagacacacagagagggacgaccctgtgaggacacagggagaagacggcatctccaagcccaggagaggggcctcaggaggaaccagcactgcccacacctggatctcagacctccagcctccagggctgtgggagaatcaatgtgttttgtttctaagccgcccagcctctggtattctgtgacagcagcctgagatggactaagacatctcataagaagaggagatgaggacacagacacacacagagggacgaccctgtgaggacacagggagaagacggcgtctccaagcccaggagaggggcctcaggaggaaccagccctgcccacacctggatctcagacctccagcctccagggctgtgggagaatcaatgtgttttgtttctaagccgcccagcctctggtattctgtgacagcagcctgagatggactaagccatctcataagaagagacgaggacacagacacacacagagggacgaccctgtgagggcacagggagaagacggcgtctccaagcccaggagaggggcctcaggaggaaccagccctgcccacacctggatctcagacctccagcctccagggctgtgggagaatcaatgtgttttgtttctaagccgcccagcctctggtattctgtgacagcagcctgagatggactaagccatctcataagaagagacgaggacacagacacacacagagggacgaccctgtgagggcacagggagaagacggcgtctccaagcccaggagaggggcctcaggaggaaccagccctgcccacacctggatctcagaactccagcctccagggctgtgggagaatcaatgtgttttgtttctaagccgcccagcctctggtattctgtgacagcagcctgagatggactaagacatctcataagaagaggacatgaggacacagacacacacagagggacgaccctgtgggacacagggagaagacggggtctccaagcccaggagaggggcctcaggaggaaccagccctgcccacacctggatctcagacctccagcctccagggctgtgggagaatcaatgtgttttgtttctaagccgcccagcctctggtattctgtgacagcagcctgagatggactaagacatctcataagaagaggagatgaggacacagacacacacagagggacgaccctgtgggacacagggagaagacggggtctccaagcccaggagaggggcctcaggaggaaccagccctgcccacacctggatctcagaactccagcctccagggctgtgggagaatcaatgtgttttgtttctaagccgcccagcctctggtattctgtgacagcagcctgagatggactaagacatctcataagaagaggagatgaggacacagacacacacagagggacgaccctgtgaggacacagggagaagacggcgtctccaagcccaggagaggggcctcaggaggaaccagccctgcccacacctggatctcagacctccagcctccagggctgtgggagaatcaatgtgttttgtttctaagccgcccagcctctggtattctgtgacagcagcctgagatggactaagccatctcataagaagagacgaggacacagacacacacagagggacgaccctgtgagggcacagggagaagacggcgtctccaagcccaggagaggggcctcaggaggaaccagccctgcccacacctggatctcagacctccagcctccagggctgtgggagaatcaatgtgttttgtttctaagccgcccagcctctggtattctgtgacagcagcctgagatggactaagccatctcataagaagagacgaggacacagacacacacagagggacgaccctgtgagggcacagggagaagacggcgtctccaagcccaggagaggggcctcaggaggaaccagccctgcccacacctggatctcagaactccagcctccagggctgtgggagaatcaatgtgttttgtttctaagccgcccagcctctggtattctgtgacagcagcctgagatggactaagacatctcataagaagaggacatgaggacacagacacacacagagggacgaccctgtgggacacagggagaagacggggtctccaagcccaggagaggggcctcaggaggaaccagccctgcccacacctggatctcagacctccagcctccagggctgtgggagaatcaatgtgttttgtttctaagccgcccagcctctggtattctgtgacagcagcctgagatggactaagacatctcataagaagaggagatgaggacacagacacacacagagggacgaccctgtgggacacagggagaagacggggtctccaagcccaggagaggggcctcaggaggaaccagccctgcccacacctggatctcagaactccagcctccagggctgtgggagaatcaatgtgttttgtttctaagccgcccagcctctggtattctgtgacagcagcctgagatggactaagacatctcataagaagaggacatgaggacacagacacacacagagggacgaccctgtgggacacagaagacggggtctccaagcccaggagaggggcctcaggaggaaccagccctgcccacacctggatctcagacctccagcctccagggctgtgggagaatcaatgtgttttgtttctaagccgcccagcctctggtattctgtgacagcagcctgagatggactaagacatctcataagaagaggacatgaggacacagacacacacagagggacgaccctgtgagggcacagggagaagacggcgtctccaagcccaggagagaggcctcaggaggaaccagccttgcccacacctggatctcagacctccagcctccagggctgtgggagaatcaatgtgttttgtttctaagccgcccagcctctggtattctgtgacagcagcctgagatggactaagacacctcataagaagaggagatgaggacacagacacacacggaggaacaaccctgtgaggacacagggagaagacggcatctccaagcccaggagagaggcctcaggaggaaccagccctgcccacacctggatctcagacctccagcctccagggctgtgggagaatcaatgtgttttgtttctaagccgcccagcctctggtattctgtgacagcagcctgaaacggactaagacatcccataaaaaggagatgaggacacagacacacacggagggacgaccctgtgggacacagggagaagacggcgtctccaagcccaggagaggggcctcaggaggaaccagcactgcccacacctggatctcagacctccagcctccagggctgtgggagaatcaatgtgttttgtttctaagccgcccagcctctggtattctgtgacagcagcctgagatggactaagccatctcataagaagagacgaggacacagacacacacagagggatgaccctgtgagggcacagggagaagacggcgtctccaagcccaggagaggggcctcaggaggaaccagcactgcccacacctggatctcagacctccagcctccagggctgtgggagaatcaatgtgttttgtttctaagccgcccagcctctggtattctgtgacagcagcctgagatggactaagacatctcataagaagaggagatgaggacacagacacacacagagggacgaccctgtgagggcacagggagaagacggcgtctccaagcccaggagaggggcctcaggaggaaccagccctgcccacacctggatctcagacctccagcctccagggctgtgggagaatcaatgtgttttgtttctaagccgcccagcctctggtattctgtgacagcagcctgagatggactaagccatctcataagaagagacgaggacacagacacacacagagggacgaccctgtgaggacacagggagaagacggcgtctccaagcccaggagaggggcctcaggaggaaccagcactgcccacacctggatctcagacctccagcctccagggctgtgggagaatcaatgtgttttgtttctaagccgcccagcctctggtattctgtgacagcagcctgagatggactaagccatctcataagaagagacgaggacacagacacacacagagggacgaccctgtgagggcacagggagaagacggcgtctccaagcccaggagaggggcctcaggaggaaccagccctgcccacacctggatctcagacctccagcctccagggctgtgggagaatcaatgtgttttgtttctaagccgcccagcctctggtattctgtgacagcagcctgagatggagtaagacatctcataagaagaggagatgaggacacagacacacacagagggacgaccctgtgggacacagggagaagacggggtctccaagcccaggagaggggcctcaggaggaaccagccctgcccacacctggatctcagacctccagcctccagggctgtgggagaatcaatgtgttttgtttctaagccgcccagcctctggtattctgtgacagcagcctgagatggactaagccatctcataagaagagacgaggacacagacacacacagagggacgaccctgtgagggcacagggagaagacggcgtctccaagcccaggagaggggcctcaggaggaaccagccctgcccacacctggatctcagacctccagcctccagggctgtgggagaatcaatgtgttttgtttctaagccgcccagcctctggtattctgtgacagcagcctgagatggactaagacatctcataagaagaggacatgaggacacagacacacacagagggacgaccctgtgggacacagggagaagacggggtctccaagcccaggagaggggcctcaggaggaaccagccctgcccacacctggatctcagacctccagcctccagggctgtgggagaatcaatgtgttttgtttctaagccgcccagcctctggtattctgtgacagcagcctgagatggactaagacatctcataagaagaggagatgaggacacagacacacacagagggacgaccctgtgggacacagggagaagacggggtctccaagcccaggagaggggcctcaggaggaaccagccctgcccacacctggatctcagacctccagcctccagggctgtgggagaatcaatgtgttttgtttctaagccgcccagcctctggtattctgtgacagcagcctgagatggactaagacatctcataagaagaggacatgaggacacagacacacacagagggacgaccctgtgggacacagaagacggggtctccaagcccaggagaggggcctcaggaggaaccagccctgcccacacctggatctcagacctccagcctccagggctgtgggagaatcaatgtgttttgtttccaagccgcccagcctctggtattctgtgacagcagcctgagatggactaagacatctcataagaagaggacatgaggacacagacacacacagagggacgaccctgtgagggcacagggagaagacggcgtctccaagcccaggagagaggcctcaggaggaaccagccttgcccacacctggatctcagacctccagcctccagggctgtgggagaatcaatgtgttttgtttctaagccgcccagcctctggtattctgtgacagcagcctgagatggactaagacacctcataagaagaggagatgaggacacagacacacacggaggaacaaccctgtgaggacacagggagaagacggcgtctccaagcccaggagagaggcctcaggaggaaccagccctgcccacacctggatctcagacctccagcctccagggctgtgggagaatcaatgtgttttgtttctaagccgcccagcctctggtattctgtgacagcagcctgaaacggactaagacatcccataaaaaggagatgaggacacagacacacacggagggacgaccctgtgggacacagggagaagacggcgtctccaagcccaggagaggggcctcaggaggaaccagccctgcccacacctggatctcagacctccagcctccagggctgtgggagaatcaatgtgttttgtttctaagccgcccagcctctggtattctgtgacagcagcctgagatggactaagacatctcataagaagaggagatgaggacacagacacacaccaagggacaaccctgtgggacacggagaagacggggtctccaagcccaggagagaggcctcaggaggaaccagccctgcccatgcccatctcttgatcttggacctgcagcttccaggactgtgggagaatcaattccttttttctttttcttttttcttttttttcctctttttctgagatggagtctcactctgtcgccaggctggagtgcagtggcgtgatcttggctcactgcaacctccacctcgcaggttcaggccattctcctgcctcagccttctgagtagctgggatgacaggcgcccgccaccacacccggctactgtttgtatttttattagagacgggctttctggccatgttggccaggctggtctcatactcccgacctcaggtgatccgcccgccttggcctcccaaagcgctgggattacaggcgtgagccaccgcgcccggccaaattccttttttctgaagccaccaagctgtgggacttttttatggcagtcccagcagacagatccaccctcgttccaaataaggttatcgtcataggttctgggggtgaggtcatagatgtatgtttttttttttttttggagagagagtctctctctattgcccaggctggagggcagtggcgcgatcacggctcactgtagcctcgacctcctgggctcaagcgatcctctcgggaggctaagagaggagaatcgtttgaatccgggaggcagaggttgcagtgagctgagatagcaccacagcactgcagagcgagactctgtctcaaaaaaaaaaaaaagaaaaaagaaaaaaaataggccgggtgcgtggctgacgcctgtaatcccagcactttgggaggccgaggcgggtggatcacttgaggtcaggagttcaagaccagcctaacgaagatggtgaaaccccatctctatgagaaatacaaaaattacccgggcgtggtggcgggcgcctgtagtcccagctactcgggaggcaggggcaggagaatcgcttgaacctgggaggtggaggttgtgagctgagatcgtgccactgcactccagcctgggcgacaaaacgagactccatctcaaaaaaaaaaaaaaaagaaaaagaaaaagaaaaaattaacacacacacacaaattccatgataaacacaaaatcaagttcaaagcacgcacgccagtgctgcctctgctgcccctccatgctgcccacacccaaagcacctgccggcctgctgggcacagtggaagtccctggcgctccccgtgtcccgagcaccaggcagacagggatccctggtggtctttccgctcccttagggttccagactggggctgggaggtccggaagtcgctcccggtcctggtactcaggtggcctgcaggtggcccgcaggtggtcacggtctctgtgcaggtggcactactggggtgtccccccctggacgccaccccatatggcagccacctctctgcttcccagggccccggggagagcttacagtccctggtccccccaggacggcccccggtctgtgaccctctcaccctttacccctagagtgcgaccaggaggagggcgcaaacacacgtgcctggcggacgtcgctgctgatcgcgctggggacgctgctggccctggtctgtgtcttcgtgatctgcagaaggtgagccctcgagggcgtccgcgagcgtcgcttgtttccagtgtgaccctgaaagttattcacagaaccatcctgagaattatcattattatttttgtgatggagtctcgctctgtctcccaggctggagtgcagtggcacgatctgggctcactgcagcctctgcctcctgggttcaggcgatcctcctgcctcagcctcccaagtagctgggattacaggcacccagcaacacacccagctaatttttgtatttttagtagagacggggttttgccatgttggccaggctggtcttgaattcctggactcaggtgatccacctgcctcagcctcctaaagtgctgggattacaggcgtaagccacctcgcctggcccatattattattattgttatgattattattattttttgagtcttgctctgtcacccaggctggagtgcagtggctcgatctcggctcaccgcagcctccacctcccgggttcaagtgattctcctgcctcagcctcccgagtagctgggattacaggtgtgcaacactgcacccaactaattcttgtatttttagtggagacggggtttcaccatgttggccacactggtgttgaactcctggcctcaagtgatcccccagcctcggcctcccaaagtgctgggattacaggcgtgagccaccgcacctggccccttgagaattattcacaaaagaccaggggccaggtcctctctgctagctgccccctgccaggaggtctgtagagccaaagctgagggctctggtgggaccaagggtgtccccagggtggaggaagcagggccggtcctcccctgccctgcccagcgggcctgacacagtcagagggcgaaaggccaggctttctggtcgggaaggggcctgggcgaacgtcacagctgtccacttggatgggccaggatccgtcatgcagaccaactcgaggtttttggtcaccagctgggtcaccccaggtcctgtctccttttttttagagaaggagttttgcttttgttgcccagcctggagtgcaatggcgccatctcggttcactgcaacctctgcctcctgggttcaagcgattctcctgcctcagcctccctgagtagctgggattacaaggatgtgccaccacgcctggctaattttgtatttttagtagagatggggtttctccgtgttggtcaggctggtcttgaactcctgacctcatgtgatccacccgcctcggcctcccaaagtgctgggatgacaggcgtgagccaccatgcccggataattttgtattttcagtagagacggagtttctccgtgttgatcaggctggtcttgaactcctcacctcagttgatctgcccgcctgggcctcccaaagtgctgggatgacaggcgtgtgccaccatgcccagataattttgtatttttagtagagatggagtttctccatgttggtcaggctgttctcgaactcctgacctcagttgatctgcccgcctgggcctcccaaagtgctggcattacaggcttgagccaccatgaccagccaggccctgtttccttcctgctgggcatcagagcttcacaatctgtcaaatgggtgccatggtgacttctgtctcccgggggaagggggaaaaggggagggggagggggaaggggaagaggggggaggaggggggaagggaggagggggaagggaggggggaaaggagggggaagggaggagggggaagggaagagggggaggagggggaaggggaggaggaggagggggaggagaggcgagggggagggtgggggagggggaagggggaggaggagaggggaggatgagtggggagggggaaggagggagagggggagggggagagggaggggtaggggggaaggggtggaggagggaggaaaagggggaggaagagggggacgaggcccttcctgcaagctgtctcaggtcgtaaactcagtgacctgaggcaccaggggtctgtctttgcagctgcacccctgggtggctccggtaccagcgccctactcctttaattagacaccagcgcctgcctatgatgatggtcgggggcgtgtcagggcctcaggggccgggaaaatagagacccctcgagtagatgacttgagtcttttgctctgtcctggcactgtctgtcctggacacgctgtgtcccagatgatgagctggtcggttttgggttcagagctgggccatttctctttcctccgaggtatctggtgatgcagagactctttccccgcatccctcacatgaaagaccccatcggtgacagcttccaaaacgacaagctggtatgttgttttttctgccttgggacgggtctggaggcgtggtggccactttgggaggcccaggcgggcggaccacttgaggccaggaactggagaccagcctggccaacatggagaaactccgtgtctactaaaaatacaaaattagccgggtgtggtggcgggcgcctgtaatcccagctactcgggaggctgagggaggaggatcacttgaacccgggaggtggaggctgcagtgaactacgatcgagccactgcactccatctgggcgacaagagtgaaatggcctggactaggaggctggacacctgtctgctggcgctggtgggcggctgggaaaagctgcaggatgaagggagtggggggacactgggctcccagcccaccgtgatcacgggccgtctccgcaccctgcacaccagagcagagcagatttttttttttttttttagatggagttttgctcttgttgcccaggctagagtgcaatggtgcgatcttggctcaccacaacctccaccttcccagtccaaggttcaagcgattgtcctgcctcagcctcccgagtagctgggactacaggcacgcaccgacacgcccagctaattttgtatttttagtagagacggggtttcaccatgttggccaggatggtctcgatctcctgaccttgtgatccccctgcctcggcctcccaaagtgctgggattacaggcatgagccaccatgcccagcctagttttcaacaagtttttagtgatacctgtgtccctaagagaaaggaagggcagaggaaaaggaggcagacatctctgtcagagttttttgttttgttttgttttgtttgtttttgtttttgagacgcagttttgttcgttgccccggctggagtgcaatggtgcaatctcggctcactgcaacctccaccttcccggttgaaggttcaagcgattctcctgcctcagcctcccaagtagctgggactacaggcatgcaccaacacacccagctaattctgcatttttagtagagaaggggtttcaccatgttggccaggatggtctggatctcctgaccttatggtccgctcgcctcggcctcccaaagtgctgggattacaggtgtgacccaccgcgcctggcccaaagtgctgggatgacaggcgtgagacaccatgcctggcccacagagcagatctgagatgggacaggcccccgcagatcaggacgtgggctctgttatctggggggtggccgactcaccctgcctcctctcgtctctgcaggtggtctgggaggcgggcaaagccggcctggaggagtgtctggtgactgaagtacaggtcgtgcagaaaacttga

SEQ ID NO: 2877 - DNA, 46069 bp, human
tcaggttcatggttacgaagctgctgaccccaggatcccagcccgtgggagagaagggggtctctgacagcccccacccctccccactgccagatccttattgggtctgagtttcaggggtggggccccagctggaggttataaaacagctcaatcggggagtacaaccttcggtttctcttcggggaaagctgctttcagcgcacacgggaagatatcagaaacatcctaggatcaggacaccccagatcttctcaactggaaccacgaaggctgtttcttccacacagtactttgatctccatttaaggtaaggtcccccctccagggtgggatgagggaaaaagagggcaggcaggggaggcggtggactgtgggttcccaaatccaagctggcagacacggggcattggcatgtaacaggtttctgctgagacctgctgtccgtgtgggcaccacaccacacatagaatgacccggtaccagagaagtatgtttgcgatctcattcacccttttgtaagtggatcggacgctgaagccatcatagcatgttagatgccttgggtttataaaggtgatagcattaggagtaatttgacagtgctttctgctttttctgtgtgcttgctagaaaatgtacacacctacacatggctagagttctctgtttattagaaagcgctggttcagttagtcaatgagctcacgcccagggcgagctgactgccagccggggagccgcttttggggctgggaccccagcctgcttgtagtgtttctcagtggttttcaaaggctggcgggactcagaatgttccagatggctggtgaaacctcaggtccctcctagcagctttattcacagtagccaagaggtggagacagccctcgtacccatctatagatgaatggaaaaatataatgtccatccacacagtggaatattacgcagccatgaaaaggaacaagcagctttattcacaatagccaagaggtggagacagccctcatacccatctatagacgaatggataaatataatgtggtccagccacacggtggaatattacacagccatgaaaaggaacaagcagctttattcacaatagccaagaggtggagacagccctcatacccatctatagacgaatggataaatataatgtggtccagccacacagtggaatattacacagccatgaaaaggaacaagcagctttattcacaatagccaagaggtggagacagccctcatacccatctatagatgaatggagaaatataatgtggtccagccacacagtggaatattatacagccatgaaaaggaacaagcagctttattcacaatagccaagaggtggagacagccctcgtacccatctatagatgaatggagaaatataatgtggtccagacacacagtggaatattatacagccatgaaaaggaacaagcagctttattcacaatagccaagaggtggagacagccctcatacccccatctatagatgaagggagaaatataatgtccatccacacagtggaatattacacagccatgaaaaggaacaagcagctttattcacaatagccaagaggtggagacagccctcatacccatctatagatgaatggaaaaatataatgtccatccacacagtggaatattacacagccatgaaaaggaacaagcagctttattcacaatagccaagaggtggagacagccctcataccccatctatagatgaatggagaaatataatgtggtccagccacacggtggaatattacacagccatgaaaaggaataagcagctttattcacactagccaagaggtggagagagtcctcatacccatctatagatgaatggagaaatataatgtggtccagccacacggtggaatattacacagccatgaaaaggaacgaggctctgccacaggtggcaatgtgggtgaatgctgaggacatcatgcttcctgagagaggccagatacaaaaagatacatagtgtctgtatgattccatttattccctatgtccagatacaggcaaatccacagagacagaaagtggatgagtggttgccacaggctggggaagaggaaggacgggtctttaatgggtctggagtctccttttggggtcgtgacaatgttctagaagatagaagtggtggttttttttgagacagagtctcgctctgtcgcccaggctggagtgcagtggcgcgatctcagctcactgcaacctccacctcccgggttcaagcaattctcctgcctcagcctcctgagtagctgggactacaggcacccgcaactacgcctggctaatttttgtatgtttagtagagactttgtatgtttagtagagtagtagagattttgtatgtttagtatgttttgtatgttggtcaggctggtctcgaactcctgacctcaagcaatccacccccctcagcctcccaaagtgctgggattataggcgtgagccaccgcgcctggccaatgaaaatattaatcaataaatgttaagagcacagatttcccaacgttctgactcaggcatcttcctggaccacagcccctacaggcaagtgtgactgtgtgtggtgagcccatgagctgaacacaggctctgtccgaaaggagactctagagattgcctgttgccttggaggtgggctgcggtccctctgcccaggcaggaaggggctccgaggcctctggaacctcattttaccttttccctgctgccctcagtcccgtccccagcctcaaggggctcagctttttccaggctcaccccttccatttataatttggagacaagcaaggtccactgacgctaacgccatttggttctttaaaagatgttaggccgggcgcggtggctcacgcctgtcatcccagcactttgggaggccaaggcgggtggatcatgaggtcaggagttcgagaccagcctgaccaacatggtgaaacaccatctctactaaaaatagaaaaattagctgggtgtggtggcggacaccggtaatcccatctactggggaggctgaggcaggagaatcgcttgaacgtgggaggtggaggttgcagtgaaccaagatcgcgccactgcactccggcctggacaacaagagtgagactccatctcagaaaaaacaaaacaaaacaaaacaaaaaaccagaaaagacagctgccaccccagagcacagtgtaggagagccagcctttctgggatgcggcagaaagttccagtgcaggaggctgaggtcctgtacccccttgttacggtaactgcagccacttaggaatttccgtgtgttgatttcatcattgtaattatacttccttccactgctttgtcatctgagcttcctggtgtgccgcagaggatgtgttttcctggtttgtggatacagctcgagccaagaacgggctaaacccccagggcagcaactctttcttttcttttcttttttttttttttttttgagacggagtctcgctctgtcgtccaggctggagtgcagtggcgccatctcggctcactgcaagctccacctcccgggttcaactgattgtcctgcctcagcctcccgagtagctgggattataggcacactccaccacgcctggctaatttttgtatttttagtagagacggggtttcaccatgttagccaggctggtcttgaactcctgacctcgggcaatctgcccacctctgcttcccaaagtgctgggattactggcatgagccactgcacccagccggcagggcttctttcaaaagggaacggctgacacacacacagatgcatgcacatacatgcacacatacacactgatgcaaacacatttgtacacatacattcacacatgcatgcacataaatatgcacttctaggcacatgcatgcacacatacagactcatgcatgtatatttgtgtatgcacatatatttatgcacatgtgtgtacacgtggaatgcatgcacagatacatatgcattcaaacacaaagactgtgtgtacctgcatgcatgaaaacacacaaacacagccgggcacggtggctcacacctgtaatctcagcacttggcgaggaaaaggcgggcggatcacctgaggcaggagtccgagaccagcctggccaacatggtcaaatctctactaaaaaatacaaaaagtgggctggacgcggtggctgacgcctgtcatcccagcactttgggaggctgaggtgggtggatcacctgaggtcaggagttcgagaccagcctggccaacacggtgaaaccccgtctctgctaaaaatacaaaaattagccggacatggtggtgggtgcctataatcccagctactcgggaggctgaggcaggacaatcggttgaacctgggaggcggaggttgcagtgagcccagatcacgccattgcactccagcctgggcaacaagagcaaaactctgtcacaaaaaataaataaataaataaataatacaaaaattagccaggcatggtggcgagtgcctgtaatcccagctactcaggaggctgaggcaggagagtcgcttgaacctgggaggcagaggttgcaatgagccgagatcatgccactgcactccagcctggacgacaagggcgagtctccatcaggaaaaaaaaaaaaagaaaacacacaaacacttatgtgtgcacacagatacacacgggcacaaaaatgtacacacgtgcaagcacacacacacacagacacatgtacacagtacccgtgtgtgcacaggcatgcatgcagtcctgcaaatgtgcaaacagacatggctacatagaggcatgcacacatatagacccatgtacacacacacgaatattcgtgcacacatgtagaagcacactctgatgtgcatgcatgtgcaaaggcgcatttgcacacagacacatatgcacactcaccaccgctttccctccagaagcagctccttctgctgtgagcaccaggctctggaaggggcaagcatccttcattacccgcaacccagtttcacagccagtccccgctgcctgactctcgtttctcctgcagcaggcacctctgtcctgcgttccggagctgcgttcccgatggtcctcctttggctcacgctgctcctgatcgccctgccctgtctcctgcaaacgaaggaaggtaagaactggagaaaaaatgcacgtgccacctggggagcggtgggggtagacagacacacaatgtcagcgtgccgtccttcagggaaacttttcatgctgagctcatggcagagtctcatgcagtggtcgggaatgactcagacacttccctgtacccgtcaccaagttccctgtaatgcagcatcttgcaaaacggtaatacgacctcacaggcagggacctgatcgtgacacagatgccatgtgaggtgttttgatgaaactcacacgctgggatcaacagcaccaataacaatttccagtttccttcattgtttatcttactttttcattttcttattatttttattttggagacagggtcttactgtcttgcccaggctggagtgcaatagtgtgatctcggctcactgcaacctctgcctcccggattcaagcgattcttctgcctcagcctcccgaggagctgagattacagtcgcgcaccaccatacccggctaatttctgtatttttgatagagacgggatttcactatgtcggtcaggctggtctagaactgctgaccacaagtgatccgtctgccttggcctcccaaagtgctgggattacaggtgtgagccacagcgcccggccttttttttcattggtttttacagtctattactgcagggtttcactttaccttgaatttcttttaactttaatttgcttttcattctttaacttcttttttttttttttttttgacacagagtttcattctggtcgcccaggctggagtgtaatagcgtgaccatggctcactgcaacctctacctgctgggttcaattgattctcctgtctcagcctcccaagcacctgggattacaggtgtccgccaccacgcccagctaatttttctgtttttactagagacggggtttcaccgtgttagacaggatggtctcgatctcctgacctcatgatccgcctgcctcggggttgggattacacactttgggaggccaaggcaggtggacgatcacaaggtcaggagttcgtgaccagcctgactaacacggtgaaaccccgtctctactaaaaatacaaaaatcagctgggcgtggtggcgggcgcctgtaatcccagttactcgggaggctgaggcaggagagtcgcttgaacccgggaggaggaggttgcagtgagcctagatcacgccattgcactccagcctgggcgacagagtgagactccgtctcaaaatgaatgaatgaatgaatgaatttcttataagaatttttttccccagacagtttgttttaagggataaattatccttctaagttagaagaaaataatgccagaagtctagacattcttatgctttggtcccgcttatcaaaccaaggttgctgaccttgataaccactcaagatccttacagtttataaagtcatttcctcaagttttctaagtggccgatcagagataaaccctagagaaatagttgatgtatgtttctagctttgggtgaccagcaaaatgtgatagaatattgccttttactggccgggtgcaacggctcacgtctgtaatcccagcactttgggaggctgaggcgggtggatcacttgaggtcaggagttcaaaaccagcttggccatcatggtgaaaccccgtctgtactaaaaatacaaaaaaattagctgggcgcggtgctgtgcacctgtaatccctgctactcaggaggctgaggcaggagaatcacttgaacccgggaggcggaggttgccgtgagccaagatcacgccattgcactccaacctgggtgacagagcgaggctccatctcaaaaaaaaaaaaaaaaaaagaatattgcctttaacatctttgtacaggtcatttatgaaatatcttgagctctgtgatggctaagagagaccttctttttctttctttcttttttttttttttgagacggagtttttttgtttttttgagatggagtctcgctctgttacccaggctggagtgcagtggcacgatctcagctcaccgcaacctccgcctcccgagttccagtgattctcctgcctcagcttcctgattagctgggattacaggcgcccgccaccacgcccaactaatttttgtatttttagtcgcgacggggtttcaccgtgttagccaggatggtcttgatcacttgacctggtgatccgcccaccttggcctcccaaagtgctgggatgacgggcgtgagccaccacgcccgtttgctttatgacttctaccagctcacagaagtctcctgtgtacatagaactccacttcccagccaggctcagtaactcacgtctgtgatcccagcactttgggaggctgaggcaggcagatcatgtgaggttgggagttcgagaccagcctggccaacatggtgaaaccccatctctagtaaaaatacaaaaattagccgagtgtggtggcaggcacctgttatcccagctgcacagcaggctgacacaggataatcgcttgaacccgggaggcggaggttgtagtgagccgagatcgcgccactgaattccagcctgggcgacagagtgagactccgtctcaaaacaaacaagcaaacaaaaatacccattacaatgttgttttaagattgttgtatatcaactgggcatggtggctcatgcttgtaatcccagcactttgagaggccgaggcggacagatcacgaggtcaggagatcgagaccatcctggccaacatggtgaaaccccatctctagtaaaaatacaaaaattagccgggcgtggtggtgggctcctgtaatcctagctactcgggaggctgaggcaggagaatcgcttgaacccgggaggtagaggttgcggtgagctgagatcgtgccactgcactccagcctgggtgacaagagcaaaactccgtctcaaaaaaataaaaaatttaaaaaaataaagaactcgacctcccaaaggtattggctaactccacgggcaaaaaaaccatacccattacaatgctgttttaagattgttgacctggtgcggtggctcatgcctgtaatcccagcactttgggaggctgaggcggacgaatcatgaggtcaggagatcgagaccatcctggctaacacggtgaaacgccatctctactaaaaatacaaaaaaaaaaaaattagccgggcgtggtggcgggcgcctgtagtcccagctactcgggaggctgaggcaggagagttgcttgaaccaggaggcggagcttgcagtgagctgagatcgtgccactgtagtccagccagggcgacaagagtgaaactccatgtcaaaaaatttaaaaaaattaaataaaagaactccacctcccaaaggtattggctaactccacgggcaaaaaaaaaaaaccataccccttacaatgccgttttaagattcttacgtatctcttcgaactccaacctgtcaccgttttagatccaaacccaccaatcacgaacctaaggatgaaagcaaaggctcagcagttgacctgggaccttaacagaaatgtgaccgatatcgagtgtgttaaagacgccgactattctatgccggtaaatcatactctctattgtttttttatttttattttatttatttatgtatttatgtatttatttattttttgagacggagtcttgctctgtcgcccaggctggactgcggtgacccgatctccgctctctgcaacctccacctcccaggtccatgccattctcctgcctcaacctcccgagtagctgggactacaggcgcccgccaccatgcccggctaatttttttgtatttttagtagagatggggtttcactgtgttagccaggagggtctcgatctcctgacctcgtgatctgcccgcctcggcctcccaaagtgctgggattacaggcgcgagtcaccgcgcatggcccagactctctaatgttgacgaacaagacgtttccgtcttctgcaggaatctcagaaccaatactgctcccatcgctggtgtcatgactacctggtttctgccccgaagtcaggtgtgggatttgaagtgactttggagggtctggttccccgtccgcgggacatctaagatggcacacactggacagggtggatgtgaaagtgaaatgaggctaagctatgactggtgcgaaacccaaccccacgctgggcgtggtggctcacgtctgtaatcccagcactttgggaggctgaggcgggcggatcatgaggtcaggagttcgagaccagtctggccaacacggtgaaacgctgtctctgctaaaaatacgaaagttagccgggcacagtggctcacaccagcactttgagaggctgaggcggatggatcacctggggccaggagttcgagactagtctgggcaacatggtgaaaccccgcctccactaaaaatataaaaattagctgggcatggtggtgggcgcctgtaatcccagttacttgggaggctgaggcaggagaatcgcttgaacccgggaggcagaggttgcattgagccgagactgtgccactgcactccagcctgggggacgagagcaagacttcatgtcaaaaaagaaaaagaaaaattagccggatgtggtggcacatgcctgtaataccagctattcaggaggctgaggcaggagaattgcttgaacctgggaggccgaggttgcactgagccgagattgtgccactgcactccagcctgggtgacagagtgagactccatctcaaaacaaaaacaaaaacaaaagcaaaaacaaaacaaaagtgtgtgctcaggaaacaaggtcctcatcacgaaatccttccaaatcccccatcttgtcatcacctgcgttctcagggtttgagaacagcgccagacctcatggggtggcccaggtgacactgtgagctatttacaagtcagtgtcttatgggaaaggagcacgtttccctgagaacctatttggtcccctccaagagctatgttcgttcaatacaattcaaatcacggcccttcatgcgtctgctcgggccaccattataaaatcctacccccagctccaaatacagtcccattgaactttgtgattttggagagtagagataaaacagtctagaatcccagagcgattttaccataccatggcaaactgactctcaactttagaaacacaaatgctgaaaaaaaaactaaggaaattttgaaaaagaaggtgaatgaaggagaacctgccttacctatatcaaaaggcactgaaaagttcatacccaatgtgcggattgctataagaatacacaagtaggccgggcgtggtggctcacgcctgtcatcccagcactttggaggccgaggcgggtggatcacgaggtcaggagatcgagaccctcctggctaacacggtgaaaccccgtctctactaaaaatataaaaattagccgggcgtggtggctggtgcctgtagtcccagctactcgggaggctgaggcaggagaatggcttgaacctgggaggcagaagcttgcagtgagccgagatcgcgccactgcactccagcctgggcgacagagcgagactctgtctcaaaaaaacaaaaacaaaagcaaacaaaacgaagaatatacaagtagattaatgaaatgtggccgggtgcggtggtgaggcaggagaattgcttgaacccgagaggtggaggttgcagtgagctgagatcgcaccactgaagtctagcctgggcaagcggagtgaggccctgtcttaacaaaaaaacaaagaaacaaaaaacaaacaaacaagaaaaaaacaaagcaaaacaaacagaaaagtatttcactaatatttactgctaagtgggattatttttattcaagcttttgtatctttagaaaaaaattgtggccgggcgcggtggctcacgcctgtcatcccagcactttgggaggccgaggagggtggatcacgaggtcaggagatcgagaccctcctggctaacacggtgaaaccccgtctctactaaaaatataaaaattagccgggcgtggtggcgggcgcctgtagtcccagctacttgggaggatgaggcaggagaatggcatgaacccgggagggagaggctacagtgagccgagatcgcgcccctgcactccagcctgggcgacagagcgagactccctctcaaaaaaaaaaaaaacagaaaaaagtcttggccgggcacggtggctcacgcctgtaatcccagcactttgggaggctgaggcaggcggatcacatgaggtcaggagttcgagaccagcctgaccaacatggtgaaaccctgtctctacccagaaaaatactttaaaaattagctgggcgtggtggcgggcacctgtaatcccaggtgctcgggaggttgaagcaggagaatggcttgaacccgggagggagaggctgcagtgagccgagatcacgccactgcactccagcgtgggcgacgagagcgaaactctgcctcaaaaaaaatctgaacatcattagcgtcaaattaagcatggtctgtcagcagccatcatagtcctatgtctctcttaggcagtgaacaatagctattgccagtttggagcaatttccttatgtgaagtgaccaactacaccgtccgagtggccaacccaccattctccacgtggatcctcttccctgagaacagtgagaaaaatgttcattgtttgtttattctctattccctccctccttccctctctccctccctctcgccttcgctgtgtcttttttcttttctttttctctttctttctttctttctttctttctttctttctttctttctttctttttctttctttctgtttctgtttctttcttcctttctttttctttctttctttccttctttcctctctttcttttctttctctttccctccctcccttctttcttttcttcacttccttccctccctccttctctccttttcctccctcctccttcccaccctacttcctctctctccttccttccctttcgttttcttttcctccctgcctcactcccttccttccttctctccctcctcttttccttccttcttccctccttccctttctctctctctctctttctctctttccccctcccctcccttcccctcctctcccctctcctttcctgacacggtcttgctctgttgcccaggctggagcgcagtggtgcaatcacagcttactgcaggcttcacctcctgagctcaaacaatccttctgcctcagcctcccacgtaggtggaactacacccatgtaccaccatgcccacctaattttttaaacacctttttttttttttagacagagtctcactctgtccaccaggctggagtgcactggcgcgatctcggctcactgcaacctctggctcccgggttcaagcgattctcctgcctcagcctcccgagtagctgggattataggcgcccaccgccacgcccagctaattcttgtatttttagtagagatggggtttcaccatgttggtcaggctggtctcaaactcctgacttcgtgatctgcccgcctcggcctcccaaagtgctgggagtacaggggtgagccaccgcgcccagccttaaatactttttgtagagatggggtgtcgctatgttacctgagctggtctcaaactcctaggctcaagtgatcctcccgcctcagtctcccaaagtgcagggattgtaagcatcagccaccacgcctggcctcttctttgttttttaattaattagaagtccatggtttatttttttgttttgttttgtttgtttttctgtgatggagtcttgttcttgtcgcccaggctggagtgcagtggtgcgatttcagcttaccgcaaactccgcctcccgggttcaagcgattctcctgcctcagcctcacaagtagctgggattacaggcacccgccaccaagcccggctaaattttgtattttaagtagagacggggcttcaccatgttggtctcgaactcctgaccttgtgatccacccgcctcagcctcccaaagtgctgggatgacaggcgggagccactgtgccgggcctcaatttaattatttttaagtttaatggatttccagggagttatgccgagtcggaaaaaaaagaccactccagagcgtgacacacacagtgatttcattaatacaactgtcttgaaatggcaaaattttacaaatagaaaacagtctcctgggttgcagggatataagcaggagtgagagctgagagaggtgggtttggctgtaaaagtgctccttggggaggccgggcgcagtggctcacgcctgtaatcccagcactttgggaggccgaggcgggcggatcacctgaggtcaggagttcgagaccagcctggccaacatggtgaaaccccgtctctactaaaaacacaaaaattagccgggcatggtggctcacgcctgtaatcccagcactttgggaggccgaggcaggcggatcacctgaggtcaggaattcgagaccagcctggctaacatggtgaaaccccatctctactaaaaatacaaaattagccaggggtggtggcacatgcctgtagtcccagctactcaggaggctgaggcaggagaatcacttgaacccgggaggcggagattgcggtgagctgagatcgtgccattgctctccagcctgggcaacaagagtgaaattccatctaaaaaaaaaaaaaaattaaaaagaaattagcggccgggcccagtggctcacacctgtaatcccagcactttgggaggccgaggtgggtggatcgcgaggtcaggagatcgagaccatcccggctaacatggtgaaaccccatctctactaaaaatacaaaattagccaggggtggtggcacatgcctgcagtcccagctactcaggaggctgaggcaggagaatcacttgaacctgggaggcggaggttgtggtgagccattgagctccagcctgggcaacaagagtgaaactctgtcttaaacacacacacagatgcacacacacgcacacacacacaaacaatgaaagaaaaacatctgtagtcccagcagtttgggaggctgaggcgggtggatcacttgaggtcaggaattcgcgaccagtctgggcaacatggtgaaaccccatctctactaaaaatacaaaaattagctgggtgtggtagtgggtgcctgttgtcccagatacttgggaggctgaggcaggagaattgcttgaacccgggaggtggaggttgcagtgagccgagatggcgccattgtactccagcctaggcgacggagcgagactctgtaaaaatgaataaataaatcattaaaagaatatgcaggatctctccatattattattattttttacaacggcttgtgtatctaccatggtctcaaaatacaaaaggcactctaaaaaggaattagagttttatttttttttttgagacggagtctcgctcttgtcacacaggctggagtgcagtgacgtggcctgggctcactgcaacctctgcctcctgggttcaagaaattctcctgcctcagcctccctagtagctgggattacagcggcccgacatcacgcccggctaatttttgtatttttagtagaggcagggtttcaccatgttagccaggccggtctcgaactccggacctcaggtgatcctcctgcctcggcctcccaaagtgctgggattacaggcgtgagccaccatgcctgggtttgtttttttatttttttgagacgaaggctcactctgtcgcccaggctggagtgcagtggcgtgatctcagctccatgcaacctctgcctcctgggttcaagaaattctcctgcctcagcctcccgagtagctgggattacagcggcccgacatcacacctggctaattttttatatttttagtagagactgggtttcaccatgttagccaggctggtctcgaactccggacctcgggtgatccacctgcctcggcctcccaaagtgctgggatcacaggcgcgtgccaccagacacagctaatttttgcatttttagtagagattgggtttctccatgttggccaggctggtctcgaactcctgacctcatgtgatccacccgcctcggcctcccaaaatgctggggtgacaggcgtgagccaccgcgcccggtcccgattcgagttctctttcatgtttgtgaacccaggtgggaagccttgggcaggtgcggagaatctgacctgctggattcatgacgtggatttcttgagctgcagctgggcggtaggcccgggggcccccgcggacgtccagtacgacctgtacttgaacgttgccaagtaggtgtgcccgtgggcagaggccgggctgtccctggtgcgggtgccatcggcgtggggtcgtcccccaaccttaccgcttaccgcagcaggcgtcaacagtacgagtgtcttcactacaaaacggatgctcagggaacacgtatcgggtgtcgtttcgatgacatctctcgactctccagcggttctcaaagttcccacatcctggtgcggggcaggagcgcagccttcggtatcccctgcacagataagtttgtcgtcttttcacagattggtgagtagcccgggacactccctcccaccctcagttctgtgataccacggctttagcgccaggccagatcccacgggaccacgtggctcccaacgcagacgttggcctctcacatttccagaggctggacgttggaggtcagcgtgctggctggctgggctcctcgggaggtctcttcctggcttggagagagggtcatcttctcactgtgtcttcacgtggtgtagagagagagagagatgaagttctggggtctcttgttagaagggcactaacaccatcatgggtcccatcatgggtcataggatccctcaccatgggtcatgggaccccccatcatgggttccatcatgggtcccatcatgggtcatagaatcccccatgatgggtttcatcatgagtcatagaaccccctatcatggattccatcatgggtcatgggaacccccatcatgggtcccatcatggttcataggatcccccatcatgggtttcatcatgagtcatagaaccccctatcatggattccatcatgggtcatgggaacccccatcatgggtcccatcattggtcataggaccccctatcatgggttccatcatgggtcatgggacaccccccatcatgggttccaccatgagtcatgggatccctcatcgtgggttccatcatgggtcatgggaccccccatcatgggttccatcatgggtaataggacccccccatcatgggttccaccatgagtcatgggatcccttatcatggattccatcatgggtcatgggaccccctatcatggattccatcatgggtcatgggacccccccatcatgggtcccatcatgagtcatgggatccctcatcatgggtttcatcatgggtcataggacccccatcatggattccatcatgggtcatgggaacctccatcatgggtcccattatgggtcatagaattccccatcatgggttccatcatgagtcatgggaccccccatcatgggttccacatgggatccctcatcattggttccatcatgggtcataggatcccccatcataggtcccatcatgggttccacatgggatcccccatcataggtcccatcatgggtcatgggaccccccccatcatgggttccatcacgggtcatgggaccccccccatcatgggttccatcacgggtcatgggaccccccccaatcatgggttccatcatgggtcatgggaacccccatcatgggtttcatcatgggtcataggatcccctatcatgggttccatcatgggtcatgggaccccccccatcacgggttccatcatgggtcatgggaacccccatcatgggtttcatcatgggtcataggatcccctatcatggattccatcatgagtcatgggatccctcatcatgggttccatcatgggtcatgggacccccccccccatcatgggtcgtgggacccccacccccatcatgggtcatgggagcccccattgtgagtcatggaatccctcatcatgggtctcatcatgggccatgggtcccaccatgggtcatgggagcccccatcatgagtcatggaatccctcatcatgggtcatgggtcccatcatgggtcatgggagcccccatcatgggtcatgggtcccatcatgggtcacgggagcccccatcatgggggtccaccctcataacttcagcccacgccagtcacctcccaaagaccccaccttctaacaccgcccaaccaggggttagagcttcagtggaggaatttgggacagaaggacacacactttcagtccacgatacccgagctccgaggaacctcccaggtggtgagaatgtcaatatgcccagagctgacgtgccctgaacccaagggcagggtgctcggatgcttcagaagaggagggggaaacgaggaagaggaggagaaggacaaggagaagagaagggaggagaggaagaacatgagcagggggaggaggaggagaaggaaaagaaacagaggaaaaggagggggaggaggtagagatggagagggaaggaagaggaggaagagaagaaaacggagaaagaggagggggaggaggaggaggaagagaaaatggagaaagaggagggggaggaggtggagatggggaggggaggaagaggaggaagagaagaaaacaggagggggaggaagagaagaaaatggagggaaaggagggggaggaggtggagatggggagagaaggagcaggaggaggagaagaaagaagaggaagaaaggaggaggagagggtggaggaggaagagggtgaaggagagagggaggagaatggagaggaggaggaggcgggggagggaagagaaggaggtgaggaggaggaaggggaggatagagaaggtggggtagaagggtggtgaggtggggagggagaaggagggggaggaggagagaggaggactggggggaggaagggggaggaggggagagaggaggagggaggagggagaaggagggggagaggatggaggaaggggagcagatggaggaaggcgagcaggagggggaggaaaaaggaggggcaggaggaagaaggagcgggaggagaggaggaggaggaggaggagaatgggcagggaggaggagagggaagaaaaggagggggaggaggaaggagggggaggagggtggagggggaggagggtggagggggaggagggtggagggggaggaggaaggagggagaaggaggggagaggatggaggaagaggagcaggagggggaggaaaaaggaggaggggcaggaggggaggaggagaaaggagagtggaggaggagggtgacaaggagaatggggaggagagaggagtggtagaaaaaggagagagaggaagagtaggagcggagggggaggaggggaggggaggggaggggagaaagaccaggagggtaggaggagggggaggaggaggagggggccagggctggacttccttccaggggcccaggggagacccagccaggcagccggacacacagggctgggctggtagtcgggtcacacctgaggatgtggaagtgcctggggttcccgggaagtggaggatgtcctgggccactgggagaggcggcacatcccctggggggcggaggtgggggaggtgagaagccaggcaggggccaggaagtggaagcttcaggaggatgtgtgcaggtcaaagtgtaggagtctgcatcttgaatgatgcagagagggcctccaaggctccagtgtgctgcaggtgggcagagggggcatgggaagtaggggttggccctgggcaggggtggggagtgggccaggctgcccagcggggctgagcctagagatggaaggggcagggacaaagatgtgcagctgccagtccttggaaaagctgaacgcctggtacttcagagaacaaaagggtggttctgaaggctgctcccaggacagtggggctccgagggtgcaaccccaaggctcactcctcccagtgcccccaacgcggctcagtcctgtgtctctgcctgtagagtttctttgttccctcttccttcctggtgtttttctctcccgctctccaaatgcataggagaagtaatttgaagtatctccagaaaaaaaaagagaaaaagaaaaagaattgatttcttgtactcctaaatcctaaaagtgtttttctcgttgctagagatattaactccacccaacatgactgcaaagtgtaataagacacattcctttatgcactggaaaatgagaagtcatttcaatcgcaaatttcgctatgagcttcagatacaaaaggtaaactttcaccccgcccccagcccccccacccccgtggacatcccttatttttggtaagtcgcactctggggccttgaaacgggcaacaatctcctctgataacgtcacagaaggcatggatcattaaaaaacaaaaacaaaaacaaaaggccgggcgctgtggctcacgcctgtcatcccagcactttgggaggctgaggcaggtggatcacaaggtcaggagatcgagaccatcctggctaacgcggtgaaaccccgtctctactaaaaatacgaaaaaaaattagctgggcgtggtggcacggtcttgtagttccagctactggggaggccgaggcaggagaattgcttgaacccaggaggtgggggttgcagtgagccgagatcgcgccattgcactccagcctgggcgacagagcgagactccgtctcaaaaaaaaaaaaaaagtttgagactgtatgtggtctgttgttttttatttttattatttctattgttatgtggttttttaattttttcttgaactttcttttttcttttgtagtgatctacagattcaatgcaagcttcccagatatttttgatccacagttcgttggatcagttgaacataaatattgatttatttattgagccactctggctctgtagcccagactggagtgcagtggcttaaatcttgactcactgcaacctctgcctcccgggttcaagtgattctcctgcctcagcctcccgagtagctgggattatgggcacccatcaccacacccagctaagtttttgtatttttagtagaaacagagtttcatcatgttggccaggctggtctcaaactcctgacctcaggtgatccacccgcctcggcctcccaaagtgctgggattacaggtgtgagccttcgtgcgcagcctatgtgttatatttagtttgtattttattttattgtattttattatttatttatttatttttgagacggagtcctgctctgtcacccaagctgtttgtttgtttgtttgtttgtttattatttttgagacggagtcctgctctgttgcccaggctggggtgcagtggcatgatctcagctcactgtaacctccgcctctcgggttcaaccaattctcagcttcagcctcctgagtagctggaattacaggcacctgccaccatgcctggctaatttttttttgtatttttagtagagatggggtttcaccatcttgtcctggctggtcttgaactcctgacctcatgatccacccgcctcagcttcccaaagtgctgggattacaggcgtgaggcactgtgccccgccatatatttattatttatgctcaaatactaattatttcatatgcaatttttctgtaagtctaaatctgctaaaaaacgttaggtctattaatttcttttatattaccaagtgttttttagccaatctgtttgggttttttttttttttaagaaaataaatggctgggtgcagtagcttacgcctgtaatcccagcactttgggaggccgaggcaggacgatcacgaggtcaggagatagagaccatcctggctaacatggtaaaaccccgtctctactaaaaatacaaaaaaaaattagctgggcgtggtggcgggcgcctgtagtcccagctacttgggaggctgaggcaggagaatggcgtaaacccagaaggcggagcttgcagcgagctgagattgtgccactgcactccatcctgggcaacagagtgagactccgtctcaggagaaaaaaaaaaaaagaaaataaatacagcacagacttctttctttcactgatttgagggagcaggcatagctgcagccacaggcagagtcgtagctagtctgatgttgcaccccctacctagttcgctggcctggcataggctgtctgtggctacccctgagtgcatctggacacagtctgggaggacggtgggtcttgtttgtccaccggcctcacaaagccccctcccaccaaggtcttgccacagtggcccataagaaaccttttgggccaggcgcgatggggcatgcctgtaatcccagcactttgggaggccgaggtgggcagatcatgaggtcaagagatcaagaccatcctggccaacatggtgaaactttgtttccactaaaaatacaaaaaattagccaggcgtggtggcacgcacctgtagtcccagctactcgggagactgaggcaaaagaatcacttgaatccgggaggcggaggttgcagtgagccgagatcacgccactgcattccagcctgggtgacggagtgagactccgtctcataaataaataaacaaacaaaccttttggtcaggtgctatttactcctaagctcattattttgcccccactgctgcccgaaggccttcccagagccctcactgttttgctggttttcctggagggagaaatttgagtttgggaggaggaggctttcagggacggtccagacactcaaaagtttgcttgcttttgtgttgcagagaatgcagcctgtaatcacagaacaggtgagtgttccctacccccagccgctgtacttgacattgcaaagggtgagttttattattattaagaataaaatgataaaaaatattaataattcttattaataaaataatgaaaatattattaataataaatgttattattcaatgttcagtgactttcattggacagactcttgagtgtcacccttactgcgatcttgcaaaattgggatatttcacatccccaaattgagggatgggaaaaggaagagtcagggatgacacctcccaaggtgtgagagccagatgctatggctggccaggtgctgtccaaacgaggtccacccatttgccccagattccttaccctgggccaggcagccccagtccagcaggaacaagctaccaaaccatagctccacccagcagagacaagcattcagacaggtggcccagacctcagacagaggaccctcccccagcccctgcctgggatctgcaggaacagacagccggaccacagcattctctgtcccctctctctctgtccatctctttccccgtatctctttctctgtctctgaatctctctgcctttctccctccctctctttctctctctctcgtctctatctccctccccctctctgtatctccctccctttttccctccctctatctttctggctctctccctgtgtctatctctccctgtccccatctctctctgtgtctctttccctccctctctcattctccttccctctctctatctttctctccctgtctctatctcccgctccgtgtctgtctctatctttctccctttctccctccatctctctctccctgtctctctctccccgttcccatctctctctctgtgtctctgtctctccctctctcattctccctccctcttttattctccctccctctctttctctctctctctctctctcctggtctctgtctcccccctccccatctctttctctgtgtctgtctctgtaaccttctccatttctccctccatctctctgtctctccctgtgtctatctcccactgtccctgtctgtttctccgtgtctgtctctgtatctctctccctttctccctccatctttctctctctcccccggtctctatcttcccttctccccatctctctctctctgtctgtctctgtatctctctccctttctccctccatctttctctctctctcccggtctctatctccccctctccccgtctctttctccgtgtctgtctctgtgtctctctccctttctccctccctccatctttctctctctctcccggtctctatttcctccctccccatctctttctctgtgtctgtctctgtatctctctccctttctccctccatctttctctctctctcctggtctctatctccccctctccctgtctctctgtgtctgtctctgtatctctctccctttctccctccctctctttatctctctctctctctctgcctctatctcccactgtccaaatctgtgtctctgtctctccctctttcattctccctctctttctctatctctctccttgtctatatctccccctctcccagtctctctgtatctctgtatctctctccctttctccttccctctcttcatctttctttttgaaacggagtttttctcttgttgcccaggctggagtgcgatggcacgatctcggctcactgcaacctccgcctcccaggttcaagcgaatctactccctcagcctcccaagtagctgggattacaggcactcgccaccatgcccaactaacttttttttttttttgtatttttagtagagacagggtttcactagtgggccaggctggtctcgaactcctgacctcaggcgatccacctgcctcatcctctcaaagtgctggaattacaggtgtgagccaccgtgcccggcccctctctttatctttctagctctctccctgtctctctctcccttcccctctctgtctctctctcccttcccctctctgtctctctctcccttcccctctctgtctctctctcccttcccctctgtctctctctcccttcccctctctgtctctctctcccttcccctctctgtctctctctcccttcccctctgtctctctctcccttcccctctctgtctctctctcccttcccctctctgtctctctctcccttcccctctctgtctctctctcccttcccctctctgtctctctctcccttcccctctctgtctctctctccctttccttctctgtctctctctcccttcccctctctctctctccattcccctgtctctatgtctctccctttctctctcccattatttctctgtgattgtctctttctttctctgcctctgtctgtctgtccccctgtattagtccattgtcacactgctgataaacatatacccaagactgggtaatttataaacaaaagagggttcctggactcacagttccatgtggctggggaggcctcacgatcacggcagaaggtgaaggaggaggaaaggcatgtcttacatgtcagcgggcaagacagaatgagacagtcgccgggcgcagtgactcatgcctgtaatcacagcaccttgggaggacgaggtgggtggaccacgaggtcaggagttcaagaccagcctggccaacatggtgaaacctagctctactaaaaataaaaaaaattacccagacgtggtggtggcaggcgcctgtggtcccagctactcgggaggctgaagcaggagaatcgcttgaacccgggaggcagaggttgcagtgagttgagatcgcgccactgcactccagcctgggtgacagagtgagactccgtctcgagaaaaaaaaaaaaaaaaaaaaaatgagagccgagagaaaggtttcccttattaaaccattagatctcgtgagacttattcactaccccgagaacagtgtggggggaaactgcccccatgattcagttatgtcctacccagtccctctcacaacacgtgggagttataagggctacaattcaagatgagatttgggtggggacacagccaaactacatcacccactctctctgtctctctgcttctgttttcctctctgtctctgtttttctttccctctctctgtctctttgtatctctgtctctctctctctgtctccgtttctatctctgtctctctctgtccatcacccactctgtctctttgtctctctatgtctctctgtttctgtttttctgtttttctctttccctctctctttgtatctatgtctttctgtctctccgtttctgtctctctctctgtccatcacccactctgtctgtctttgtctatgtctctctgtttttctgtctctttttctctttccctctctgtctcccctctctgtgtctctttgtatctccgtctctccctgtctgtttctatctctgtctctctctgtccatcacctactctgtctctttgtctctgtctgtttctgtttttctttctttttccctctgtctcccttctctgtgtctctttgtatctctgtctctctctgtttctatctgtctctctctgtccatcacccactatctctgtctatgtctgtttttctgtctctgtttttctctctccctctctctgtctcccctctctgtgtctctttgtatctctttctctctctctgtctctccctgtctgtttctatctccgtcctcctgtattagtccattttcatggactaatgaggatccttcccgcttctcccagctcctggggactctggggtccctgggcttgtggccatatcactccactctctgcctccgtctccacatggccttctcctctgcatccgtgtctcctttttatttatttatttatttattttgagacagagtctcgctctgtcacccaggctggagtgcagtggtgcgatctcagctcactgcaacctccgcctcccaggttcaagcgattcccctgcctcagcctcccgagtagctgggactacaggtgcacaccaccacgcctggctaatttttgtattattagtaaagatgggattttaccttgttgctcaggttgacctcgaactcctgacctcaggtgatctacccacctcagcctcccaaagtgctgggattacaggtgtcagccaccgcgcccggccacgtctcctcttcttataaggatattggtcattgcatttagggccccccctgatccaaaatgacatcatctcaatctatatcttaacgacatctgccatgaacaggtatttcatcataaggccccattgtaaggtgctgggggctaagactgcaacatatgaattttgggggatcacaatgcagcctcattcttttgtacccatcaaatatgaatggtcttttcttcttttttttttttttttgagacggagtctcgctctgtcacccaggctggagtgcagtggcgcaatctcggctcactgcaagctccgcctcccgggttcccgccactctcctgcctcagcctcctgagtagctgggacctcaggcgcccgccaccgggcccggctaattttttgtatttttagtagagacggggtttcactgtggtctcgatctcctgaccttgtgatctgcccgccttggccctccaaagtgctgggattacaggcgtgagccaccgcgcctggccgagctatttcatcataaggccccactgtaaggagctgggggctaagactgcaacatatgaattttgggggatcacaatgcagactcattcttttgtacccatcaaatatgaatggtcttttcttctacttttttgtttggtttttaatttcagacaggctctcactctgtcacccacgctagagtgcagtggcacagtcacggctcactgcaatctctgcctcctgggctcaagggatcctcctgcctcagccccccaagtagctgaaactacaggcgtttgccaccaggtcagctcatttaaaaaaaaatttggctgggcgcggtggctcacgctggtaatcccagccctttgggaggccgaggcgggtggatcatgaggtcaggaaatcaagaccatcctggctaacatggtgaaaccctgtctctactaaaaaaaaaaatacaaaaaattagctgggcatggtagcgggtgcctgtagtcccagctactcgggaggctgaggcaggagaatggcatgaacccgggaagcggagcttgcagtgagccgagatcacgccactgcactccagcctgggggacagagtgagactccatctcaaaaaaaaaaaaatttttttttggctggacgtggtggctcacactggtaatcccagcactttgggaggctgaggcgggtggatcaccggaggttgggagttcgagaccagcctgaccaacatggagaaaccccgactctactaaaaatacaaaattaaccgagcgtggtggtgggcgcctgtaatcccagctactcgggaggctgaggcaggagaatcgcttgaatctgggaggcggaggttgcggtgagccgagttggtgccactgcactccagcctgggcaacaagagtgaaactctgtctcaaaacaaaacaaaacaaattttcttctagagatggggtcttggtttgttgcccaggctggtctcaaactcctaagctcgaggtatccccccacctcagcctccctggtagctgggaccaaagacatgtgtcaccacgtctggtaatttttacagttttttttttttggtaaagatggggtcttgctatgttgcccaggctggtgtcaaactcctgggcttaaggaattctcccacctcagcctccaaaagtgctgtggtgagaggcataaaccgtagcacccagcccctcttttcttcttttatttatttatttatttatttatttatttatttagagacagagtctcactctgttgcccaggctgcagtgcagtggtgccatctcgcctcactgcaacctccacctctcaggtttaagctattctcctgcctcagcctcctgagtagctgggattacaggtgcctgccaccatgccaggctaatttttgtatttttagtagagacagggtttcaccatgttggccaggctggtctcgaactcctgacctcaggtgatccacctgccttggcctccctaagtgcccaggtgagagtcatgagccaccatacctggcccctcttctttattttctttcaaaccacaggtcagagacagaacctccttccagctactcaatcctggaacgtacacagtacaaataagagcccgggaaagagtgtatgaattcttgagcgcctggagcaccccccagcgcttcggtgagtgggctgtgcggggtgcgcggggtgagcggggtgagcggggtgcgcggggtgagcggggtgcgcggggtgagcggggtgcgcggggtgagcggggtgagcggggtgagccgggtgcgcggggtgagccggctgcgcggggtgagcggggtgagcggggtgagcggggtgagcggggtgcgcggggtgagcggggtgagcggggtgcgcggggtgagcggggtgagccgggtgcgcggggtgagccgggtgagcggggtgcgcggggtgagcggggtgagcggggtgcgcggggtgagccgggtgcgcggggtgagcggggtgagccgggtgcgcggggtgagcggggtgagcggggtgagccgggtgagccgggtgagccgggtgcgcggggtgagccgggtgcgcggggtgagcggggtgcgcggggtgagcggggtgcgcggggtgagccgggtgcgcggggtgagcggggtgcgcggggtgagcggggtgcgcggggtgagccgggtgcgcggggtgagcggggtgagcggggtgagccgggtgccccgggtgagcggggtgcgcggggtgagccgggtgcgcggggtgagcggggtgagcggggtgcgcggggtgagccgggtgcgcggggtgagccgggtgcgcggggtgagccgggtgagcggggtgagcggggtgcggggtgcgcggtgcgcggggtgagcggggtgcgcggggtgagccgggtgcgcggggtgagcggggtgagccgggtgccccgggtgagcggggtgcgcggggtgagccgggtgcgcggggtgagcggggtgcgcggggtgagcggggtgcgcggggtgcgcggcgtgagccgggtgcgcggggtgcgcggggtgagcggggtgcgcggggtgcgcggggtgcgcggggtgagcggggtgcgcggggtgcgcggcgtgagccgggtgcgcggggtgagcggggtgcgcggggtgagcggggtgcgcggggtgagccgggtgcgcggggtgagccgggtgagccgggtgcgcggggtgagcggggtgcgcggggtgagccgggtgagccgggtgcgcggggtgagccgggtgcgcggggtgagcggggtgcgcggggtgagccgggtgcgcggggtgagcggggtgcgcggggtgagcggggtgcgcggggtgagcggggtgcgcggggtgagccgggtgcgcggggtgagcggggtgagcggggtgagccgggtgccccgggtgagcggggtgcgcggggtgagcccggtgagccgggtgcgcggggtgagccgggtgcgcggggtgagccgggtgagcggggtgagcggggtgcgcggtgcgcggggtgagcggggtgcgcggggtgagccgggtgcgcggggtgagcggggtgagccgggtgccccgggtgagcggggtgcgcggggtgagccgggtgcgcggggtgagcggggtgcgcggagtgagcggggtgcgcggggtgcgcggcgtgagccgggtgcgcggggtgcgcggggtgagcggggtgcgcggggtgcgcggggtgcgcggggtgagcggggtgcgcggggtgcgcggcgtgagccgggtgcgcggggtgagcggggtgcgcggggtgagcggggtgcgcggggtgagccgggtgcgcggggtgagcggggtgcgcggggtgagccgggtgcgcggggtgcgcggggtgcgcggggtgcgccgggtgcgcggggtgagccgggtgcgcggggtgagcggggtgcgcggggtgcgcggggtgcgcggggtgagccgggtgcgcggggtgagcggggtgagccgggtgcgcggggtgagcggggtgagccgggtgcgcggggtgagcggggtgcgcggggtgagccgggtgcgcggggtgagcggggtgcgcggggtgagccgggtgcgcggggtgagcggggtgcgccgggtgagcggggtgagcggggtgagccgggtgcgcggggtgcgcggggtgcgccgggtgcgcggggtgagccgggtgcgcggggtgagcggggtgcgcggggtgcgcggggtgcgcggggtgagccgggtgcgcggggtgagcggggtgagccgggtgagcggggtgcgcggggtgagccgggtgcgcggggtgagcggggtgcgcggggtgagccgggtgcgcggggtgcgcggggtgagccgggtgcgcggggtgagcggggtgcgcggggtgagcggggtgcgcggggtgagccgggtgcgcggggtgagccgggtgcgcggggtgcgcggggtgcgcggcgtgagccgggtgcgcggggtgcgccgggtgcgcggggtgagcggggtgagccgggtgcgcggggtgagcggggtgcgcggggtgagcggggtgcgccgggtgagccgggtgcgcggggtgagccgggtgcgcggggtgagcggggtgcgcggggtgagccgggtgcgcggggtgagcggggtgcgccgggtgagcggggtgcgcggggtgagcggggtgcgccgggtgagcggggtgcgcgggctgagcggggtgcgccgggtgagcggggtgcgcggggtgagcggggtgcgccatcctgggtcacggaaacactcctctcctgcaaaggagaggagattcactcccccagtttctgtgaccccaaaaaggaccctgaacccgacggtgaactcacagcttgctcttactcacgagaggagacgtggaggggaaacaaggtcgtcccactgacagacaccccctgggccttgtaataaagaccgaggcgggcggatcacaaggtcaggagatcgagaccatcccggctaacacggtgaaacccggtctctacaaaaaatgtaacaaattagccaggcgtggtgatgggcgcctgtagtcccagctactcgggaggctgaggcaggagaatggcgtgaacccgggaggcggaggttgcagtgagccgagatcgcgccactgtgctccatccagcctgggcgacaagagcgagactccatctcaacaacaaaacaaaaggatcgcctcagagtagaacttctggccgggcacggtgactcatgcctgccatcccagcactttgggaggctgaggtgggtagatcacctgaggtcaggagttcgagaccagcctgaccaacatggaaaaaccctgtctctactaaaaatagaaaaattaggtcaggtgctgtggcttaagcctgtaacctcagctaccagggaggctgaggcaggagaatcgcttgaattgtgttccctcaaaattcgtgtgttgaagctttgatcccccaggacctcagaatgtgactgtgtttggagttggggtgtttaaagaggcgattaaggtaaaatgaggtcattagggtgggccctaatctaacaggactggggtccttataagaagaggagatgaggacacagacacacacagagggacgaccctgtgggacacagggagaagacggcgtctccaagcccaggagaggggcctcaggaggaaccagcactgcccacacctggatctcagacctccagcctccagggctgtgggagaatcaatgtgttttgtttctaagccgcccagcctctggtattctgtgacagcagcctgagatggactaagccatctcataagaagagacgaggacacagacacacacagagggacgaccctgtgagggcacagggagaagacggcgtctccaagcccaggagaggggcctcaggaggaaccagcactgcccacacctggatctcagacctccagcctccagggctgtgggagaatcaatgtgttttgtttctaagccgcccagcctctggtattctgtgacagcagcctgagatggactaagacatctcataagaagaggagatgaggacacagacacacacagagggacgaccctgtgagggcacagggagaagacggcgtctccaagcccaggagaggggcctcaggaggaaccagccctgcccacacctggatctcagacctccagcctccagggctgtgggagaatcaatgtgttttgtttctaagccgcccagcctctggtattctgtgacagcagcctgagatggactaagacatctcataagaagaggagatgaggacacagacacacacagagggacgaccctgtgagggcacagggagaagacggcgtctccaagcccaggagaggggcctcaggaggaaccagcactgcccacacctggatctcagacctccagcctccagggctgtgggagaatcaatgtgttttgtttctaagccgcccagcctctggtattctgtgacagcagcctgagatggactaagccatctcataagaagagacgaggacacagacacacacagagggatgaccctgtgagggcacagggagaagacggcgtctccaagcccaggagaggggcctcaggaggaaccagcactgcccacacctggatctcagacctccagcctccagggctgtgggagaatcaatgtgttttgtttctaagccgcccagcctctggtattctgtgacagcagcctgagatggactaagacatctcataagaagaggagatgaggacacagacacacacagagggatgaccctgtgagggcacagggagaagacggcgtctccaagcccaggagaggggcctcaggaggaaccagccctgcccacacctggatctcagacctccagcctccagggctgtgggagaatcaatgtgttttgtttctaagccgcccagcctctggtattctgtgacagcagcctgagatggactaagccatctcataagaagagacgaggacacagacacacacagagggacgaccctgtgaggacacagggagaagacggcgtctccaagcccaggagaggggcctcaggaggaaccagcactgcccacacctggatctcagacctccagcctccagggctgtgggagaatcagtgttttgtttctaagccgcccagcctctggtattctgtgacagcagcctgagatggactaagccatctcataagaagagacgaggacacagacacacacagagggacgaccctgtgagggcacagggagaagacggcgtctccaagcccaggagaggggcctcaggaggaaccagccctgcccacacctggatctcagacctccagcctccagggctgtgggagaatcaatgtgttttgtttctaagccgcccagcctctggtattctgtgacagcagcctgagatggagtaagacatctcataagaagaggagatgaggacacagacacacacagagggacgaccctgtgggacacagggagaagacggggtctccaagcccaggagaggggcctcaggaggaaccagccctgcccacacctggatctcagacctccagcctccagggctgtgggagaatcaatgtgttttgtttctaagccgcccagcctctggtattctgtgacagcagcctgagatggactaagccatctcataagaagagacgaggacacagacacacagagagggacgaccctgtgaggacacagggagaagacggcatctccaagcccaggagaggggcctcaggaggaaccagcactgcccacacctggatctcagacctccagcctccagggctgtgggagaatcaatgtgttttgtttctaagccgcccagcctctggtattctgtgacagcagcctgagatggactaagacatctcataagaagaggagatgaggacacagacacacacagagggacgaccctgtgaggacacagggagaagacggcgtctccaagcccaggagaggggcctcaggaggaaccagccctgcccacacctggatctcagacctccagcctccagggctgtgggagaatcaatgtgttttgtttctaagccgcccagcctctggtattctgtgacagcagcctgagatggactaagccatctcataagaagagacgaggacacagacacacacagagggacgaccctgtgagggcacagggagaagacggcgtctccaagcccaggagaggggcctcaggaggaaccagccctgcccacacctggatctcagacctccagcctccagggctgtgggagaatcaatgtgttttgtttctaagccgcccagcctctggtattctgtgacagcagcctgagatggactaagccatctcataagaagagacgaggacacagacacacacagagggacgaccctgtgagggcacagggagaagacggcgtctccaagcccaggagaggggcctcaggaggaaccagccctgcccacacctggatctcagaactccagcctccagggctgtgggagaatcaatgtgttttgtttctaagccgcccagcctctggtattctgtgacagcagcctgagatggactaagacatctcataagaagaggacatgaggacacagacacacacagagggacgaccctgtgggacacagggagaagacggggtctccaagcccaggagaggggcctcaggaggaaccagccctgcccacacctggatctcagacctccagcctccagggctgtgggagaatcaatgtgttttgtttctaagccgcccagcctctggtattctgtgacagcagcctgagatggactaagacatctcataagaagaggagatgaggacacagacacacacagagggacgaccctgtgggacacagggagaagacggggtctccaagcccaggagaggggcctcaggaggaaccagccctgcccacacctggatctcagaactccagcctccagggctgtgggagaatcaatgtgttttgtttctaagccgcccagcctctggtattctgtgacagcagcctgagatggactaagacatctcataagaagaggagatgaggacacagacacacacagagggacgaccctgtgaggacacagggagaagacggcgtctccaagcccaggagaggggcctcaggaggaaccagccctgcccacacctggatctcagacctccagcctccagggctgtgggagaatcaatgtgttttgtttctaagccgcccagcctctggtattctgtgacagcagcctgagatggactaagccatctcataagaagagacgaggacacagacacacacagagggacgaccctgtgagggcacagggagaagacggcgtctccaagcccaggagaggggcctcaggaggaaccagccctgcccacacctggatctcagacctccagcctccagggctgtgggagaatcaatgtgttttgtttctaagccgcccagcctctggtattctgtgacagcagcctgagatggactaagccatctcataagaagagacgaggacacagacacacacagagggacgaccctgtgagggcacagggagaagacggcgtctccaagcccaggagaggggcctcaggaggaaccagccctgcccacacctggatctcagaactccagcctccagggctgtgggagaatcaatgtgttttgtttctaagccgcccagcctctggtattctgtgacagcagcctgagatggactaagacatctcataagaagaggacatgaggacacagacacacacagagggacgaccctgtgggacacagggagaagacggggtctccaagcccaggagaggggcctcaggaggaaccagccctgcccacacctggatctcagacctccagcctccagggctgtgggagaatcaatgtgttttgtttctaagccgcccagcctctggtattctgtgacagcagcctgagatggactaagacatctcataagaagaggagatgaggacacagacacacacagagggacgaccctgtgggacacagggagaagacggggtctccaagcccaggagaggggcctcaggaggaaccagccctgcccacacctggatctcagaactccagcctccagggctgtgggagaatcaatgtgttttgtttctaagccgcccagcctctggtattctgtgacagcagcctgagatggactaagacatctcataagaagaggacatgaggacacagacacacacagagggacgaccctgtgggacacagaagacggggtctccaagcccaggagaggggcctcaggaggaaccagccctgcccacacctggatctcagacctccagcctccagggctgtgggagaatcaatgtgttttgtttctaagccgcccagcctctggtattctgtgacagcagcctgagatggactaagacatctcataagaagaggacatgaggacacagacacacacagagggacgaccctgtgagggcacagggagaagacggcgtctccaagcccaggagagaggcctcaggaggaaccagccttgcccacacctggatctcagacctccagcctccagggctgtgggagaatcaatgtgttttgtttctaagccgcccagcctctggtattctgtgacagcagcctgagatggactaagacacctcataagaagaggagatgaggacacagacacacacggaggaacaaccctgtgaggacacagggagaagacggcatctccaagcccaggagagaggcctcaggaggaaccagccctgcccacacctggatctcagacctccagcctccagggctgtgggagaatcaatgtgttttgtttctaagccgcccagcctctggtattctgtgacagcagcctgaaacggactaagacatcccataaaaaggagatgaggacacagacacacacggagggacgaccctgtgggacacagggagaagacggcgtctccaagcccaggagaggggcctcaggaggaaccagcactgcccacacctggatctcagacctccagcctccagggctgtgggagaatcaatgtgttttgtttctaagccgcccagcctctggtattctgtgacagcagcctgagatggactaagccatctcataagaagagacgaggacacagacacacacagagggatgaccctgtgagggcacagggagaagacggcgtctccaagcccaggagaggggcctcaggaggaaccagcactgcccacacctggatctcagacctccagcctccagggctgtgggagaatcaatgtgttttgtttctaagccgcccagcctctggtattctgtgacagcagcctgagatggactaagacatctcataagaagaggagatgaggacacagacacacacagagggacgaccctgtgagggcacagggagaagacggcgtctccaagcccaggagaggggcctcaggaggaaccagccctgcccacacctggatctcagacctccagcctccagggctgtgggagaatcaatgtgttttgtttctaagccgcccagcctctggtattctgtgacagcagcctgagatggactaagccatctcataagaagagacgaggacacagacacacacagagggacgaccctgtgaggacacagggagaagacggcgtctccaagcccaggagaggggcctcaggaggaaccagcactgcccacacctggatctcagacctccagcctccagggctgtgggagaatcaatgtgttttgtttctaagccgcccagcctctggtattctgtgacagcagcctgagatggactaagccatctcataagaagagacgaggacacagacacacacagagggacgaccctgtgagggcacagggagaagacggcgtctccaagcccaggagaggggcctcaggaggaaccagccctgcccacacctggatctcagacctccagcctccagggctgtgggagaatcaatgtgttttgtttctaagccgcccagcctctggtattctgtgacagcagcctgagatggagtaagacatctcataagaagaggagatgaggacacagacacacacagagggacgaccctgtgggacacagggagaagacggggtctccaagcccaggagaggggcctcaggaggaaccagccctgcccacacctggatctcagacctccagcctccagggctgtgggagaatcaatgtgttttgtttctaagccgcccagcctctggtattctgtgacagcagcctgagatggactaagccatctcataagaagagacgaggacacagacacacacagagggacgaccctgtgagggcacagggagaagacggcgtctccaagcccaggagaggggcctcaggaggaaccagccctgcccacacctggatctcagacctccagcctccagggctgtgggagaatcaatgtgttttgtttctaagccgcccagcctctggtattctgtgacagcagcctgagatggactaagacatctcataagaagaggacatgaggacacagacacacacagagggacgaccctgtgggacacagggagaagacggggtctccaagcccaggagaggggcctcaggaggaaccagccctgcccacacctggatctcagacctccagcctccagggctgtgggagaatcaatgtgttttgtttctaagccgcccagcctctggtattctgtgacagcagcctgagatggactaagacatctcataagaagaggagatgaggacacagacacacacagagggacgaccctgtgggacacagggagaagacggggtctccaagcccaggagaggggcctcaggaggaaccagccctgcccacacctggatctcagacctccagcctccagggctgtgggagaatcaatgtgttttgtttctaagccgcccagcctctggtattctgtgacagcagcctgagatggactaagacatctcataagaagaggacatgaggacacagacacacacagagggacgaccctgtgggacacagaagacggggtctccaagcccaggagaggggcctcaggaggaaccagccctgcccacacctggatctcagacctccagcctccagggctgtgggagaatcaatgtgttttgtttccaagccgcccagcctctggtattctgtgacagcagcctgagatggactaagacatctcataagaagaggacatgaggacacagacacacacagagggacgaccctgtgagggcacagggagaagacggcgtctccaagcccaggagagaggcctcaggaggaaccagccttgcccacacctggatctcagacctccagcctccagggctgtgggagaatcaatgtgttttgtttctaagccgcccagcctctggtattctgtgacagcagcctgagatggactaagacacctcataagaagaggagatgaggacacagacacacacggaggaacaaccctgtgaggacacagggagaagacggcgtctccaagcccaggagagaggcctcaggaggaaccagccctgcccacacctggatctcagacctccagcctccagggctgtgggagaatcaatgtgttttgtttctaagccgcccagcctctggtattctgtgacagcagcctgaaacggactaagacatcccataaaaaggagatgaggacacagacacacacggagggacgaccctgtgggacacagggagaagacggcgtctccaagcccaggagaggggcctcaggaggaaccagccctgcccacacctggatctcagacctccagcctccagggctgtgggagaatcaatgtgttttgtttctaagccgcccagcctctggtattctgtgacagcagcctgagatggactaagacatctcataagaagaggagatgaggacacagacacacaccaagggacaaccctgtgggacacggagaagacggggtctccaagcccaggagagaggcctcaggaggaaccagccctgcccatgcccatctcttgatcttggacctgcagcttccaggactgtgggagaatcaattccttttttctttttcttttttcttttttttcctctttttctgagatggagtctcactctgtcgccaggctggagtgcagtggcgtgatcttggctcactgcaacctccacctcgcaggttcaggccattctcctgcctcagccttctgagtagctgggatgacaggcgcccgccaccacacccggctactgtttgtatttttattagagacgggctttctggccatgttggccaggctggtctcatactcccgacctcaggtgatccgcccgccttggcctcccaaagcgctgggattacaggcgtgagccaccgcgcccggccaaattccttttttctgaagccaccaagctgtgggacttttttatggcagtcccagcagacagatccaccctcgttccaaataaggttatcgtcataggttctgggggtgaggtcatagatgtatgtttttttttttttttggagagagagtctctctctattgcccaggctggagggcagtggcgcgatcacggctcactgtagcctcgacctcctgggctcaagcgatcctctcgggaggctaagagaggagaatcgtttgaatccgggaggcagaggttgcagtgagctgagatagcaccacagcactgcagagcgagactctgtctcaaaaaaaaaaaaaagaaaaaagaaaaaaaataggccgggtgcgtggctgacgcctgtaatcccagcactttgggaggccgaggcgggtggatcacttgaggtcaggagttcaagaccagcctaacgaagatggtgaaaccccatctctatgagaaatacaaaaattacccgggcgtggtggcgggcgcctgtagtcccagctactcgggaggcaggggcaggagaatcgcttgaacctgggaggtggaggttgtgagctgagatcgtgccactgcactccagcctgggcgacaaaacgagactccatctcaaaaaaaaaaaaaaaagaaaaagaaaaagaaaaaattaacacacacacacaaattccatgataaacacaaaatcaagttcaaagcacgcacgccagtgctgcctctgctgcccctccatgctgcccacacccaaagcacctgccggcctgctgggcacagtggaagtccctggcgctccccgtgtcccgagcaccaggcagacagggatccctggtggtctttccgctcccttagggttccagactggggctgggaggtccggaagtcgctcccggtcctggtactcaggtggcctgcaggtggcccgcaggtggtcacggtctctgtgcaggtggcactactggggtgtccccccctggacgccaccccatatggcagccacctctctgcttcccagggccccggggagagcttacagtccctggtccccccaggacggcccccggtctgtgaccctctcaccctttacccctagagtgcgaccaggaggagggcgcaaacacacgtgcctggcggacgtcgctgctgatcgcgctggggacgctgctggccctggtctgtgtcttcgtgatctgcagaaggtgagccctcgagggcgtccgcgagcgtcgcttgtttccagtgtgaccctgaaagttattcacagaaccatcctgagaattatcattattatttttgtgatggagtctcgctctgtctcccaggctggagtgcagtggcacgatctgggctcactgcagcctctgcctcctgggttcaggcgatcctcctgcctcagcctcccaagtagctgggattacaggcacccagcaacacacccagctaatttttgtatttttagtagagacggggttttgccatgttggccaggctggtcttgaattcctggactcaggtgatccacctgcctcagcctcctaaagtgctgggattacaggcgtaagccacctcgcctggcccatattattattattgttatgattattattattttttgagtcttgctctgtcacccaggctggagtgcagtggctcgatctcggctcaccgcagcctccacctcccgggttcaagtgattctcctgcctcagcctcccgagtagctgggattacaggtgtgcaacactgcacccaactaattcttgtatttttagtggagacggggtttcaccatgttggccacactggtgttgaactcctggcctcaagtgatcccccagcctcggcctcccaaagtgctgggattacaggcgtgagccaccgcacctggccccttgagaattattcacaaaagaccaggggccaggtcctctctgctagctgccccctgccaggaggtctgtagagccaaagctgagggctctggtgggaccaagggtgtccccagggtggaggaagcagggccggtcctcccctgccctgcccagcgggcctgacacagtcagagggcgaaaggccaggctttctggtcgggaaggggcctgggcgaacgtcacagctgtccacttggatgggccaggatccgtcatgcagaccaactcgaggtttttggtcaccagctgggtcaccccaggtcctgtctccttttttttagagaaggagttttgcttttgttgcccagcctggagtgcaatggcgccatctcggttcactgcaacctctgcctcctgggttcaagcgattctcctgcctcagcctccctgagtagctgggattacaaggatgtgccaccacgcctggctaattttgtatttttagtagagatggggtttctccgtgttggtcaggctggtcttgaactcctgacctcatgtgatccacccgcctcggcctcccaaagtgctgggatgacaggcgtgagccaccatgcccggataattttgtattttcagtagagacggagtttctccgtgttgatcaggctggtcttgaactcctcacctcagttgatctgcccgcctgggcctcccaaagtgctgggatgacaggcgtgtgccaccatgcccagataattttgtatttttagtagagatggagtttctccatgttggtcaggctgttctcgaactcctgacctcagttgatctgcccgcctgggcctcccaaagtgctggcattacaggcttgagccaccatgaccagccaggccctgtttccttcctgctgggcatcagagcttcacaatctgtcaaatgggtgccatggtgacttctgtctcccgggggaagggggaaaaggggagggggagggggaaggggaagaggggggaggaggggggaagggaggagggggaagggaggggggaaaggagggggaagggaggagggggaagggaagagggggaggagggggaaggggaggaggaggagggggaggagaggcgagggggagggtgggggagggggaagggggaggaggagaggggaggatgagtggggagggggaaggagggagagggggagggggagagggaggggtaggggggaaggggtggaggagggaggaaaagggggaggaagagggggacgaggcccttcctgcaagctgtctcaggtcgtaaactcagtgacctgaggcaccaggggtctgtctttgcagctgcacccctgggtggctccggtaccagcgccctactcctttaattagacaccagcgcctgcctatgatgatggtcgggggcgtgtcagggcctcaggggccgggaaaatagagacccctcgagtagatgacttgagtcttttgctctgtcctggcactgtctgtcctggacacgctgtgtcccagatgatgagctggtcggttttgggttcagagctgggccatttctctttcctccgaggtatctggtgatgcagagactctttccccgcatccctcacatgaaagaccccatcggtgacagcttccaaaacgacaagctggtatgttgttttttctgccttgggacgggtctggaggcgtggtggccactttgggaggcccaggcgggcggaccacttgaggccaggaactggagaccagcctggccaacatggagaaactccgtgtctactaaaaatacaaaattagccgggtgtggtggcgggcgcctgtaatcccagctactcgggaggctgagggaggaggatcacttgaacccgggaggtggaggctgcagtgaactacgatcgagccactgcactccatctgggcgacaagagtgaaatggcctggactaggaggctggacacctgtctgctggcgctggtgggcggctgggaaaagctgcaggatgaagggagtggggggacactgggctcccagcccaccgtgatcacgggccgtctccgcaccctgcacaccagagcagagcagatttttttttttttttttagatggagttttgctcttgttgcccaggctagagtgcaatggtgcgatcttggctcaccacaacctccaccttcccagtccaaggttcaagcgattgtcctgcctcagcctcccgagtagctgggactacaggcacgcaccgacacgcccagctaattttgtatttttagtagagacggggtttcaccatgttggccaggatggtctcgatctcctgaccttgtgatccccctgcctcggcctcccaaagtgctgggattacaggcatgagccaccatgcccagcctagttttcaacaagtttttagtgatacctgtgtccctaagagaaaggaagggcagaggaaaaggaggcagacatctctgtcagagttttttgttttgttttgttttgtttgtttttgtttttgagacgcagttttgttcgttgccccggctggagtgcaatggtgcaatctcggctcactgcaacctccaccttcccggttgaaggttcaagcgattctcctgcctcagcctcccaagtagctgggactacaggcatgcaccaacacacccagctaattctgcatttttagtagagaaggggtttcaccatgttggccaggatggtctggatctcctgaccttatggtccgctcgcctcggcctcccaaagtgctgggattacaggtgtgacccaccgcgcctggcccaaagtgctgggatgacaggcgtgagacaccatgcctggcccacagagcagatctgagatgggacaggcccccgcagatcaggacgtgggctctgttatctggggggtggccgactcaccctgcctcctctcgtctctgcaggtggtctgggaggcgggcaaagccggcctggaggagtgtctggtgactgaagtacaggtcgtgcagaaaacttgagactggggttcagggcttgtgggggtctgcctcaatctccctggccgggccaggcgcctgcacagactggctgctggacctgcgcacgcagcccaggaatggacattcctaacgggtggtgggcatgggagatgcctgtgtaatttcgtccgaagctgccaggaagaagaacagaactttgtgtgtttatttcatgataaagtgatttttttttttttaa

SEQ ID NO: 2878 - DNA, 19535 bp, human
ttcggggaaagctgctttcagcgcacacgggaagatatcagaaacatcctaggatcaggacaccccagatcttctcaactggaaccacgaaggctgtttcttccacacagtactttgatctccatttaaggtaaggtcccccctccagggtgggatgagggaaaaagagggcaggcaggggaggcggtggactgtgggttcccaaatccaagctggcagacacggggcattggcatgtaacaggtttctgctgagacctgctgtccgtgtgggcaccacaccacacatagaatgacccggtaccagagaagtatgtttgcgatctcattcacccttttgtaagtggatcggacgctgaagccatcatagcatgttagatgccttgggtttataaaggtgatagcattaggagtaatttgacagtgctttctgctttttctgtgtgcttgctagaaaatgtacacacctacacatggctagagttctctgtttattagaaagcgctggttcagttagtcaatgagctcacgcccagggcgagctgactgccagccggggagccgcttttggggctgggaccccagcctgcttgtagtgtttctcagtggttttcaaaggctggcgggactcagaatgttccagatggctggtgaaacctcaggtccctcctagcagctttattcacagtagccaagaggtggagacagccctcgtacccatctatagatgaatggaaaaatataatgtccatccacacagtggaatattacgcagccatgaaaaggaacaagcagctttattcacaatagccaagaggtggagacagccctcatacccatctatagacgaatggataaatataatgtggtccagccacacggtggaatattacacagccatgaaaaggaacaagcagctttattcacaatagccaagaggtggagacagccctcatacccatctatagacgaatggataaatataatgtggtccagccacacagtggaatattacacagccatgaaaaggaacaagcagctttattcacaatagccaagaggtggagacagccctcatacccatctatagatgaatggagaaatataatgtggtccagccacacagtggaatattatacagccatgaaaaggaacaagcagctttattcacaatagccaagaggtggagacagccctcgtacccatctatagatgaatggagaaatataatgtggtccagacacacagtggaatattatacagccatgaaaaggaacaagcagctttattcacaatagccaagaggtggagacagccctcatacccccatctatagatgaagggagaaatataatgtccatccacacagtggaatattacacagccatgaaaaggaacaagcagctttattcacaatagccaagaggtggagacagccctcatacccatctatagatgaatggaaaaatataatgtccatccacacagtggaatattacacagccatgaaaaggaacaagcagctttattcacaatagccaagaggtggagacagccctcataccccatctatagatgaatggagaaatataatgtggtccagccacacggtggaatattacacagccatgaaaaggaataagcagctttattcacactagccaagaggtggagagagtcctcatacccatctatagatgaatggagaaatataatgtggtccagccacacggtggaatattacacagccatgaaaaggaacgaggctctgccacaggtggcaatgtgggtgaatgctgaggacatcatgcttcctgagagaggccagatacaaaaagatacatagtgtctgtatgattccatttattccctatgtccagatacaggcaaatccacagagacagaaagtggatgagtggttgccacaggctggggaagaggaaggacgggtctttaatgggtctggagtctccttttggggtcgtgacaatgttctagaagatagaagtggtggttttttttgagacagagtctcgctctgtcgcccaggctggagtgcagtggcgcgatctcagctcactgcaacctccacctcccgggttcaagcaattctcctgcctcagcctcctgagtagctgggactacaggcacccgcaactacgcctggctaatttttgtatgtttagtagagactttgtatgtttagtagagtagtagagattttgtatgtttagtatgttttgtatgttggtcaggctggtctcgaactcctgacctcaagcaatccacccccctcagcctcccaaagtgctgggattataggcgtgagccaccgcgcctggccaatgaaaatattaatcaataaatgttaagagcacagatttcccaacgttctgactcaggcatcttcctggaccacagcccctacaggcaagtgtgactgtgtgtggtgagcccatgagctgaacacaggctctgtccgaaaggagactctagagattgcctgttgccttggaggtgggctgcggtccctctgcccaggcaggaaggggctccgaggcctctggaacctcattttaccttttccctgctgccctcagtcccgtccccagcctcaaggggctcagctttttccaggctcaccccttccatttataatttggagacaagcaaggtccactgacgctaacgccatttggttctttaaaagatgttaggccgggcgcggtggctcacgcctgtcatcccagcactttgggaggccaaggcgggtggatcatgaggtcaggagttcgagaccagcctgaccaacatggtgaaacaccatctctactaaaaatagaaaaattagctgggtgtggtggcggacaccggtaatcccatctactggggaggctgaggcaggagaatcgcttgaacgtgggaggtggaggttgcagtgaaccaagatcgcgccactgcactccggcctggacaacaagagtgagactccatctcagaaaaaacaaaacaaaacaaaacaaaaaaccagaaaagacagctgccaccccagagcacagtgtaggagagccagcctttctgggatgcggcagaaagttccagtgcaggaggctgaggtcctgtacccccttgttacggtaactgcagccacttaggaatttccgtgtgttgatttcatcattgtaattatacttccttccactgctttgtcatctgagcttcctggtgtgccgcagaggatgtgttttcctggtttgtggatacagctcgagccaagaacgggctaaacccccagggcagcaactctttcttttcttttcttttttttttttttttttgagacggagtctcgctctgtcgtccaggctggagtgcagtggcgccatctcggctcactgcaagctccacctcccgggttcaactgattgtcctgcctcagcctcccgagtagctgggattataggcacactccaccacgcctggctaatttttgtatttttagtagagacggggtttcaccatgttagccaggctggtcttgaactcctgacctcgggcaatctgcccacctctgcttcccaaagtgctgggattactggcatgagccactgcacccagccggcagggcttctttcaaaagggaacggctgacacacacacagatgcatgcacatacatgcacacatacacactgatgcaaacacatttgtacacatacattcacacatgcatgcacataaatatgcacttctaggcacatgcatgcacacatacagactcatgcatgtatatttgtgtatgcacatatatttatgcacatgtgtgtacacgtggaatgcatgcacagatacatatgcattcaaacacaaagactgtgtgtacctgcatgcatgaaaacacacaaacacagccgggcacggtggctcacacctgtaatctcagcacttggcgaggaaaaggcgggcggatcacctgaggcaggagtccgagaccagcctggccaacatggtcaaatctctactaaaaaatacaaaaagtgggctggacgcggtggctgacgcctgtcatcccagcactttgggaggctgaggtgggtggatcacctgaggtcaggagttcgagaccagcctggccaacacggtgaaaccccgtctctgctaaaaatacaaaaattagccggacatggtggtgggtgcctataatcccagctactcgggaggctgaggcaggacaatcggttgaacctgggaggcggaggttgcagtgagcccagatcacgccattgcactccagcctgggcaacaagagcaaaactctgtcacaaaaaataaataaataaataaataatacaaaaattagccaggcatggtggcgagtgcctgtaatcccagctactcaggaggctgaggcaggagagtcgcttgaacctgggaggcagaggttgcaatgagccgagatcatgccactgcactccagcctggacgacaagggcgagtctccatcaggaaaaaaaaaaaaagaaaacacacaaacacttatgtgtgcacacagatacacacgggcacaaaaatgtacacacgtgcaagcacacacacacacagacacatgtacacagtacccgtgtgtgcacaggcatgcatgcagtcctgcaaatgtgcaaacagacatggctacatagaggcatgcacacatatagacccatgtacacacacacgaatattcgtgcacacatgtagaagcacactctgatgtgcatgcatgtgcaaaggcgcatttgcacacagacacatatgcacactcaccaccgctttccctccagaagcagctccttctgctgtgagcaccaggctctggaaggggcaagcatccttcattacccgcaacccagtttcacagccagtccccgctgcctgactctcgtttctcctgcagcaggcacctctgtcctgcgttccggagctgcgttcccgatggtcctcctttggctcacgctgctcctgatcgccctgccctgtctcctgcaaacgaaggaaggtaagaactggagaaaaaatgcacgtgccacctggggagcggtgggggtagacagacacacaatgtcagcgtgccgtccttcagggaaacttttcatgctgagctcatggcagagtctcatgcagtggtcgggaatgactcagacacttccctgtacccgtcaccaagttccctgtaatgcagcatcttgcaaaacggtaatacgacctcacaggcagggacctgatcgtgacacagatgccatgtgaggtgttttgatgaaactcacacgctgggatcaacagcaccaataacaatttccagtttccttcattgtttatcttactttttcattttcttattatttttattttggagacagggtcttactgtcttgcccaggctggagtgcaatagtgtgatctcggctcactgcaacctctgcctcccggattcaagcgattcttctgcctcagcctcccgaggagctgagattacagtcgcgcaccaccatacccggctaatttctgtatttttgatagagacgggatttcactatgtcggtcaggctggtctagaactgctgaccacaagtgatccgtctgccttggcctcccaaagtgctgggattacaggtgtgagccacagcgcccggccttttttttcattggtttttacagtctattactgcagggtttcactttaccttgaatttcttttaactttaatttgcttttcattctttaacttcttttttttttttttttttgacacagagtttcattctggtcgcccaggctggagtgtaatagcgtgaccatggctcactgcaacctctacctgctgggttcaattgattctcctgtctcagcctcccaagcacctgggattacaggtgtccgccaccacgcccagctaatttttctgtttttactagagacggggtttcaccgtgttagacaggatggtctcgatctcctgacctcatgatccgcctgcctcggggttgggattacacactttgggaggccaaggcaggtggacgatcacaaggtcaggagttcgtgaccagcctgactaacacggtgaaaccccgtctctactaaaaatacaaaaatcagctgggcgtggtggcgggcgcctgtaatcccagttactcgggaggctgaggcaggagagtcgcttgaacccgggaggaggaggttgcagtgagcctagatcacgccattgcactccagcctgggcgacagagtgagactccgtctcaaaatgaatgaatgaatgaatgaatttcttataagaatttttttccccagacagtttgttttaagggataaattatccttctaagttagaagaaaataatgccagaagtctagacattcttatgctttggtcccgcttatcaaaccaaggttgctgaccttgataaccactcaagatccttacagtttataaagtcatttcctcaagttttctaagtggccgatcagagataaaccctagagaaatagttgatgtatgtttctagctttgggtgaccagcaaaatgtgatagaatattgccttttactggccgggtgcaacggctcacgtctgtaatcccagcactttgggaggctgaggcgggtggatcacttgaggtcaggagttcaaaaccagcttggccatcatggtgaaaccccgtctgtactaaaaatacaaaaaaattagctgggcgcggtgctgtgcacctgtaatccctgctactcaggaggctgaggcaggagaatcacttgaacccgggaggcggaggttgccgtgagccaagatcacgccattgcactccaacctgggtgacagagcgaggctccatctcaaaaaaaaaaaaaaaaaaagaatattgcctttaacatctttgtacaggtcatttatgaaatatcttgagctctgtgatggctaagagagaccttctttttctttctttcttttttttttttttgagacggagtttttttgtttttttgagatggagtctcgctctgttacccaggctggagtgcagtggcacgatctcagctcaccgcaacctccgcctcccgagttccagtgattctcctgcctcagcttcctgattagctgggattacaggcgcccgccaccacgcccaactaatttttgtatttttagtcgcgacggggtttcaccgtgttagccaggatggtcttgatcacttgacctggtgatccgcccaccttggcctcccaaagtgctgggatgacgggcgtgagccaccacgcccgtttgctttatgacttctaccagctcacagaagtctcctgtgtacatagaactccacttcccagccaggctcagtaactcacgtctgtgatcccagcactttgggaggctgaggcaggcagatcatgtgaggttgggagttcgagaccagcctggccaacatggtgaaaccccatctctagtaaaaatacaaaaattagccgagtgtggtggcaggcacctgttatcccagctgcacagcaggctgacacaggataatcgcttgaacccgggaggcggaggttgtagtgagccgagatcgcgccactgaattccagcctgggcgacagagtgagactccgtctcaaaacaaacaagcaaacaaaaatacccattacaatgttgttttaagattgttgtatatcaactgggcatggtggctcatgcttgtaatcccagcactttgagaggccgaggcggacagatcacgaggtcaggagatcgagaccatcctggccaacatggtgaaaccccatctctagtaaaaatacaaaaattagccgggcgtggtggtgggctcctgtaatcctagctactcgggaggctgaggcaggagaatcgcttgaacccgggaggtagaggttgcggtgagctgagatcgtgccactgcactccagcctgggtgacaagagcaaaactccgtctcaaaaaaataaaaaatttaaaaaaataaagaactcgacctcccaaaggtattggctaactccacgggcaaaaaaaccatacccattacaatgctgttttaagattgttgacctggtgcggtggctcatgcctgtaatcccagcactttgggaggctgaggcggacgaatcatgaggtcaggagatcgagaccatcctggctaacacggtgaaacgccatctctactaaaaatacaaaaaaaaaaaaattagccgggcgtggtggcgggcgcctgtagtcccagctactcgggaggctgaggcaggagagttgcttgaaccaggaggcggagcttgcagtgagctgagatcgtgccactgtagtccagccagggcgacaagagtgaaactccatgtcaaaaaatttaaaaaaattaaataaaagaactccacctcccaaaggtattggctaactccacgggcaaaaaaaaaaaaccataccccttacaatgccgttttaagattcttacgtatctcttcgaactccaacctgtcaccgttttagatccaaacccaccaatcacgaacctaaggatgaaagcaaaggctcagcagttgacctgggaccttaacagaaatgtgaccgatatcgagtgtgttaaagacgccgactattctatgccggtaaatcatactctctattgtttttttatttttattttatttatttatgtatttatgtatttatttattttttgagacggagtcttgctctgtcgcccaggctggactgcggtgacccgatctccgctctctgcaacctccacctcccaggtccatgccattctcctgcctcaacctcccgagtagctgggactacaggcgcccgccaccatgcccggctaatttttttgtatttttagtagagatggggtttcactgtgttagccaggagggtctcgatctcctgacctcgtgatctgcccgcctcggcctcccaaagtgctgggattacaggcgcgagtcaccgcgcatggcccagactctctaatgttgacgaacaagacgtttccgtcttctgcaggaatctcagaaccaatactgctcccatcgctggtgtcatgactacctggtttctgccccgaagtcaggtgtgggatttgaagtgactttggagggtctggttccccgtccgcgggacatctaagatggcacacactggacagggtggatgtgaaagtgaaatgaggctaagctatgactggtgcgaaacccaaccccacgctgggcgtggtggctcacgtctgtaatcccagcactttgggaggctgaggcgggcggatcatgaggtcaggagttcgagaccagtctggccaacacggtgaaacgctgtctctgctaaaaatacgaaagttagccgggcacagtggctcacaccagcactttgagaggctgaggcggatggatcacctggggccaggagttcgagactagtctgggcaacatggtgaaaccccgcctccactaaaaatataaaaattagctgggcatggtggtgggcgcctgtaatcccagttacttgggaggctgaggcaggagaatcgcttgaacccgggaggcagaggttgcattgagccgagactgtgccactgcactccagcctgggggacgagagcaagacttcatgtcaaaaaagaaaaagaaaaattagccggatgtggtggcacatgcctgtaataccagctattcaggaggctgaggcaggagaattgcttgaacctgggaggccgaggttgcactgagccgagattgtgccactgcactccagcctgggtgacagagtgagactccatctcaaaacaaaaacaaaaacaaaagcaaaaacaaaacaaaagtgtgtgctcaggaaacaaggtcctcatcacgaaatccttccaaatcccccatcttgtcatcacctgcgttctcagggtttgagaacagcgccagacctcatggggtggcccaggtgacactgtgagctatttacaagtcagtgtcttatgggaaaggagcacgtttccctgagaacctatttggtcccctccaagagctatgttcgttcaatacaattcaaatcacggcccttcatgcgtctgctcgggccaccattataaaatcctacccccagctccaaatacagtcccattgaactttgtgattttggagagtagagataaaacagtctagaatcccagagcgattttaccataccatggcaaactgactctcaactttagaaacacaaatgctgaaaaaaaaactaaggaaattttgaaaaagaaggtgaatgaaggagaacctgccttacctatatcaaaaggcactgaaaagttcatacccaatgtgcggattgctataagaatacacaagtaggccgggcgtggtggctcacgcctgtcatcccagcactttggaggccgaggcgggtggatcacgaggtcaggagatcgagaccctcctggctaacacggtgaaaccccgtctctactaaaaatataaaaattagccgggcgtggtggctggtgcctgtagtcccagctactcgggaggctgaggcaggagaatggcttgaacctgggaggcagaagcttgcagtgagccgagatcgcgccactgcactccagcctgggcgacagagcgagactctgtctcaaaaaaacaaaaacaaaagcaaacaaaacgaagaatatacaagtagattaatgaaatgtggccgggtgcggtggtgaggcaggagaattgcttgaacccgagaggtggaggttgcagtgagctgagatcgcaccactgaagtctagcctgggcaagcggagtgaggccctgtcttaacaaaaaaacaaagaaacaaaaaacaaacaaacaagaaaaaaacaaagcaaaacaaacagaaaagtatttcactaatatttactgctaagtgggattatttttattcaagcttttgtatctttagaaaaaaattgtggccgggcgcggtggctcacgcctgtcatcccagcactttgggaggccgaggagggtggatcacgaggtcaggagatcgagaccctcctggctaacacggtgaaaccccgtctctactaaaaatataaaaattagccgggcgtggtggcgggcgcctgtagtcccagctacttgggaggatgaggcaggagaatggcatgaacccgggagggagaggctacagtgagccgagatcgcgcccctgcactccagcctgggcgacagagcgagactccctctcaaaaaaaaaaaaaacagaaaaaagtcttggccgggcacggtggctcacgcctgtaatcccagcactttgggaggctgaggcaggcggatcacatgaggtcaggagttcgagaccagcctgaccaacatggtgaaaccctgtctctacccagaaaaatactttaaaaattagctgggcgtggtggcgggcacctgtaatcccaggtgctcgggaggttgaagcaggagaatggcttgaacccgggagggagaggctgcagtgagccgagatcacgccactgcactccagcgtgggcgacgagagcgaaactctgcctcaaaaaaaatctgaacatcattagcgtcaaattaagcatggtctgtcagcagccatcatagtcctatgtctctcttaggcagtgaacaatagctattgccagtttggagcaatttccttatgtgaagtgaccaactacaccgtccgagtggccaacccaccattctccacgtggatcctcttccctgagaacagtgagaaaaatgttcattgtttgtttattctctattccctccctccttccctctctccctccctctcgccttcgctgtgtcttttttcttttctttttctctttctttctttctttctttctttctttctttctttctttctttctttttctttctttctgtttctgtttctttcttcctttctttttctttctttctttccttctttcctctctttcttttctttctctttccctccctcccttctttcttttcttcacttccttccctccctccttctctccttttcctccctcctccttcccaccctacttcctctctctccttccttccctttcgttttcttttcctccctgcctcactcccttccttccttctctccctcctcttttccttccttcttccctccttccctttctctctctctctctttctctctttccccctcccctcccttcccctcctctcccctctcctttcctgacacggtcttgctctgttgcccaggctggagcgcagtggtgcaatcacagcttactgcaggcttcacctcctgagctcaaacaatccttctgcctcagcctcccacgtaggtggaactacacccatgtaccaccatgcccacctaattttttaaacacctttttttttttttagacagagtctcactctgtccaccaggctggagtgcactggcgcgatctcggctcactgcaacctctggctcccgggttcaagcgattctcctgcctcagcctcccgagtagctgggattataggcgcccaccgccacgcccagctaattcttgtatttttagtagagatggggtttcaccatgttggtcaggctggtctcaaactcctgacttcgtgatctgcccgcctcggcctcccaaagtgctgggagtacaggggtgagccaccgcgcccagccttaaatactttttgtagagatggggtgtcgctatgttacctgagctggtctcaaactcctaggctcaagtgatcctcccgcctcagtctcccaaagtgcagggattgtaagcatcagccaccacgcctggcctcttctttgttttttaattaattagaagtccatggtttatttttttgttttgttttgtttgtttttctgtgatggagtcttgttcttgtcgcccaggctggagtgcagtggtgcgatttcagcttaccgcaaactccgcctcccgggttcaagcgattctcctgcctcagcctcacaagtagctgggattacaggcacccgccaccaagcccggctaaattttgtattttaagtagagacggggcttcaccatgttggtctcgaactcctgaccttgtgatccacccgcctcagcctcccaaagtgctgggatgacaggcgggagccactgtgccgggcctcaatttaattatttttaagtttaatggatttccagggagttatgccgagtcggaaaaaaaagaccactccagagcgtgacacacacagtgatttcattaatacaactgtcttgaaatggcaaaattttacaaatagaaaacagtctcctgggttgcagggatataagcaggagtgagagctgagagaggtgggtttggctgtaaaagtgctccttggggaggccgggcgcagtggctcacgcctgtaatcccagcactttgggaggccgaggcgggcggatcacctgaggtcaggagttcgagaccagcctggccaacatggtgaaaccccgtctctactaaaaacacaaaaattagccgggcatggtggctcacgcctgtaatcccagcactttgggaggccgaggcaggcggatcacctgaggtcaggaattcgagaccagcctggctaacatggtgaaaccccatctctactaaaaatacaaaattagccaggggtggtggcacatgcctgtagtcccagctactcaggaggctgaggcaggagaatcacttgaacccgggaggcggagattgcggtgagctgagatcgtgccattgctctccagcctgggcaacaagagtgaaattccatctaaaaaaaaaaaaaaattaaaaagaaattagcggccgggcccagtggctcacacctgtaatcccagcactttgggaggccgaggtgggtggatcgcgaggtcaggagatcgagaccatcccggctaacatggtgaaaccccatctctactaaaaatacaaaattagccaggggtggtggcacatgcctgcagtcccagctactcaggaggctgaggcaggagaatcacttgaacctgggaggcggaggttgtggtgagccattgagctccagcctgggcaacaagagtgaaactctgtcttaaacacacacacagatgcacacacacgcacacacacacaaacaatgaaagaaaaacatctgtagtcccagcagtttgggaggctgaggcgggtggatcacttgaggtcaggaattcgcgaccagtctgggcaacatggtgaaaccccatctctactaaaaatacaaaaattagctgggtgtggtagtgggtgcctgttgtcccagatacttgggaggctgaggcaggagaattgcttgaacccgggaggtggaggttgcagtgagccgagatggcgccattgtactccagcctaggcgacggagcgagactctgtaaaaatgaataaataaatcattaaaagaatatgcaggatctctccatattattattattttttacaacggcttgtgtatctaccatggtctcaaaatacaaaaggcactctaaaaaggaattagagttttatttttttttttgagacggagtctcgctcttgtcacacaggctggagtgcagtgacgtggcctgggctcactgcaacctctgcctcctgggttcaagaaattctcctgcctcagcctccctagtagctgggattacagcggcccgacatcacgcccggctaatttttgtatttttagtagaggcagggtttcaccatgttagccaggccggtctcgaactccggacctcaggtgatcctcctgcctcggcctcccaaagtgctgggattacaggcgtgagccaccatgcctgggtttgtttttttatttttttgagacgaaggctcactctgtcgcccaggctggagtgcagtggcgtgatctcagctccatgcaacctctgcctcctgggttcaagaaattctcctgcctcagcctcccgagtagctgggattacagcggcccgacatcacacctggctaattttttatatttttagtagagactgggtttcaccatgttagccaggctggtctcgaactccggacctcgggtgatccacctgcctcggcctcccaaagtgctgggatcacaggcgcgtgccaccagacacagctaatttttgcatttttagtagagattgggtttctccatgttggccaggctggtctcgaactcctgacctcatgtgatccacccgcctcggcctcccaaaatgctggggtgacaggcgtgagccaccgcgcccggtcccgattcgagttctctttcatgtttgtgaacccaggtgggaagccttgggcaggtgcggagaatctgacctgctggattcatgacgtggatttcttgagctgcagctgggcggtaggcccgggggcccccgcggacgtccagtacgacctgtacttgaacgttgccaagtaggtgtgcccgtgggcagaggccgggctgtccctggtgcgggtgccatcggcgtggggtcgtcccccaaccttaccgcttaccgcagcaggcgtcaacagtacgagtgtcttcactacaaaacggatgctcagggaacacgtatcgggtgtcgtttcgatgacatctctcgactctccagcggttctcaaagttcccacatcctggtgcggggcaggagcgcagccttcggtatcccctgcacagataagtttgtcgtcttttcacagattggtgagtagcccgggacactccctcccaccctcagttctgtgataccacggctttagcgccaggccagatcccacgggaccacgtggctcccaacgcagacgttggcctctcacatttccagaggctggacgttggaggtcagcgtgctggctggctgggctcctcgggaggtctcttcctggcttggagagagggtcatcttctcactgtgtcttcacgtggtgtagagagagagagagatgaagttctggggtctcttgttagaagggcactaacaccatcatgggtcccatcatgggtcataggatccctcaccatgggtcatgggaccccccatcatgggttccatcatgggtcccatcatgggtcatagaatcccccatgatgggtttcatcatgagtcatagaaccccctatcatggattccatcatgggtcatgggaacccccatcatgggtcccatcatggttcataggatcccccatcatgggtttcatcatgagtcatagaaccccctatcatggattccatcatgggtcatgggaacccccatcatgggtcccatcattggtcataggaccccctatcatgggttccatcatgggtcatgggacaccccccatcatgggttccaccatgagtcatgggatccctcatcgtgggttccatcatgggtcatgggaccccccatcatgggttccatcatgggtaataggacccccccatcatgggttccaccatgagtcatgggatcccttatcatggattccatcatgggtcatgggaccccctatcatggattccatcatgggtcatgggacccccccatcatgggtcccatcatgagtcatgggatccctcatcatgggtttcatcatgggtcataggacccccatcatggattccatcatgggtcatgggaacctccatcatgggtcccattatgggtcatagaattccccatcatgggttccatcatgagtcatgggaccccccatcatgggttccacatgggatccctcatcattggttccatcatgggtcataggatcccccatcataggtcccatcatgggttccacatgggatcccccatcataggtcccatcatgggtcatgggaccccccccatcatgggttccatcacgggtcatgggaccccccccatcatgggttccatcacgggtcatgggaccccccccaatcatgggttccatcatgggtcatgggaacccccatcatgggtttcatcatgggtcataggatcccctatcatgggttccatcatgggtcatgggaccccccccatcacgggttccatcatgggtcatgggaacccccatcatgggtttcatcatgggtcataggatcccctatcatggattccatcatgagtcatgggatccctcatcatgggttccatcatgggtcatgggacccccccccccatcatgggtcgtgggacccccacccccatcatgggtcatgggagcccccattgtgagtcatggaatccctcatcatgggtctcatcatgggccatgggtcccaccatgggtcatgggagcccccatcatgagtcatggaatccctcatcatgggtcatgggtcccatcatgggtcatgggagcccccatcatgggtcatgggtcccatcatgggtcacgggagcccccatcatgggggtccaccctcataacttcagcccacgccagtcacctcccaaagaccccaccttctaacaccgcccaaccaggggttagagcttcagtggaggaatttgggacagaaggacacacactttcagtccacgatacccgagctccgaggaacctcccaggtggtgagaatgtcaatatgcccagagctgacgtgccctgaacccaagggcagggtgctcggatgcttcagaagaggagggggaaacgaggaagaggaggagaaggacaaggagaagagaagggaggagaggaagaacatgagcagggggaggaggaggagaaggaaaagaaacagaggaaaaggagggggaggaggtagagatggagagggaaggaagaggaggaagagaagaaaacggagaaagaggagggggaggaggaggaggaagagaaaatggagaaagaggagggggaggaggtggagatggggaggggaggaagaggaggaagagaagaaaacaggagggggaggaagagaagaaaatggagggaaaggagggggaggaggtggagatggggagagaaggagcaggaggaggagaagaaagaagaggaagaaaggaggaggagagggtggaggaggaagagggtgaaggagagagggaggagaatggagaggaggaggaggcgggggagggaagagaaggaggtgaggaggaggaaggggaggatagagaaggtggggtagaagggtggtgaggtggggagggagaaggagggggaggaggagagaggaggactggggggaggaagggggaggaggggagagaggaggagggaggagggagaaggagggggagaggatggaggaaggggagcagatggaggaaggcgagcaggagggggaggaaaaaggaggggcaggaggaagaaggagcgggaggagaggaggaggaggaggaggagaatgggcagggaggaggagagggaagaaaaggagggggaggaggaaggagggggaggagggtggagggggaggagggtggagggggaggagggtggagggggaggaggaaggagggagaaggaggggagaggatggaggaagaggagcaggagggggaggaaaaaggaggaggggcaggaggggaggaggagaaaggagagtggaggaggagggtgacaaggagaatggggaggagagaggagtggtagaaaaaggagagagaggaagagtaggagcggagggggaggaggggaggggaggggaggggagaaagaccaggagggtaggaggagggggaggaggaggagggggccagggctggacttccttccaggggcccaggggagacccagccaggcagccggacacacagggctgggctggtagtcgggtcacacctgaggatgtggaagtgcctggggttcccgggaagtggaggatgtcctgggccactgggagaggcggcacatcccctggggggcggaggtgggggaggtgagaagccaggcaggggccaggaagtggaagcttcaggaggatgtgtgcaggtcaaagtgtaggagtctgcatcttgaatgatgcagagagggcctccaaggctccagtgtgctgcaggtgggcagagggggcatgggaagtaggggttggccctgggcaggggtggggagtgggccaggctgcccagcggggctgagcctagagatggaaggggcagggacaaagatgtgcagctgccagtccttggaaaagctgaacgcctggtacttcagagaacaaaagggtggttctgaaggctgctcccaggacagtggggctccgagggtgcaaccccaaggctcactcctcccagtgcccccaacgcggctcagtcctgtgtctctgcctgtagagtttctttgttccctcttccttcctggtgtttttctctcccgctctccaaatgcataggagaagtaatttgaagtatctccagaaaaaaaaagagaaaaagaaaaagaattgatttcttgtactcctaaatcctaaaagtgtttttctcgttgctagagatattaactccacccaacatgactgcaaagtgtaataagacacattcctttatgcactggaaaatgagaagtcatttcaatcgcaaatttcgctatgagcttcagatac

SEQ ID NO: 2879 - DNA, 40699 bp, human; identical to SEQ ID NO: 2876

SEQ ID NO: 2880 - DNA, 46069 bp, human; identical to SEQ ID NO: 2877

SEQ ID NO: 2881 - DNA, 19535 bp, human; identical to SEQ ID NO: 2878

SEQ ID NO: 2882 - DNA, 27863 bp, human
gaggctccggaagccacggctggattggagacaagatgggatcctcagaggaccaggcctatcgcctccttaatgactacgccaacggcttcatggtgtcccaggtaggatacgctctgtgggacaagggggaatagacttccgttcatcacactcacgttccattgttgtgtcagtcgagaaaaatgatgagtctccatcattttaggaggtttattttccaccgtgaaagacgtacacccacgatgtagcctcaggagttcctgaggacatgtgcccagggtggtctggggacagcttggtttgatacattttacagagacatgagtcatcaatcaatgtatgtaagtacattgggccagtcgtggtggctcacacctgtgatcccagcactttgggaggctgaggcgggcggatcacctgaggtcgggagttcgagaccagcctgacccacacagagaaaccccatctctactaaaaatacaaaattagccaggcttggtggtacatgcctataatcccagctacttgggaggctgaggcaggagaatcgcttgaacctgggaggcggaggttgcagtgagccgagatcgcaccactgcactcccgcctgggggacacagcaagactctgtgtcaaaaaaaaaccaaacaaacaacaaaaaaaaagaaacaaagcttaagatgaaatacataggattagaaacaagacaatgtttattgaactgcaagtgttgaaatttttaaaacatttcatgatagagtagtatatgtggttgtttattaacccagtaaataattacactgtgcgtttatcatagaggtgagttttgagggttcacccgtagaggagcaacacctcattccttttttttatttttttgagctggagtctcactctgtaacccaggctggagtgcagtggcacggtcttggctcactgcaacctccgcctccagggttcaggctattctcctgcttcagcctcccgagtatctgggattacaggcacccaccaccacgcccggctaatttttgtatttttagtagagatggggtttcaccatgttggccaggctggtctcgaactcctgacctcaagtgattcacctgcctcggcctcccaaggcctcatttcttcttctcacagaataacatcgtgctcagtgaaggaaggctgacgtgaaaggccccatatggtatgacttcatttatatgaaatgtgcagagcaggcaaatccttcgaggtggaaagtggactggtggtttgcagaggctgggcaggactgcggagggagtgtttaacggagacagtgtccctttttggggtgatgcaaatgttctggaacccggcggaagtgctggctatacaacatcacgaatgtactaagtgcccctgaattatgcttgaaaagggttaatgatggccgggctcagcggtgacacctgtcatcccaacggtttgggggtccgaaacgagggaatcgctttagcccaggaattcgagaccagtctgggcaacatagtgagaccccccatttctacaaattcttttttctttttgagacagagtctcgctctgtcgcccaggctggagtgcaatggcacgatctcggctcactgcaagctccacctcccaggttcacgccattctcctgcctcagcctcccgagtagctgggattacaggcacccgccaccacgcccggctaattttttgtatttttagtagagacggggtttcaccgtgttagccaggatggtctcgatctcctgacctcatgatccgcccgcctcggcctcccaaagtgctgggattacaggcgtgagccactgtgcctggccaaaaatattttaaaaattagccaggtggggtggtgcacacctgtagtcccagctactcaggaggctgaggcgggaggatcgcttaagcctaggagatgaaggctgcagtgagctatgattgcaccactgcactccagcctggatgacagagcaatactgagtctctttaaaaaataaacggcagggcgcggtggctcatgcctgtcatcccagcactttttggggtccaaggtgggcggatcacttgaggtcaggagttcaagaccagcctggccaacatggtgaaaccccgtctctactagaagtataaaaattagccaggcatgatggtgggcacctgtcatcccatttactcgggaggctgaggcaggagaattgcttgaacccggaggaggtagaggttgcagtgagccgagattatgccactgcactccagcctgggtgtcgcagtgagactctgtctcagaacaaaaaccaaaaaccagcatcatcgtgaaagggggtcgtgtgctgacgatattttgagatgtctgcagcagctctcgtgtgacttgaaaatatctgtggtttctctccgtcagcaagccaccggttttttttgtttgtttttttcctttttttttttcagacagagtttccctcttgtcgcccaggctggagcgcagtggcgctatctcggctcactgcaacctctgcctcccgggttcaagcgattctcctgcctcagcctcccgagtagctgggagtacaggcgcgttccaacacgcccagataattttgtatttttagtagagatggggtttctctatgttggtcaggctggtctcgaactcccaacctcaggtgatcctcctggcccccacactttcttctatcatggctgtggtttgccagtacgctcatggttgaagggaacaccacatcttaggaagaggtagtgaaaattagagtgaagtctcttctccttcctggtttgtagagcccgtgaattttacctctaggcccccaagggttaaaaatacctattccccagccactgatacgcagagcggcctccgcctacggggttcaagcgattctcctgcctcagcctcctgagtacctgggattacaggtgcctgccaccaagcctggctaacttttatttttatttttatttttatttatttttctgatatggagtttcactgttgttgcccaggctggagtgcagtggcatgatctcagctcactgcaacctctccctcccaggttcaagcaattcccctgccttagcctcctgagtagctgggatttcaggcgtccaccaccacgcccggctaatttttgtatttttggcagagacggggtttcatcatgttggccaggctggtgtcgaactcctgacctcgggcgatctgcctgcctcggccttccaaagtgctaggattacaggtgtgagctactgcctctggctaattttttgtagttttggtagagatgaggtttcatcatgttggccaggctggtcttgaactcctgaccttgggcaatctgcctgcctcagcctcccaaagtgctaggatgacgggcgtgagccactgacatccagctaattttttgtatttttggtagagacggggtttcatcatgttgtccaggctggtctcgaactcctgacctcgggtgatctgcctgcctcagcctcccaaagtgctaggattataggcatgagccaacatgtctggctaatttttctattttttagtaaaggtgggatttctgttactgtcccagacaacagtaacttgctacctttgcctcctttgaccgcaggcctcctgctggggctattgactgctcattcaaagactgtcgctggttcacagcggtgttcagggaggtggtctggtgggttctaaatcttggaagagcagtcactttaaggcacatgataccatgtcatgggagttgtcagaagtttcacagaaccagagttaatgcagagttaataccaccttaagaggatcaaacttagtacacccttaacagaaacaattagctaatgcagctttcatagaccaagagtgaatatcgccttaagaagataacatttagtatacccttggccaggcacagtggctcacgcctgtaatcccagcactttgggaggccgaggcgggcggatcacaaggtcaggagttcgagaccagcctggccaatatggtgaaatcccatctctactaaaaatacaaaaattacctgggcgtggtggcgggcacctgtagtaccagctacttgggaggctgaggcacgagaatggcgtgaacccgggaggtggaggttgcagtgagccgagatcacgccactgcactccagccttgggggcagagcgggaccctgtctcaaaaaaaaaaaaaaaaagtgggggctggggagggagagcactaggacaaatacctaatgtaggtgacgggttgacaggtgcagcaaaccaccatggcacatgtatacctgtgcaacaaacctgcacgttctgcacatgtaccccagaacttaaagtataataataataataataataataataataataataataaaaagtctttgggagcagaaaaaaaaaaagatcaaagttagcgtacccttaacagaaacagttaatgcacctttcatagaccaagggtgaactcagccataagaaggtaacatttaatatatgcccttaaaagaacaattaattgagacaaccccaaaaggaatgaatacaactttaatgaataaaacaaaacagaacgctaatttaaaaaggttaatacgggccgggcgtggtggctcatgcctgtaatctgagcactttgggaggccgaggaaggtggatcaggaggtcaggagattgagaccatcctggctaacacggtgaaaccccgtctctactaaaaatattttaaaaattagccgggcgtggtggtgggcgcctgtagtttcagctactcgggagactgaggcaggagaatcccttgaacccgggaggcggagcttgctgtgagccgagatcgcaccactgcactccagcctgggtgacagagccagactccgtctcaaaataaataaataaataaataaataaaaaagaaaaaggttaatacaacattaaagaacaagaattaatatagctttttttttttttttttttttttgagacctagtctcactctgttgcccaggctggagggcagtggcatgatctcagctcactgcaacctccgcctcccgggttcaggcgattctcctgcctcagcctcccgaataggtgggattacaggcgtgcaccaccatgcctactttttgtatttttagtagagacggggtttcactatgttggccaggctggtgtcgaactcttgacctcaagtgatctgcctgccttggcctcccaaagtgctgggatgacaggtgtgagccactgcacctggcctaatatagctttaatagaaaaggagctaatacaagcttagaataataaactttatgcagacttactgaaacaaacagtcaatgcaaccttaaccaaacaggaattgataacagtttaataaaaaagctaataccacttgaatagaatatatcttactacaaccttcataagaaaaacaactaatacactttgggagaccgaggcaggcagatcacgaggtcaggagatcgagaccatggtgaaaccccgcctctactaaaaatacaaaaaaattagcctggcatggtggcgggcacctgtagtcccagctagtcgggaggctgaggcaggagaatggcttgaacctgggaggtggaggttgccgtgaggcgtgatcgtgccactgcactccagcctggcgacagagcgagactctgtctcaaaaaaataatgataataataataaacaaataaagataccaaaaaaaaaatacaaaaatttagccgggtgtggtggcacgtgcctgtaatcacagctactcgggaggctggggcaagagaatcacttgaacgcgggaggcgtaggttgccgtgagccgagattgcaccgctgcactccagcctgggtgacagagcgagactccgtctcaaaaaaaagaacaaacaaaaagatagtggtaggtgtaatctgtgtttctttccccatgctgttgaaataaagctaactgtaagtatcctggaagacacgtggcctgaagaaaccatctttccctgtggtttgtttatgacttcctgtcactaaggttgcctgagccttggcacccatccaaaacgatgtgtgcaagaaaagaaatgcatggatgatttattcttgttttattttttttttgagatggagtctcgctctgttgcccaggctggagtgcagtggcgcgatcttggctcactgcaatctccacctccaggattcaagcaattctcctgcctcaccctccccagtagctgggactacaggctcacaccaccatgcccagctaatttttatacttttagtagagatggggtttcaccatgttggccaggttagccctgaactcctgacctcaggtgatccgcccacctcggcctcccagaatgttgggattacaggcgtgagctaccacgcctggctgatttattcattttttatagtttgtgtattatttgaaggcattacctgattactgctttattttatttttatatgtatttatttatttatctattgagacggagtttcgctcttgttgcccaggctggagtgcaatggcacgatctcggctcaccacaacctctgcctcccgggtgcaagtgattctcctgcctcagcctcccgagtagctgggattacaggcatgcaccaccacaccaggctaattttgtatttttagtagagatggggtttctgcacgttggtcaggctggtcacgaactcacaacctcagttgctccacctgcctcggcctcccaaagtgctgggatgacaggcgtgagccaccgcacccggcctatttattttttttgagacggagtctcactctgtccagcccaggctggagtgcagtgatgcgatcttggctcactgcaacctctgcctcccgggtttacgccattctcctgcctcagcctcccgagtagctgggatacaggtgcgcaccaccatgcctggctaatttttgtatttttagtagagacggagtttcaccatgttggccaggctggtctcgaacccctgacctcaagtgatctaccctcctaggcctcccaaagtgctgggattacaggcgtgagccaccacgcccggtcctctgtctctgtttttgagacagagtcttactctgtcacccaggcttggagtgcagtggtgagatctcggctcactgcaacctccgcttagcaggttcaagcgattctcctgcctcagcctcccaagtagttgggattacaggcatgagccaccacgcccggctaatttttgtatttttagtagagatggggtttcaccatgttggccaggctggtctcaaactcctgacctcaggtgatccacccacctcccaaagcgcagggattataggtatgagttaaagcacccagccaggagacatttttaaatgaggttgcacggctatggaaaacagggtggggccaggcgcaatggctcacgcctgtcatcccagcactttgggaggccgaggctggcagatcacgaggtcagaagttcgagaccagcctggccaacatggtgaaaccccatctttactaaaaacacaaaaattagacaggcatggtggaacaggcctgtaatcccagctactcgggaggctgaggcaggagaatggtgtgaagccgggaggcagaggttgcagtgagccgagaccgcaccactgccctccagcctgggtgatacagtgagacttcaactcaaaataaataaattaattaattaataaaaataaataaataaatatgactgttttccatagtggtgcaatctcatttgactctgtctcaaaaaaaaaaataaataaatgaataagaatataaataaaacaatgctttcctccctagcctgccatggtatggggtgtttctaagactgtggttcccaggaggctgagccctgaccttttatttccgctcctgctccaaggttctcttcgccgcctgcgagctgggcgtgtttgaccttctcgccgaggccccagggcccctggacgtggcggcagtggctgcaggtgtgagggccagcgcccatgggacagagctcctgctggacatctgtgtgtccctgaagctgctgaaagtggagacgaggggaggaaaaggtgaggacacgggcgttttgaaggaggcattttacatagacaccctctgcagcccacgtgttctgtaaaaagtgaaacagtctccatcctggctcacacagtgaaaccccgtctctactaaaaaaaatacaaaaaattagccgggtgtggtggcgtgcacctgtcatcccagctactcaggaggctgaggcaggagaatggcatgaacccgggaggcagaggttgcagtgagccgagatcgtgccactgcactccagtctgggcgacagagcgagactccatctgtatttgcaggtttgggggtcgtgtggtttttgtggcagctaccgacctctgccctggggacgtcaaagctgccagagtgtgagacccaggctgggggattccttgagcccaggagttcgagaccagcctgggccacgtatttttaatagagacaggatttcatcacgttggccaggctggtctcgagctcctgacctcaggtgatccaccagcctgggccacttatttttagtagagacaggatttcgtcacgttggccaggccggtctcgagctcctgacctcaggtgatccacccgcctcggcctccctaagcgctgagattacaggtgtgagccaccacgcccggcctcaataagttattttagacattctgtggaatgtaacgtacgtttcctctcgtggctcatctgcctttgtacttgctgcacccaaactcccgatggggatttgtacaaaccgaacccgacgggggtgctagccgccccaggtcacctttgcgccttccacagaaggctccagctgtacaaggcaagaggaagaccccatctctaaagaagagatgggcttgtaatcatgttgaaatcacgatgttgtcgagctggggagcgtccgccggcaggaactcggaatctcactgctttttccctgtttttttgtgtgtgtttcagctttctatcgaaacacagagctgtccagcgactacctgaccacggtcagcccgacgtcacaatgcagcatgctgaagtacatgggcaggaccagctaccggtgctggggccacctggcagacgccgtgaggtgggggctgcccccaggcagatgctgggaggtggtggctgcacccaggcagatgctgggaggtgggggctgcccccaggcagatgctgggaggtggtggctgaccccaggcagatgctgggaggtgggggctgaccccaggcagatgctgggaggtgggggctgcacccaggcagatgctgggaggtgggggctgcccccaggcagatgctgggaggtggtggctgcacccaggcagatgctgggaggtgggggctgcccccaggcagatgctgggaggtggtggctgaccacaggcagatgctgggaggtgggggctgaccccaggcagatgctgggaggtggtggctgaccacaggcagatgctgggaggtgggggctgaccccaggcagatgctgggaggtgggggctgcacccaggcagatgctgggaggtgggggctgcacccaggcagatgctgggaggtgggggctgcacccaggcagatgctgggaggtgggggctgaccccaggcagatgctgggaggtgggcgctgcacccaggcagatgctgggaggtgggggctgaccccaggcagatgctgggaggtgggggctgcatccaggcagtgaccaagtctcaggactaccgccaggggctggtgaagtggcagtggaggaggtgaaagggaaggtttctttttctttgttttttcttttcttttctttcttttttttttttttgagatggagtcttgctctgtcacccagggtggagcgcagtggcgccatctcggctcattgcaagctatgcctcccgggttcacgccattctcctgcctcagcctcccaagtagctgggactacaggaacccgccaccacacccgactaattttttgtgtttttggtagagacggggtttcaccatgttagccaggatggtctccatctcctgacctcgtgatctgcctgcctacatggtggcaggcacctgtagtcccagctactcaggaggctaaggtgggagaactgcttgaacccagaaggcagaggctgcaatgagctgattgtgccactgcactgcagcctgggcaacagagcaaaaactctgtctcagaaagaaggaaacagaaagagagagagaggggagaaggaaggaaggaagggagggagggagggagggagggagggaaagaagggaaataatggaaagtaagagaaagaaagagaaggaaggaaagaaagagagagagagagagaagacctggactcaatagaaaggagtgtctgggtggccggacgcagtagcccatgccggtaatcccagcactttgggaggctgaggcgggcggatcacgaggtcaggagatcgagaccatcctggctaacacggtgaaaccccgtctctattaaaaatacaaaaaattagccgggcgtggtggcgggcgcctgtagtcccagctactcggagaggctgaggcaggaaaatggtgtgaacccgggaggcggaggttgcagtgagccaagatcgcaccactgcactccagcctgggcgacagagcgagactccatctcaaaaaaaaaaaaaaaaaaataggggtgtctgggttaacatagggggttgtggagaccaaattcttattatgtagatgaaatctccaggtagcaggcttcagaaagaatagactgttactgtttcctatctgacttggttctctcctggatcagaaaaaaggaaggaaaaggaaggtgattctctccagaacgtagattttctccacaacaggtagctttacaggagtatttcaagctatggtaaagagaacatgtttggggctaaaatatttttatttccttttttttttttttttttgagacagagttttgttttgttgcccaggctggagtgcagtggtatgatctcgactcactgcaacctccgcctcctgggtttaagtgattcacctgcctcagcctccccagtagctgggagtataggcatccaccacacctggctgattgtttgtgttttagtagagacggggtttcaccctgtctttgaggctggtctccaactcctgagctcaggctatctgcccccgtcttggcctcccagagtgttaggattataggtgtgagccaccacgcccagcctttgattttcttctttatctgtgatgggttgttatgccagagtcaggttggaaagtgagccacgtaatatagggttaaataaaacccatctcacgagactttatagttatagagcataactccctaggccccttagataagaatttgggcaaggaagaaaaaggtcacgtgtaacaattaagtcctcaggtttaaacaattaagcaacagctggccaggcgcggtggctcacgcctgtaatcccagcactttgagaggccgaggcgggtggatcacctgaggtcacgagttcgagaccagcctgaccaacatagtgaaaccccatctctactaaaaaatacaaaaatgagccaggcatggtggcgggtgcctgtcatcccagctactcgggaggttgaggcaggagaatcgcttgaaccgaggaggtggagattgcagtgagccaagatcgcgccattgcactccagcctgggcgacacagcgagactccgtctcataaaataaaataaggccaggtgcggtggctcacgcctgtaatcccagcactttgggaggccaaggcgggcagatcacctgaggtcaggagttcgagaccagcctgaccaacatgatgaaaccccatctgtactaaaaagtacaaaaattagccaggcacggtggcaggtgcctgtaatcccagctactcgggaggctgaggtaggaaaatcgcttgaacccgggaggcggagattacagtgagccaagatcgtgccattgcactccagcctgggcgacacagcgagactccatctcctaaaataaaataaggccaggtgtggtggctcacacctgtaaccccaccactttgggaggccgaggcgggtggatcacctgaggtcacgagtttgagaccagcctgaccaacatggtgaaacctgtctccactaaaaatacaaaaattagctgggcgtggtggcgggcgcctatagtcccagctactcgggaggctgaggcaggagaatggcgtgaacccagaaggcagaggttgcagtgagccgagatcgtgccattgcactccagcctgggctacagagctgaaatgaaatgaaacgaaatgaaacgaaatgaaatgaaatgaaatgaaatgaaatgaaatgaaatgaaaatcagccttctctctcttttcttagagaaggaaggaaccagtacctggagacgtttggcgttcccgctgaagagctttttacggccatctacaggtaacacccatcactttgaaaccaacaactcagataagattctgtttatttttaaaggacttaggaaacccaatccatttactcaaatggcacaacccaggaggaagctgccatttaatttaaaataacatcccctatccccactactaccccagattttgctcatctgatgtttaaattgatcaaattcctgaggaggtgcaacgtgacccttccttcgaaaggactactcacaaactcagtgtttatgtagaaaatggaggcacgcgccgggcgcggtggctcacgcctgtcatcccagaactttgggaggccgaggcaggtggatcacctgaggtcaggagttcgagaccagcctggccaacagggtgaaaccccgtctctactaaaaatacaaaaattagccgggcgtggtggcggacgcctgtaatcccagctagtcgggaggctgaggcaggagaactgcttgaacccgggaggcggaggttgcggtgatctgagatcgcaccactgcactccagcctgggcaacaagagtgaaactccatctcaaaaaagaaaagaaaagaatatagaggcccagtttttgatttggtcagaggtgaaggtgaggccaggtgagacctcagctcttcactttgctttgcgatgtggacacagctttggcctttgcccgaagctcttacctagaattcccagatggaggtgaattgatgggcccgtccagtgttccagctggctgaggcatggagtagggaagggtatgaaggacaaggggatgcctgagtggttcgcctgccccccaacctctcctctcctcccctgctctcccctcccctctcttctccttctgtcctgttccctctcttttcctcttccatcctcctctctttctctccttttccttctcttctcttctctcctctcttttcctctccatcttccccctcctctctcccatcttccctctcttgtctcctctctcttcttccctctctcctttcctctcgcctcccttcccctcccttcacctgcctctctccttctcctctcccgtcttctttctctcatcttctctgttttcatgccccgtatttcacctccttttctcctcctctcttctcctcggtctgctttcctttcccccgtttctctctttctttctctctctctttctttctttccttctttctttccttctttctccttccttccttcgttccttcctctttccttctgcctgccttccttccttccctccctccctcctttctttctttttctttcttccttcttccttctttcctttctttatatatatatatatgtgtgtatacatgtgtatgtgtatgtgaatatatgtatctgtttagggggcacaagtacccatgtcttccatgcttacatgttgcaccttgcagcctaggcttttagtgtgcccatcacctgaatagtgaccgtggtacctaagaggcaatttttcagccctcgctactctgaggcaaacccctacagcaggctctgcagagaggacaggaggagagagggagctgtggggggggaggagcaggaaatgcttccaacaccagagccctgtccgcctctgtgtccacctatccttcttggctccatctcacctgcctcccttcctagttcctgccttttctctagcctcttccccaggatgtgtggacctcccacccgcttcctggatttgtcctctggggctgagctctgtggatgggggaacgtattattgactttcctcttagaaaacatctaaactcctcttcagatagaaatcccttcccatccagagaacaatcgtccgttctgaatcaactccaggtttcccggagctgggtacactttgctggctgacctatggttcccccatcccgaatgacttcctgttccatttcacaaatgcaagccttccaggtgcacctgtggggtatagctccgttctcaacagggggttatgtacacccttgctctgggcacgtccccagatcctcaccatcttgacaagcgtggttttgcatgccaggtccgagggcgagcggctacagttcatgcaagctctgcaggaggtctggagcgtcaacgggagaagcgtgctgaccgcctttgacctgtcagtgttcccacttatgtgtgaccttggtggtaagtacccctcaccactaatacctcggaggtgtggcttctgttctgtatggggaatgtgttattcatgtcttttattttctgcattctgatgctttgacatgtgcggccttactggtcttagaggaatcattcctcccagcactgggcacttcctagagtcagcaaacatctcctctgcgagcacacgtttctttttcttttctttttttaagatggaagcttgctccatcgcccaggctgcagtgcagtggcatgatctcggctcactgcaacctttgcctcctgggttcaagcgattctcctgcctcagcctcccgagtagctgggattacaggcacctgccaccacaccaggctaatttttttttttttttttttttttgagatgaagtgtcgctctgtcgcccaggctggagtgcagtggcacgatctcggctcaccgcaacctccgcctcctgggttcaagcgattctcctgccccagcctcccgagtaggtgggattatgggtgcgcaccactctgtcaggctaatttttgtattttttaatagagacggggttttgccatgttggccaggctggtctcgaactcctgacctcatgatccacccgcctcggtcttgtttttagtttttgagagagggtcctgtttgtcacccaggctcgagtgcaatggtgtgttgatagctcactgcagcctcagactctcaggctcaagtggtcctcccacctcagcctcccaagtagctgggattacagatgactgccgccacacctagctcatttaaaaacttttctgtagagcctgagtctctctacgttgccctggctggtctcagactcctgggctcatgcaatcctgctgcctcagcctccaaaagtgctgggattacaggcgcccgccaccacacccaggctgagctgagcttgttttatttatttatttatttatttatttacttgtatttatttatttatttttttttttgagatggagtcttgctctgtcacccaggctggaatgcagtggtgcaatctccactcactgcaagctctgcctcccgggttcacgccattctcctgcctcagcctcctgagtagctgggactacaggcgcccgccaccacgcccagctaattttttgtttttttttttagtagagacggggtttctccgtgttagccaggatggtctcgatctcctgacctcgtgatccacccgcctccgcctcccaaagtgccaggattgcaggcatgagccactgcgccgagctcattttcaaacttttttgtagagaacgagtctccctatgttgccctggctggtctcagactccagtttcatgcagtcctcctgcctcggcctcccagagtgagtgatgggattacaggcatgagccactgcacccaggctgagcttgctttttgaatacaaatccccaaccccgagctcaccccttaagcacctcctctaccccatagggctgtcacactccaggccgtgatccacccaccctatctccctcctgtgactcagtggatcactcagaacagctcctggctggtagaaggccctttgcagagtgaggagcttctccaagtttattacttttagtcactgtgagcagggatagatagagttcaggatccccctgcctggggagcagcttgggaagaaaataatgaacaagcagaccgggcgcggtggctcactcctgtaatcccagcactttgggaggccgaggcgggtggatctcctgaggtcaggagttcgagatcagcctggtcaacatggtgaaatcccgtctctactaaaaatacaaaaaaaggctgggtgcggtggctcatgcctgtaatcccagcactttgggaggctgaggcgggcggatcccaaggtcaggagtttgagaccagcctgaccaacggggtgaaacccggtctctactaaaaatacaaaaacttagccaggcatgacagtaggtgcctgtcatcccaggtactcaggaggctgaggcaggagaatcgcttgtacccgggaagtgaaggttgcagtgagctgagatcgcgccactgcactccagcctggtgacagagtgagactccatctcaaaataaataaaaagactgactttctacagaaataatggacaaggagcatggggctggaagtctctgtggcccatgatggattttgtgtgcacgacttaccggggcctctgaatggggcttgttattacatccttctcttagctgttggccgcccttggctggacaggtgcgccggcttcaagaacacacagttaagtgcgtggccatatggaagtttggagcttgggtcagcccagccagaaagaccacctgaactcaggggcctgtagacaatcacgtcaccgtcaagattagacatggtggataaaaaaggatgagttcggccgggcgcggtggctcacgcctgtcatcccagcactttgggaggccgagatgggcggatcacgaggtcaggagatcgagaccatcctggctaacacggagaaaccctgtctctactaaaaatacaataaaaaaattagctgggcgtggtggcgggcgcctgtagtcccagctactggggaggctgaggcaggagaatggcgtgaacccgggaggcagagcttgcagtgagcggaaatcgtgccactgcactccagcctgggcgacagagccagactctgtctcaaaaataaataaattaataaataaaaggatgcgttcatgtcctttgcagggacatggataaagctggaaaccatcattctcagcaaactatcgcaaggacagaaaaccaaacaccgcgtgttctcactcataggtgggaactgaacaatgagaccacatggacacagggaggggaacgtcacacactggggcctgtcagggcctggggggctgggaggctgggggagggagagcactaggacaaatacctaatgtaaatgacgagtcgatgggtgcagcaaaccaccatggcacatggatacctatgtaacaaaaccgcatgttctgcacatgtaccctagaacttaaagtataataaaaagaaaaaaaagaccagacatggcggaaggacccaagttcctgggttggacccttcatgagtccatggtgtgtggagggtgagcgatgtctctcaggttcatctctgagggtcaaacgggctgtgtccccttccaggtggggctggagctctggctaaggaatgcatgtctctgtaccctggatgtaagatcaccgtttttgacatcccagaagtggtgtggacggcaaagcagcacttctcattccaggaggaagaacagattgacttccaggaaggtgtgtttgtgtccgtggggaagcagagatgtgtctcacggcttctccagggggactggatgtttctgggaaatgaagaagatgtgatgtggttttcctctcactcccggaaacaccctcaactcaacactgtctgttattcatgatggatggaaagctgggtgtagatatacagttttcttacaattattattattattattgatacagagtcttgctttgtcgcccaggctggagtgcagtggtgcagtctcggctcactgcaacctccacctcctgggttcaagcaattctcctgcctcagcctcccaagtagctgggattacaggcatgcgccaccacatccagctaatttttttttttttttgagatggagtctcactctcttgcccgggctggagtgtggtgacagatctcggctcccttcaagctccgcctcccgggttcacaccattctcctgcctcagcctcccaagtagctgggactacaggcacccaccaccacacctggctaatcttttatatttttagtagaggtggagtttcactgtgttagccaggatggtctcgatctcctgaccgcgtgatccgcccaccttggcctcccaaagtgctgggattacaggtgtgaaccatcacacccggcctctttttgtatttttagtagagatggggtttcaccgtgttgaccaggctggtctcaaactcctgacctcaggagatccacccgcctcggcctcccaaagtgctgggattacaggcgtgagccaccgcacccagccagtcatatcatttctgcagtgaagggtgtggccagggtctccacgactaccttcaggttcaataattcactagaaggacacaccgagctcagaagagccatcatacacatagttatatttacaacaatgaaagaatacagatgcatatcagcgaaggagaaaggagcatgggatagagttcgggagaaaccacatgtgagcttcttgttgtcttctcccagtggagctgtggacagcaatcaattcccccaacaacaaggtttgacaacacacaccactcactgccagcctggagagcctccgcaatccctgacatccaaggattttcttggagactggttacatagacatggcagacaccctgcatggctgactccaatcttcacctcttccagagttcccaaggtgatcctatagtaaatcccactgttagtacaaactatcctgggtggcccagagacccagctgaacaaagatacccttgtgaggtaggacattcttagagattacagttgccaattaagtgccaatcctctctttagaatgtggagggtttggacaacacaggcctgctgagttaaccccccccctttttttttcttgtttttttgagacggagtctcactctgtcacccaggctggagtgcagtggcgtgatccaagctcactgcaacctctgcctcccaggttcaagcaattttttgcctcagcctcctaagtagctgagattttacaggtgcctatcaccatgcctggctaattttttgtatttttagtagagacagggtttcactatctcggccaggctggttttgaattcctgacctcgtgatccacctgcctcggcctcccaaagtgctggggattacaggagtgagccaccgcgcctggcctgagttaactcttttttttttttttttgagatggagtctcgctctgtcacccaggctggagtgcagtggtgggatctcggctcactgcaagctccacctcccgggttcacaccattctcctgcctcagcctcccgagtagctgggactacaggcgcccaccaccacgcccagctaattttttttttttttttgtatttttggtagagatggggtttcaccgtgttagccaggatggtctcaatctcctgatctcgtgatctgccccgctcagactcccaaagtgctgggattacaggcgtgagccaccgcgcctggcctgaattaactcttcactgcacagagctcaccaagatctctcccaagattggcaccttatcattttgcgggaaaactatgacaagacttgagcgtttcacatcgcacacacataaagggtcagtcttgcgtatttactttaaatctggagaacaggtcttgactgtaggttcagttcagctcatcagttaggagctgctgaccgaattcccagggactcctggaatccacggctttgggtgatatcagcagcagtgcttttgcaggggacatcagaaagaaagaaagaaagaacatgggccgggcacagcagctcatgcctgtaatcccagcactttgggaggccgaggcgggcggatcacctcaggttgggggttcgagaccagcctcagcaacatggagaaatcccatctctactaaaaatacaaaaattagccgggcgtggtggcgggtgcctgtaatcccagctactcaggaggctgaggcaggagaatcgcttgaaaccaggaggtggaggttgcggtgagctgagatcaggcccttgcactccagcctgggcaacaagagcaaaactccatctcaaacaaacaaacaaacaaaaaaacaaaaaagaaaccatattatgatttttttttaaaggaggaggagagaaagaggccacacttattcagtattttctttctttttttttttttggagacagtctcgctgtcgcccaggctggagtgcaatggtgcaatctcggctcactgcaagctccgcctcccgggttcatgccattctcctgcctcagcctcccgagtagctgggaccacaggcacccgccatcacgcccggctaattttttttgtatttttagtagagacagggtttcaccgtgttagccaggatggtcttgatctcctgacctcgtgatctgcccacctccgcctcccaaagtgctaggattacaggcgtgagccaccgcgcccgacctcagtattttcttatctttctcctaagcctttttgttttctgaggctaggtctgcaggtgactagcctggaagacctgggaaaggcgtgacccatccaggtgaccttttgtgcccagaataggtttagtcaaatgggattggattgcaggctgacctcggtgtgcctgccctgtgttccaggggatttcttcaaagaccctcttccggaagctgatctgtacatcctggccagggtcctccatgactgggcagacggaaagtgctcacacctgctggagaggatctaccacacttgcaagccaggtaagttgtggggtttgcatttcagcgtgtgcttgtgacacggggcagaattgtacgagtcacatttagaaggcaggcactgaaatcatcccacaggtaagggtagacatcctgcccaatatggctttccttttagataacgacctgaaataaatagggtcctaatttctattctattgataaaaccacataaagatggaaaaagtgaaaggccctctgaaacttcagtggcctcactttggtgaaattctttcagaattaggctagtatttgtgtgtgtgatgaggacagtgccccactgacttctgaggtccacccatcctgatggttcatgaggatgtgggcacagcctctgtgtgtgatggggacagtgtcccagctctcctgtgaggtccatccatcctgatggcacatgaggatgtgggcacagcctctgtgtgtgatggggacagtgtcccagctctcctgtgaggtccatccatcctgatggcacatgaggatgtgggcacagcctctgtgtgtgagataaggactgtgtcccagctctcctgtgaggtccacccatcctgatgcttcacgaggacgtgggcacagcctctgtgtatgatggggacagtgtcccagtgtcctgtgaggtccatccatcctgatggcacatgaggatgtggacacagcctctgtgtgtgtgatggggacagtgtcccagtgtcctgtgagatccatccctcctgatggttcatgaggatgtgggcacagcctctgtgtatgatggggacagtgtcccagtgtcctgtgagatccatccctcctgatgcttcacgaggacgtgggcacagcctctgtgtatgatggggacagtgtcccagtgtcctgtgaggtccacccatcctgatggcacatgaggatgtgggcacagcctctgtgtgtgagatagggaccatgtcccagctctcctgtgaggtccatccatcctgatgatccatgaggatgtggacacagcctctgtgtgtgtgatggggacagtgtcccagtgtcctgtgagatccatccctcctgatggttcatgaggatgtgggcacagcctctgtgtgtgagatagggaccatgtcccagctctcctgtgaggtccatccatcctgatgatccatgaggatgtggacacagcctctgtgtgtgtgatggggacagtgtcccagtgtcctgtgagatccatccctcctgatggttcatgaggatgtgggcacagcctctgtgtgtgagatagggaccatgtcccagctctcctgtgaggtccatccatcctgatggcacatgaggatgtgggcacagcctctgtgtgtgagatagggaccatgtcccagctctcctgtgaggtccatccatcctgatgatccatgaggatgtggacacagcctctgtgtgtgtgatggggacagtgtcccagtgtcctgtgagatccatccctcctgatggttcatgaggatgtgggcacagcctctgtgtgtgagatagggaccatgtcccagctctcctgtgaggtccatccatcctgatggcacatgaggatgtgggcacagcctctgtgtgtgagatagggaccatgtcccagctctcctgtgaggtccatccatcctgatgatccatgaggatgtggacacagcctctgtgtgtgtgatggggacagtgtcccagtgtcctgtgagatccatccctcctgatggttcatgaggatgtgggcacagcctctgtgtgtgagatagggaccatgtcccagctctcctgtgaggtccatccatcctgatgatccatgaggatgtggacacagcctctgtgtgtgtgatggggacagtgtcccagtgtcctgtgagatccatccctcctgatggttcatgaggatgtgggcacagcctctgtgtgtgagatagggaccatgtcccagctctcctgtgaggtccatccatcctgatggcacatgaggatgtgggcacagcctctgtgtgtgagatagggaccatgtcccagctctcctgtgaggtccacccatcctgatgcttcacgaggacgtgggcacagcctctgtgtatgatggggacagtgtcccagtgtcctgtgaggtccatccatcctgatggcacatgaggatgtggacacagcctctgtgtgtgtgatggggacagtgtcccagtgtcctgtgagatccatccctcctgatggttcatgaggatgtgggcacagcctctgtgtgtgagatagggaccatgtcccagctctcctgtgaggtccacccatcctgatgatccatgaggatgtggacacagcctctgtgtgtgtgatggggacagtgtcccagtgtcctgtgagatccatccatcctgatggcacatgaggatgtgggcacagcctctgtgtgtgagatagggaccatgtcccagctctcctgtgaggtccatccatcctgatgatccatgaggatgtggacacagcctctgtgtgtgtgatggggacagtgtcccagtgtcctgtgagatccatccctcctgatggttcatgaggatgtgggcacagcctctgtgtgtgagatagggaccatgtcccagctctcctgtgaggtccacccatcctgatgatccatgaggatgtggacacagcctctgtgtgtgtgatggggacagtgtcccagtgtcctgtgagatccatccatcctgatggttcatgaggatgtgggcacagcctctgtgtgtgagatagggaccatgtcccagctctcctgtgaggtccatccatcctgatggcacatgaggatgtgggcacagcctctgtgtgtgagataaggactgtgtcccagctctcctgtgaggtccacccatcctgatgcttcacgaggacgtgggcacagcctctgtgtatgatggggacagtgtcccagtgtcctgtgaggtccatccatcctgatggcacatgaggatgtggacacagcctctgtgtgtgtgatggggacagtgtcccagtgtcctgtgagatccatccctcctgatggttcatgaggatgtgggcacagcctctgtgtgtgagatagggaccatgtcccagctctcctgtgaggtccacccatcctgatgatccatgaggatgtggacacagcctctgtgtgtgtgatggggacagtgtcccagtgtcctgtgagatccatccatcctgatggcacatgaggatgtgggcacagcctctgtgtgtgagatagggaccatgtcccagctctcctgtgaggtccatccatcctgatgatccatgaggatgtggacacagcctctgtgtgtgtgatggggacagtgtcccagtgtcctgtgagatccatccctcctgatggttcatgaggatgtgggcacagcctctgtgtgtgagatagggaccatgtcccagctctcctgtgaggtccacccatcctgatgatccatgaggatgtggacacagcctctgtgtgtgtgatggggacagtgtcccagtgtcctgtgagatccatccatcctgatggcacatgaggatgtgggcacagcctctgtgtgtgagatagggaccatgtcccagctctcctgtgaggtccacccatcctgatgatccatgaggatgtggacacagcctctgtgtgtgtgatggggacagtgtcccagtgtcctgtgaggtccatccctcctgatggttcatgaggatgtgggcacagcctctgtgtgtgagatagggaccatgtcccagctctcctgtgaggtccacccatcctgatgatccatgaggatgtggacacagcctctgtgtgtgtgatggggacagtgtcccagtgtcctgtgagatccatccctcctgatggttcatgaggatgtgggcacagcctctgtgtgtgagatagggaccatgtcccagctctcctgtgaggtccacccatcctgatgcttcatgaggacgtgggcacagcctctgtgtatgatggggacagtgtcccagtgtcctgtgagatccatccatcctgatggcacatgaggatgtgggcacagcctctgtgtgtgagatagggaccatgtcccagctctcctgtgaggtccatccatcctgatgatccatgaggatgtggacacagcctctgtgtgtgtgatggggacagtgtcccagtgtcctgtgagatccatccctcctgatggttcatgaggatgtgggcacagcctctgtgtgtgagatagggaccatgtcccagctctcctgtgaggtccacccatcctgatgatccatgaggatgtggacacagcctctgtgtgtgtgatggggacagtgtcccagtgtcctgtgagatccatccatcctgatggcacatgaggatgtgggcacagcctctgtgtgtgagatagggaccatgtcccagctctcctgtgaggtccacccatcctgatgatccatgaggatgtggacacagcctctgtgtgtgtgatggggacagtgtcccagtgtcctgtgaggtccatccctcctgatggttcatgaggatgtgggcacagcctctgtgtgtgagatagggaccatgtcccagctctcctgtgaggtccacccatcctgatgatccatgaggatgtggacacagcctctgtgtgtgtgatggggacagtgtcccagtgtcctgtgagatccatccctcctgatggttcatgaggatgtgggcacagcctctgtgtgtgagatagggaccatgtcccagctctcctgtgaggtccacccatcctgatgatccattaggatgtggacacagcctctgtgtgtgtgatagggaccatgtcccagtgtcctgtgaggtccacctatcctgatggtccatgaggatgtggacacagccgctctgtgtgtgatggggacagtgtcccagctctcctgtgaggtccatccatcctgatggttcatggggacgtgagcacagcctctgtgtgtgtgttggggacagtgtcccagttctcctgtgaggtccacccatcctgatggttcatgaggatgtgggcacagcctctgtgtgtgtgatggggacagtgtcccagtgtcctgtgaggtccacccatcctggtggtccatgagtacatggacacagcctctctgtgtgagatggggacagtgtcccagttctcctgtgaggtccacccatcctggtggtccatgagtacatggacacagcctctctgtgtgtgataaggacagtgttccagctctcctgtgaggtccacccatcttgatggttcatgaggacttgggcatggcctctatgtgtgtgatggggacagtgtcccagtgtcctgtgaggtccacccatcctgatggtccatgaggatgtgggcacaacctctttgtgtgtgatggggacagtgtcccagtgtctgtgaggtccacccatccgatggttcatgaggacgtgggcacagcctctgtgtgtaatggggatagcatcccagtgtcctgtgaggtccatccatcctgatggcccatgaggatgtgggcacagcctctgtgtgtgtgtgtgtgatggggacggtgtcccagttctcctgtgaggtccacccatcctgatggtccatgaggacatgggcacagcctctctgtgtgtgataaggacagtgttccagctctcctgtgaggtccacccatcttgatggttcatgaggacttgggcacagcctctgtgtgtgtgatggggacagtgtcccagtgtcctgtgaggtccatacatcctgatggtccatgaggacatgggcacaacctctgtgtgtataatggggacagtgtcccagtgtcctgtgaggtccacccatcctgatggttcatgaggacgtgggctcagcctctgtgtgtaatgaggacagtgtcccagtgtcctgagaggtccatcgatcctgatggcccatgaggatgtgggcacagcctctgtgtgtgtgtgatggggacggtgtcccagttctcctgtgaggtccatccatcctgatggttcatgaggacatgggcacagcctctatgtgtgtgatggggacagtgtcccagcgtcctgtgaggttcacccatcctgatgatcgatgaggacgtgggcacagcctctgagtgtgtgatggggacggtgccctgactgtcctctgaggtctggctgtccttatggttcactgggactttggcacagtctgtctgtgtgtttgtgtgtgatgtggactgtgcccctccctttctaggtggtggcattctggtaattgaaagcctcctggatgaagacaggcgaggtcctctgctcacgcagctctactctctgaacatgcttgtgcagacggaagggcaggagaggacccccacccactaccacatgctcctctcttctgctggcttcagagacttccagtttaagaaaacaggagccatttatgatgccattttagccaggaaataactgtttcttgtga

SEQ ID NO: 2883 - DNA, 27906 bp, human
agccacggctggattggagacaagatgggatcctcagaggaccaggcctatcgcctccttaatgactacgccaacggcttcatggtgtcccaggtaggatacgctctgtgggacaagggggaatagacttccgttcatcacactcacgttccattgttgtgtcagtcgagaaaaatgatgagtctccatcattttaggaggtttattttccaccgtgaaagacgtacacccacgatgtagcctcaggagttcctgaggacatgtgcccagggtggtctggggacagcttggtttgatacattttacagagacatgagtcatcaatcaatgtatgtaagtacattgggccagtcgtggtggctcacacctgtgatcccagcactttgggaggctgaggcgggcggatcacctgaggtcgggagttcgagaccagcctgacccacacagagaaaccccatctctactaaaaatacaaaattagccaggcttggtggtacatgcctataatcccagctacttgggaggctgaggcaggagaatcgcttgaacctgggaggcggaggttgcagtgagccgagatcgcaccactgcactcccgcctgggggacacagcaagactctgtgtcaaaaaaaaaccaaacaaacaacaaaaaaaaagaaacaaagcttaagatgaaatacataggattagaaacaagacaatgtttattgaactgcaagtgttgaaatttttaaaacatttcatgatagagtagtatatgtggttgtttattaacccagtaaataattacactgtgcgtttatcatagaggtgagttttgagggttcacccgtagaggagcaacacctcattccttttttttatttttttgagctggagtctcactctgtaacccaggctggagtgcagtggcacggtcttggctcactgcaacctccgcctccagggttcaggctattctcctgcttcagcctcccgagtatctgggattacaggcacccaccaccacgcccggctaatttttgtatttttagtagagatggggtttcaccatgttggccaggctggtctcgaactcctgacctcaagtgattcacctgcctcggcctcccaaggcctcatttcttcttctcacagaataacatcgtgctcagtgaaggaaggctgacgtgaaaggccccatatggtatgacttcatttatatgaaatgtgcagagcaggcaaatccttcgaggtggaaagtggactggtggtttgcagaggctgggcaggactgcggagggagtgtttaacggagacagtgtccctttttggggtgatgcaaatgttctggaacccggcggaagtgctggctatacaacatcacgaatgtactaagtgcccctgaattatgcttgaaaagggttaatgatggccgggctcagcggtgacacctgtcatcccaacggtttgggggtccgaaacgagggaatcgctttagcccaggaattcgagaccagtctgggcaacatagtgagaccccccatttctacaaattcttttttctttttgagacagagtctcgctctgtcgcccaggctggagtgcaatggcacgatctcggctcactgcaagctccacctcccaggttcacgccattctcctgcctcagcctcccgagtagctgggattacaggcacccgccaccacgcccggctaattttttgtatttttagtagagacggggtttcaccgtgttagccaggatggtctcgatctcctgacctcatgatccgcccgcctcggcctcccaaagtgctgggattacaggcgtgagccactgtgcctggccaaaaatattttaaaaattagccaggtggggtggtgcacacctgtagtcccagctactcaggaggctgaggcgggaggatcgcttaagcctaggagatgaaggctgcagtgagctatgattgcaccactgcactccagcctggatgacagagcaatactgagtctctttaaaaaataaacggcagggcgcggtggctcatgcctgtcatcccagcactttttggggtccaaggtgggcggatcacttgaggtcaggagttcaagaccagcctggccaacatggtgaaaccccgtctctactagaagtataaaaattagccaggcatgatggtgggcacctgtcatcccatttactcgggaggctgaggcaggagaattgcttgaacccggaggaggtagaggttgcagtgagccgagattatgccactgcactccagcctgggtgtcgcagtgagactctgtctcagaacaaaaaccaaaaaccagcatcatcgtgaaagggggtcgtgtgctgacgatattttgagatgtctgcagcagctctcgtgtgacttgaaaatatctgtggtttctctccgtcagcaagccaccggttttttttgtttgtttttttcctttttttttttcagacagagtttccctcttgtcgcccaggctggagcgcagtggcgctatctcggctcactgcaacctctgcctcccgggttcaagcgattctcctgcctcagcctcccgagtagctgggagtacaggcgcgttccaacacgcccagataattttgtatttttagtagagatggggtttctctatgttggtcaggctggtctcgaactcccaacctcaggtgatcctcctggcccccacactttcttctatcatggctgtggtttgccagtacgctcatggttgaagggaacaccacatcttaggaagaggtagtgaaaattagagtgaagtctcttctccttcctggtttgtagagcccgtgaattttacctctaggcccccaagggttaaaaatacctattccccagccactgatacgcagagcggcctccgcctacggggttcaagcgattctcctgcctcagcctcctgagtacctgggattacaggtgcctgccaccaagcctggctaacttttatttttatttttatttttatttatttttctgatatggagtttcactgttgttgcccaggctggagtgcagtggcatgatctcagctcactgcaacctctccctcccaggttcaagcaattcccctgccttagcctcctgagtagctgggatttcaggcgtccaccaccacgcccggctaatttttgtatttttggcagagacggggtttcatcatgttggccaggctggtgtcgaactcctgacctcgggcgatctgcctgcctcggccttccaaagtgctaggattacaggtgtgagctactgcctctggctaattttttgtagttttggtagagatgaggtttcatcatgttggccaggctggtcttgaactcctgaccttgggcaatctgcctgcctcagcctcccaaagtgctaggatgacgggcgtgagccactgacatccagctaattttttgtatttttggtagagacggggtttcatcatgttgtccaggctggtctcgaactcctgacctcgggtgatctgcctgcctcagcctcccaaagtgctaggattataggcatgagccaacatgtctggctaatttttctattttttagtaaaggtgggatttctgttactgtcccagacaacagtaacttgctacctttgcctcctttgaccgcaggcctcctgctggggctattgactgctcattcaaagactgtcgctggttcacagcggtgttcagggaggtggtctggtgggttctaaatcttggaagagcagtcactttaaggcacatgataccatgtcatgggagttgtcagaagtttcacagaaccagagttaatgcagagttaataccaccttaagaggatcaaacttagtacacccttaacagaaacaattagctaatgcagctttcatagaccaagagtgaatatcgccttaagaagataacatttagtatacccttggccaggcacagtggctcacgcctgtaatcccagcactttgggaggccgaggcgggcggatcacaaggtcaggagttcgagaccagcctggccaatatggtgaaatcccatctctactaaaaatacaaaaattacctgggcgtggtggcgggcacctgtagtaccagctacttgggaggctgaggcacgagaatggcgtgaacccgggaggtggaggttgcagtgagccgagatcacgccactgcactccagccttgggggcagagcgggaccctgtctcaaaaaaaaaaaaaaaaagtgggggctggggagggagagcactaggacaaatacctaatgtaggtgacgggttgacaggtgcagcaaaccaccatggcacatgtatacctgtgcaacaaacctgcacgttctgcacatgtaccccagaacttaaagtataataataataataataataataataataataataataaaaagtctttgggagcagaaaaaaaaaaagatcaaagttagcgtacccttaacagaaacagttaatgcacctttcatagaccaagggtgaactcagccataagaaggtaacatttaatatatgcccttaaaagaacaattaattgagacaaccccaaaaggaatgaatacaactttaatgaataaaacaaaacagaacgctaatttaaaaaggttaatacgggccgggcgtggtggctcatgcctgtaatctgagcactttgggaggccgaggaaggtggatcaggaggtcaggagattgagaccatcctggctaacacggtgaaaccccgtctctactaaaaatattttaaaaattagccgggcgtggtggtgggcgcctgtagtttcagctactcgggagactgaggcaggagaatcccttgaacccgggaggcggagcttgctgtgagccgagatcgcaccactgcactccagcctgggtgacagagccagactccgtctcaaaataaataaataaataaataaataaaaaagaaaaaggttaatacaacattaaagaacaagaattaatatagctttttttttttttttttttttttgagacctagtctcactctgttgcccaggctggagggcagtggcatgatctcagctcactgcaacctccgcctcccgggttcaggcgattctcctgcctcagcctcccgaataggtgggattacaggcgtgcaccaccatgcctactttttgtatttttagtagagacggggtttcactatgttggccaggctggtgtcgaactcttgacctcaagtgatctgcctgccttggcctcccaaagtgctgggatgacaggtgtgagccactgcacctggcctaatatagctttaatagaaaaggagctaatacaagcttagaataataaactttatgcagacttactgaaacaaacagtcaatgcaaccttaaccaaacaggaattgataacagtttaataaaaaagctaataccacttgaatagaatatatcttactacaaccttcataagaaaaacaactaatacactttgggagaccgaggcaggcagatcacgaggtcaggagatcgagaccatggtgaaaccccgcctctactaaaaatacaaaaaaattagcctggcatggtggcgggcacctgtagtcccagctagtcgggaggctgaggcaggagaatggcttgaacctgggaggtggaggttgccgtgaggcgtgatcgtgccactgcactccagcctggcgacagagcgagactctgtctcaaaaaaataatgataataataataaacaaataaagataccaaaaaaaaaatacaaaaatttagccgggtgtggtggcacgtgcctgtaatcacagctactcgggaggctggggcaagagaatcacttgaacgcgggaggcgtaggttgccgtgagccgagattgcaccgctgcactccagcctgggtgacagagcgagactccgtctcaaaaaaaagaacaaacaaaaagatagtggtaggtgtaatctgtgtttctttccccatgctgttgaaataaagctaactgtaagtatcctggaagacacgtggcctgaagaaaccatctttccctgtggtttgtttatgacttcctgtcactaaggttgcctgagccttggcacccatccaaaacgatgtgtgcaagaaaagaaatgcatggatgatttattcttgttttattttttttttgagatggagtctcgctctgttgcccaggctggagtgcagtggcgcgatcttggctcactgcaatctccacctccaggattcaagcaattctcctgcctcaccctccccagtagctgggactacaggctcacaccaccatgcccagctaatttttatacttttagtagagatggggtttcaccatgttggccaggttagccctgaactcctgacctcaggtgatccgcccacctcggcctcccagaatgttgggattacaggcgtgagctaccacgcctggctgatttattcattttttatagtttgtgtattatttgaaggcattacctgattactgctttattttatttttatatgtatttatttatttatctattgagacggagtttcgctcttgttgcccaggctggagtgcaatggcacgatctcggctcaccacaacctctgcctcccgggtgcaagtgattctcctgcctcagcctcccgagtagctgggattacaggcatgcaccaccacaccaggctaattttgtatttttagtagagatggggtttctgcacgttggtcaggctggtcacgaactcacaacctcagttgctccacctgcctcggcctcccaaagtgctgggatgacaggcgtgagccaccgcacccggcctatttattttttttgagacggagtctcactctgtccagcccaggctggagtgcagtgatgcgatcttggctcactgcaacctctgcctcccgggtttacgccattctcctgcctcagcctcccgagtagctgggatacaggtgcgcaccaccatgcctggctaatttttgtatttttagtagagacggagtttcaccatgttggccaggctggtctcgaacccctgacctcaagtgatctaccctcctaggcctcccaaagtgctgggattacaggcgtgagccaccacgcccggtcctctgtctctgtttttgagacagagtcttactctgtcacccaggcttggagtgcagtggtgagatctcggctcactgcaacctccgcttagcaggttcaagcgattctcctgcctcagcctcccaagtagttgggattacaggcatgagccaccacgcccggctaatttttgtatttttagtagagatggggtttcaccatgttggccaggctggtctcaaactcctgacctcaggtgatccacccacctcccaaagcgcagggattataggtatgagttaaagcacccagccaggagacatttttaaatgaggttgcacggctatggaaaacagggtggggccaggcgcaatggctcacgcctgtcatcccagcactttgggaggccgaggctggcagatcacgaggtcagaagttcgagaccagcctggccaacatggtgaaaccccatctttactaaaaacacaaaaattagacaggcatggtggaacaggcctgtaatcccagctactcgggaggctgaggcaggagaatggtgtgaagccgggaggcagaggttgcagtgagccgagaccgcaccactgccctccagcctgggtgatacagtgagacttcaactcaaaataaataaattaattaattaataaaaataaataaataaatatgactgttttccatagtggtgcaatctcatttgactctgtctcaaaaaaaaaaataaataaatgaataagaatataaataaaacaatgctttcctccctagcctgccatggtatggggtgtttctaagactgtggttcccaggaggctgagccctgaccttttatttccgctcctgctccaaggttctcttcgccgcctgcgagctgggcgtgtttgaccttctcgccgaggccccagggcccctggacgtggcggcagtggctgcaggtgtgagggccagcgcccatgggacagagctcctgctggacatctgtgtgtccctgaagctgctgaaagtggagacgaggggaggaaaaggtgaggacacgggcgttttgaaggaggcattttacatagacaccctctgcagcccacgtgttctgtaaaaagtgaaacagtctccatcctggctcacacagtgaaaccccgtctctactaaaaaaaatacaaaaaattagccgggtgtggtggcgtgcacctgtcatcccagctactcaggaggctgaggcaggagaatggcatgaacccgggaggcagaggttgcagtgagccgagatcgtgccactgcactccagtctgggcgacagagcgagactccatctgtatttgcaggtttgggggtcgtgtggtttttgtggcagctaccgacctctgccctggggacgtcaaagctgccagagtgtgagacccaggctgggggattccttgagcccaggagttcgagaccagcctgggccacgtatttttaatagagacaggatttcatcacgttggccaggctggtctcgagctcctgacctcaggtgatccaccagcctgggccacttatttttagtagagacaggatttcgtcacgttggccaggccggtctcgagctcctgacctcaggtgatccacccgcctcggcctccctaagcgctgagattacaggtgtgagccaccacgcccggcctcaataagttattttagacattctgtggaatgtaacgtacgtttcctctcgtggctcatctgcctttgtacttgctgcacccaaactcccgatggggatttgtacaaaccgaacccgacgggggtgctagccgccccaggtcacctttgcgccttccacagaaggctccagctgtacaaggcaagaggaagaccccatctctaaagaagagatgggcttgtaatcatgttgaaatcacgatgttgtcgagctggggagcgtccgccggcaggaactcggaatctcactgctttttccctgtttttttgtgtgtgtttcagctttctatcgaaacacagagctgtccagcgactacctgaccacggtcagcccgacgtcacaatgcagcatgctgaagtacatgggcaggaccagctaccggtgctggggccacctggcagacgccgtgaggtgggggctgcccccaggcagatgctgggaggtggtggctgcacccaggcagatgctgggaggtgggggctgcccccaggcagatgctgggaggtggtggctgaccccaggcagatgctgggaggtgggggctgaccccaggcagatgctgggaggtgggggctgcacccaggcagatgctgggaggtgggggctgcccccaggcagatgctgggaggtggtggctgcacccaggcagatgctgggaggtgggggctgcccccaggcagatgctgggaggtggtggctgaccacaggcagatgctgggaggtgggggctgaccccaggcagatgctgggaggtggtggctgaccacaggcagatgctgggaggtgggggctgaccccaggcagatgctgggaggtgggggctgcacccaggcagatgctgggaggtgggggctgcacccaggcagatgctgggaggtgggggctgcacccaggcagatgctgggaggtgggggctgaccccaggcagatgctgggaggtgggcgctgcacccaggcagatgctgggaggtgggggctgaccccaggcagatgctgggaggtgggggctgcatccaggcagtgaccaagtctcaggactaccgccaggggctggtgaagtggcagtggaggaggtgaaagggaaggtttctttttctttgttttttcttttcttttctttcttttttttttttttgagatggagtcttgctctgtcacccagggtggagcgcagtggcgccatctcggctcattgcaagctatgcctcccgggttcacgccattctcctgcctcagcctcccaagtagctgggactacaggaacccgccaccacacccgactaattttttgtgtttttggtagagacggggtttcaccatgttagccaggatggtctccatctcctgacctcgtgatctgcctgcctacatggtggcaggcacctgtagtcccagctactcaggaggctaaggtgggagaactgcttgaacccagaaggcagaggctgcaatgagctgattgtgccactgcactgcagcctgggcaacagagcaaaaactctgtctcagaaagaaggaaacagaaagagagagagaggggagaaggaaggaaggaagggagggagggagggagggagggagggaaagaagggaaataatggaaagtaagagaaagaaagagaaggaaggaaagaaagagagagagagagagaagacctggactcaatagaaaggagtgtctgggtggccggacgcagtagcccatgccggtaatcccagcactttgggaggctgaggcgggcggatcacgaggtcaggagatcgagaccatcctggctaacacggtgaaaccccgtctctattaaaaatacaaaaaattagccgggcgtggtggcgggcgcctgtagtcccagctactcggagaggctgaggcaggaaaatggtgtgaacccgggaggcggaggttgcagtgagccaagatcgcaccactgcactccagcctgggcgacagagcgagactccatctcaaaaaaaaaaaaaaaaaaataggggtgtctgggttaacatagggggttgtggagaccaaattcttattatgtagatgaaatctccaggtagcaggcttcagaaagaatagactgttactgtttcctatctgacttggttctctcctggatcagaaaaaaggaaggaaaaggaaggtgattctctccagaacgtagattttctccacaacaggtagctttacaggagtatttcaagctatggtaaagagaacatgtttggggctaaaatatttttatttccttttttttttttttttttgagacagagttttgttttgttgcccaggctggagtgcagtggtatgatctcgactcactgcaacctccgcctcctgggtttaagtgattcacctgcctcagcctccccagtagctgggagtataggcatccaccacacctggctgattgtttgtgttttagtagagacggggtttcaccctgtctttgaggctggtctccaactcctgagctcaggctatctgcccccgtcttggcctcccagagtgttaggattataggtgtgagccaccacgcccagcctttgattttcttctttatctgtgatgggttgttatgccagagtcaggttggaaagtgagccacgtaatatagggttaaataaaacccatctcacgagactttatagttatagagcataactccctaggccccttagataagaatttgggcaaggaagaaaaaggtcacgtgtaacaattaagtcctcaggtttaaacaattaagcaacagctggccaggcgcggtggctcacgcctgtaatcccagcactttgagaggccgaggcgggtggatcacctgaggtcacgagttcgagaccagcctgaccaacatagtgaaaccccatctctactaaaaaatacaaaaatgagccaggcatggtggcgggtgcctgtcatcccagctactcgggaggttgaggcaggagaatcgcttgaaccgaggaggtggagattgcagtgagccaagatcgcgccattgcactccagcctgggcgacacagcgagactccgtctcataaaataaaataaggccaggtgcggtggctcacgcctgtaatcccagcactttgggaggccaaggcgggcagatcacctgaggtcaggagttcgagaccagcctgaccaacatgatgaaaccccatctgtactaaaaagtacaaaaattagccaggcacggtggcaggtgcctgtaatcccagctactcgggaggctgaggtaggaaaatcgcttgaacccgggaggcggagattacagtgagccaagatcgtgccattgcactccagcctgggcgacacagcgagactccatctcctaaaataaaataaggccaggtgtggtggctcacacctgtaaccccaccactttgggaggccgaggcgggtggatcacctgaggtcacgagtttgagaccagcctgaccaacatggtgaaacctgtctccactaaaaatacaaaaattagctgggcgtggtggcgggcgcctatagtcccagctactcgggaggctgaggcaggagaatggcgtgaacccagaaggcagaggttgcagtgagccgagatcgtgccattgcactccagcctgggctacagagctgaaatgaaatgaaacgaaatgaaacgaaatgaaatgaaatgaaatgaaatgaaatgaaatgaaatgaaaatcagccttctctctcttttcttagagaaggaaggaaccagtacctggagacgtttggcgttcccgctgaagagctttttacggccatctacaggtaacacccatcactttgaaaccaacaactcagataagattctgtttatttttaaaggacttaggaaacccaatccatttactcaaatggcacaacccaggaggaagctgccatttaatttaaaataacatcccctatccccactactaccccagattttgctcatctgatgtttaaattgatcaaattcctgaggaggtgcaacgtgacccttccttcgaaaggactactcacaaactcagtgtttatgtagaaaatggaggcacgcgccgggcgcggtggctcacgcctgtcatcccagaactttgggaggccgaggcaggtggatcacctgaggtcaggagttcgagaccagcctggccaacagggtgaaaccccgtctctactaaaaatacaaaaattagccgggcgtggtggcggacgcctgtaatcccagctagtcgggaggctgaggcaggagaactgcttgaacccgggaggcggaggttgcggtgatctgagatcgcaccactgcactccagcctgggcaacaagagtgaaactccatctcaaaaaagaaaagaaaagaatatagaggcccagtttttgatttggtcagaggtgaaggtgaggccaggtgagacctcagctcttcactttgctttgcgatgtggacacagctttggcctttgcccgaagctcttacctagaattcccagatggaggtgaattgatgggcccgtccagtgttccagctggctgaggcatggagtagggaagggtatgaaggacaaggggatgcctgagtggttcgcctgccccccaacctctcctctcctcccctgctctcccctcccctctcttctccttctgtcctgttccctctcttttcctcttccatcctcctctctttctctccttttccttctcttctcttctctcctctcttttcctctccatcttccccctcctctctcccatcttccctctcttgtctcctctctcttcttccctctctcctttcctctcgcctcccttcccctcccttcacctgcctctctccttctcctctcccgtcttctttctctcatcttctctgttttcatgccccgtatttcacctccttttctcctcctctcttctcctcggtctgctttcctttcccccgtttctctctttctttctctctctctttctttctttccttctttctttccttctttctccttccttccttcgttccttcctctttccttctgcctgccttccttccttccctccctccctcctttctttctttttctttcttccttcttccttctttcctttctttatatatatatatatgtgtgtatacatgtgtatgtgtatgtgaatatatgtatctgtttagggggcacaagtacccatgtcttccatgcttacatgttgcaccttgcagcctaggcttttagtgtgcccatcacctgaatagtgaccgtggtacctaagaggcaatttttcagccctcgctactctgaggcaaacccctacagcaggctctgcagagaggacaggaggagagagggagctgtggggggggaggagcaggaaatgcttccaacaccagagccctgtccgcctctgtgtccacctatccttcttggctccatctcacctgcctcccttcctagttcctgccttttctctagcctcttccccaggatgtgtggacctcccacccgcttcctggatttgtcctctggggctgagctctgtggatgggggaacgtattattgactttcctcttagaaaacatctaaactcctcttcagatagaaatcccttcccatccagagaacaatcgtccgttctgaatcaactccaggtttcccggagctgggtacactttgctggctgacctatggttcccccatcccgaatgacttcctgttccatttcacaaatgcaagccttccaggtgcacctgtggggtatagctccgttctcaacagggggttatgtacacccttgctctgggcacgtccccagatcctcaccatcttgacaagcgtggttttgcatgccaggtccgagggcgagcggctacagttcatgcaagctctgcaggaggtctggagcgtcaacgggagaagcgtgctgaccgcctttgacctgtcagtgttcccacttatgtgtgaccttggtggtaagtacccctcaccactaatacctcggaggtgtggcttctgttctgtatggggaatgtgttattcatgtcttttattttctgcattctgatgctttgacatgtgcggccttactggtcttagaggaatcattcctcccagcactgggcacttcctagagtcagcaaacatctcctctgcgagcacacgtttctttttcttttctttttttaagatggaagcttgctccatcgcccaggctgcagtgcagtggcatgatctcggctcactgcaacctttgcctcctgggttcaagcgattctcctgcctcagcctcccgagtagctgggattacaggcacctgccaccacaccaggctaatttttttttttttttttttttttgagatgaagtgtcgctctgtcgcccaggctggagtgcagtggcacgatctcggctcaccgcaacctccgcctcctgggttcaagcgattctcctgccccagcctcccgagtaggtgggattatgggtgcgcaccactctgtcaggctaatttttgtattttttaatagagacggggttttgccatgttggccaggctggtctcgaactcctgacctcatgatccacccgcctcggtcttgtttttagtttttgagagagggtcctgtttgtcacccaggctcgagtgcaatggtgtgttgatagctcactgcagcctcagactctcaggctcaagtggtcctcccacctcagcctcccaagtagctgggattacagatgactgccgccacacctagctcatttaaaaacttttctgtagagcctgagtctctctacgttgccctggctggtctcagactcctgggctcatgcaatcctgctgcctcagcctccaaaagtgctgggattacaggcgcccgccaccacacccaggctgagctgagcttgttttatttatttatttatttatttatttacttgtatttatttatttatttttttttttgagatggagtcttgctctgtcacccaggctggaatgcagtggtgcaatctccactcactgcaagctctgcctcccgggttcacgccattctcctgcctcagcctcctgagtagctgggactacaggcgcccgccaccacgcccagctaattttttgtttttttttttagtagagacggggtttctccgtgttagccaggatggtctcgatctcctgacctcgtgatccacccgcctccgcctcccaaagtgccaggattgcaggcatgagccactgcgccgagctcattttcaaacttttttgtagagaacgagtctccctatgttgccctggctggtctcagactccagtttcatgcagtcctcctgcctcggcctcccagagtgagtgatgggattacaggcatgagccactgcacccaggctgagcttgctttttgaatacaaatccccaaccccgagctcaccccttaagcacctcctctaccccatagggctgtcacactccaggccgtgatccacccaccctatctccctcctgtgactcagtggatcactcagaacagctcctggctggtagaaggccctttgcagagtgaggagcttctccaagtttattacttttagtcactgtgagcagggatagatagagttcaggatccccctgcctggggagcagcttgggaagaaaataatgaacaagcagaccgggcgcggtggctcactcctgtaatcccagcactttgggaggccgaggcgggtggatctcctgaggtcaggagttcgagatcagcctggtcaacatggtgaaatcccgtctctactaaaaatacaaaaaaaggctgggtgcggtggctcatgcctgtaatcccagcactttgggaggctgaggcgggcggatcccaaggtcaggagtttgagaccagcctgaccaacggggtgaaacccggtctctactaaaaatacaaaaacttagccaggcatgacagtaggtgcctgtcatcccaggtactcaggaggctgaggcaggagaatcgcttgtacccgggaagtgaaggttgcagtgagctgagatcgcgccactgcactccagcctggtgacagagtgagactccatctcaaaataaataaaaagactgactttctacagaaataatggacaaggagcatggggctggaagtctctgtggcccatgatggattttgtgtgcacgacttaccggggcctctgaatggggcttgttattacatccttctcttagctgttggccgcccttggctggacaggtgcgccggcttcaagaacacacagttaagtgcgtggccatatggaagtttggagcttgggtcagcccagccagaaagaccacctgaactcaggggcctgtagacaatcacgtcaccgtcaagattagacatggtggataaaaaaggatgagttcggccgggcgcggtggctcacgcctgtcatcccagcactttgggaggccgagatgggcggatcacgaggtcaggagatcgagaccatcctggctaacacggagaaaccctgtctctactaaaaatacaataaaaaaattagctgggcgtggtggcgggcgcctgtagtcccagctactggggaggctgaggcaggagaatggcgtgaacccgggaggcagagcttgcagtgagcggaaatcgtgccactgcactccagcctgggcgacagagccagactctgtctcaaaaataaataaattaataaataaaaggatgcgttcatgtcctttgcagggacatggataaagctggaaaccatcattctcagcaaactatcgcaaggacagaaaaccaaacaccgcgtgttctcactcataggtgggaactgaacaatgagaccacatggacacagggaggggaacgtcacacactggggcctgtcagggcctggggggctgggaggctgggggagggagagcactaggacaaatacctaatgtaaatgacgagtcgatgggtgcagcaaaccaccatggcacatggatacctatgtaacaaaaccgcatgttctgcacatgtaccctagaacttaaagtataataaaaagaaaaaaaagaccagacatggcggaaggacccaagttcctgggttggacccttcatgagtccatggtgtgtggagggtgagcgatgtctctcaggttcatctctgagggtcaaacgggctgtgtccccttccaggtggggctggagctctggctaaggaatgcatgtctctgtaccctggatgtaagatcaccgtttttgacatcccagaagtggtgtggacggcaaagcagcacttctcattccaggaggaagaacagattgacttccaggaaggtgtgtttgtgtccgtggggaagcagagatgtgtctcacggcttctccagggggactggatgtttctgggaaatgaagaagatgtgatgtggttttcctctcactcccggaaacaccctcaactcaacactgtctgttattcatgatggatggaaagctgggtgtagatatacagttttcttacaattattattattattattgatacagagtcttgctttgtcgcccaggctggagtgcagtggtgcagtctcggctcactgcaacctccacctcctgggttcaagcaattctcctgcctcagcctcccaagtagctgggattacaggcatgcgccaccacatccagctaatttttttttttttttgagatggagtctcactctcttgcccgggctggagtgtggtgacagatctcggctcccttcaagctccgcctcccgggttcacaccattctcctgcctcagcctcccaagtagctgggactacaggcacccaccaccacacctggctaatcttttatatttttagtagaggtggagtttcactgtgttagccaggatggtctcgatctcctgaccgcgtgatccgcccaccttggcctcccaaagtgctgggattacaggtgtgaaccatcacacccggcctctttttgtatttttagtagagatggggtttcaccgtgttgaccaggctggtctcaaactcctgacctcaggagatccacccgcctcggcctcccaaagtgctgggattacaggcgtgagccaccgcacccagccagtcatatcatttctgcagtgaagggtgtggccagggtctccacgactaccttcaggttcaataattcactagaaggacacaccgagctcagaagagccatcatacacatagttatatttacaacaatgaaagaatacagatgcatatcagcgaaggagaaaggagcatgggatagagttcgggagaaaccacatgtgagcttcttgttgtcttctcccagtggagctgtggacagcaatcaattcccccaacaacaaggtttgacaacacacaccactcactgccagcctggagagcctccgcaatccctgacatccaaggattttcttggagactggttacatagacatggcagacaccctgcatggctgactccaatcttcacctcttccagagttcccaaggtgatcctatagtaaatcccactgttagtacaaactatcctgggtggcccagagacccagctgaacaaagatacccttgtgaggtaggacattcttagagattacagttgccaattaagtgccaatcctctctttagaatgtggagggtttggacaacacaggcctgctgagttaaccccccccctttttttttcttgtttttttgagacggagtctcactctgtcacccaggctggagtgcagtggcgtgatccaagctcactgcaacctctgcctcccaggttcaagcaattttttgcctcagcctcctaagtagctgagattttacaggtgcctatcaccatgcctggctaattttttgtatttttagtagagacagggtttcactatctcggccaggctggttttgaattcctgacctcgtgatccacctgcctcggcctcccaaagtgctggggattacaggagtgagccaccgcgcctggcctgagttaactcttttttttttttttttgagatggagtctcgctctgtcacccaggctggagtgcagtggtgggatctcggctcactgcaagctccacctcccgggttcacaccattctcctgcctcagcctcccgagtagctgggactacaggcgcccaccaccacgcccagctaattttttttttttttttgtatttttggtagagatggggtttcaccgtgttagccaggatggtctcaatctcctgatctcgtgatctgccccgctcagactcccaaagtgctgggattacaggcgtgagccaccgcgcctggcctgaattaactcttcactgcacagagctcaccaagatctctcccaagattggcaccttatcattttgcgggaaaactatgacaagacttgagcgtttcacatcgcacacacataaagggtcagtcttgcgtatttactttaaatctggagaacaggtcttgactgtaggttcagttcagctcatcagttaggagctgctgaccgaattcccagggactcctggaatccacggctttgggtgatatcagcagcagtgcttttgcaggggacatcagaaagaaagaaagaaagaacatgggccgggcacagcagctcatgcctgtaatcccagcactttgggaggccgaggcgggcggatcacctcaggttgggggttcgagaccagcctcagcaacatggagaaatcccatctctactaaaaatacaaaaattagccgggcgtggtggcgggtgcctgtaatcccagctactcaggaggctgaggcaggagaatcgcttgaaaccaggaggtggaggttgcggtgagctgagatcaggcccttgcactccagcctgggcaacaagagcaaaactccatctcaaacaaacaaacaaacaaaaaaacaaaaaagaaaccatattatgatttttttttaaaggaggaggagagaaagaggccacacttattcagtattttctttctttttttttttttggagacagtctcgctgtcgcccaggctggagtgcaatggtgcaatctcggctcactgcaagctccgcctcccgggttcatgccattctcctgcctcagcctcccgagtagctgggaccacaggcacccgccatcacgcccggctaattttttttgtatttttagtagagacagggtttcaccgtgttagccaggatggtcttgatctcctgacctcgtgatctgcccacctccgcctcccaaagtgctaggattacaggcgtgagccaccgcgcccgacctcagtattttcttatctttctcctaagcctttttgttttctgaggctaggtctgcaggtgactagcctggaagacctgggaaaggcgtgacccatccaggtgaccttttgtgcccagaataggtttagtcaaatgggattggattgcaggctgacctcggtgtgcctgccctgtgttccaggggatttcttcaaagaccctcttccggaagctgatctgtacatcctggccagggtcctccatgactgggcagacggaaagtgctcacacctgctggagaggatctaccacacttgcaagccaggtaagttgtggggtttgcatttcagcgtgtgcttgtgacacggggcagaattgtacgagtcacatttagaaggcaggcactgaaatcatcccacaggtaagggtagacatcctgcccaatatggctttccttttagataacgacctgaaataaatagggtcctaatttctattctattgataaaaccacataaagatggaaaaagtgaaaggccctctgaaacttcagtggcctcactttggtgaaattctttcagaattaggctagtatttgtgtgtgtgatgaggacagtgccccactgacttctgaggtccacccatcctgatggttcatgaggatgtgggcacagcctctgtgtgtgatggggacagtgtcccagctctcctgtgaggtccatccatcctgatggcacatgaggatgtgggcacagcctctgtgtgtgatggggacagtgtcccagctctcctgtgaggtccatccatcctgatggcacatgaggatgtgggcacagcctctgtgtgtgagataaggactgtgtcccagctctcctgtgaggtccacccatcctgatgcttcacgaggacgtgggcacagcctctgtgtatgatggggacagtgtcccagtgtcctgtgaggtccatccatcctgatggcacatgaggatgtggacacagcctctgtgtgtgtgatggggacagtgtcccagtgtcctgtgagatccatccctcctgatggttcatgaggatgtgggcacagcctctgtgtatgatggggacagtgtcccagtgtcctgtgagatccatccctcctgatgcttcacgaggacgtgggcacagcctctgtgtatgatggggacagtgtcccagtgtcctgtgaggtccacccatcctgatggcacatgaggatgtgggcacagcctctgtgtgtgagatagggaccatgtcccagctctcctgtgaggtccatccatcctgatgatccatgaggatgtggacacagcctctgtgtgtgtgatggggacagtgtcccagtgtcctgtgagatccatccctcctgatggttcatgaggatgtgggcacagcctctgtgtgtgagatagggaccatgtcccagctctcctgtgaggtccatccatcctgatgatccatgaggatgtggacacagcctctgtgtgtgtgatggggacagtgtcccagtgtcctgtgagatccatccctcctgatggttcatgaggatgtgggcacagcctctgtgtgtgagatagggaccatgtcccagctctcctgtgaggtccatccatcctgatggcacatgaggatgtgggcacagcctctgtgtgtgagatagggaccatgtcccagctctcctgtgaggtccatccatcctgatgatccatgaggatgtggacacagcctctgtgtgtgtgatggggacagtgtcccagtgtcctgtgagatccatccctcctgatggttcatgaggatgtgggcacagcctctgtgtgtgagatagggaccatgtcccagctctcctgtgaggtccatccatcctgatggcacatgaggatgtgggcacagcctctgtgtgtgagatagggaccatgtcccagctctcctgtgaggtccatccatcctgatgatccatgaggatgtggacacagcctctgtgtgtgtgatggggacagtgtcccagtgtcctgtgagatccatccctcctgatggttcatgaggatgtgggcacagcctctgtgtgtgagatagggaccatgtcccagctctcctgtgaggtccatccatcctgatgatccatgaggatgtggacacagcctctgtgtgtgtgatggggacagtgtcccagtgtcctgtgagatccatccctcctgatggttcatgaggatgtgggcacagcctctgtgtgtgagatagggaccatgtcccagctctcctgtgaggtccatccatcctgatggcacatgaggatgtgggcacagcctctgtgtgtgagatagggaccatgtcccagctctcctgtgaggtccacccatcctgatgcttcacgaggacgtgggcacagcctctgtgtatgatggggacagtgtcccagtgtcctgtgaggtccatccatcctgatggcacatgaggatgtggacacagcctctgtgtgtgtgatggggacagtgtcccagtgtcctgtgagatccatccctcctgatggttcatgaggatgtgggcacagcctctgtgtgtgagatagggaccatgtcccagctctcctgtgaggtccacccatcctgatgatccatgaggatgtggacacagcctctgtgtgtgtgatggggacagtgtcccagtgtcctgtgagatccatccatcctgatggcacatgaggatgtgggcacagcctctgtgtgtgagatagggaccatgtcccagctctcctgtgaggtccatccatcctgatgatccatgaggatgtggacacagcctctgtgtgtgtgatggggacagtgtcccagtgtcctgtgagatccatccctcctgatggttcatgaggatgtgggcacagcctctgtgtgtgagatagggaccatgtcccagctctcctgtgaggtccacccatcctgatgatccatgaggatgtggacacagcctctgtgtgtgtgatggggacagtgtcccagtgtcctgtgagatccatccatcctgatggttcatgaggatgtgggcacagcctctgtgtgtgagatagggaccatgtcccagctctcctgtgaggtccatccatcctgatggcacatgaggatgtgggcacagcctctgtgtgtgagataaggactgtgtcccagctctcctgtgaggtccacccatcctgatgcttcacgaggacgtgggcacagcctctgtgtatgatggggacagtgtcccagtgtcctgtgaggtccatccatcctgatggcacatgaggatgtggacacagcctctgtgtgtgtgatggggacagtgtcccagtgtcctgtgagatccatccctcctgatggttcatgaggatgtgggcacagcctctgtgtgtgagatagggaccatgtcccagctctcctgtgaggtccacccatcctgatgatccatgaggatgtggacacagcctctgtgtgtgtgatggggacagtgtcccagtgtcctgtgagatccatccatcctgatggcacatgaggatgtgggcacagcctctgtgtgtgagatagggaccatgtcccagctctcctgtgaggtccatccatcctgatgatccatgaggatgtggacacagcctctgtgtgtgtgatggggacagtgtcccagtgtcctgtgagatccatccctcctgatggttcatgaggatgtgggcacagcctctgtgtgtgagatagggaccatgtcccagctctcctgtgaggtccacccatcctgatgatccatgaggatgtggacacagcctctgtgtgtgtgatggggacagtgtcccagtgtcctgtgagatccatccatcctgatggcacatgaggatgtgggcacagcctctgtgtgtgagatagggaccatgtcccagctctcctgtgaggtccacccatcctgatgatccatgaggatgtggacacagcctctgtgtgtgtgatggggacagtgtcccagtgtcctgtgaggtccatccctcctgatggttcatgaggatgtgggcacagcctctgtgtgtgagatagggaccatgtcccagctctcctgtgaggtccacccatcctgatgatccatgaggatgtggacacagcctctgtgtgtgtgatggggacagtgtcccagtgtcctgtgagatccatccctcctgatggttcatgaggatgtgggcacagcctctgtgtgtgagatagggaccatgtcccagctctcctgtgaggtccacccatcctgatgcttcatgaggacgtgggcacagcctctgtgtatgatggggacagtgtcccagtgtcctgtgagatccatccatcctgatggcacatgaggatgtgggcacagcctctgtgtgtgagatagggaccatgtcccagctctcctgtgaggtccatccatcctgatgatccatgaggatgtggacacagcctctgtgtgtgtgatggggacagtgtcccagtgtcctgtgagatccatccctcctgatggttcatgaggatgtgggcacagcctctgtgtgtgagatagggaccatgtcccagctctcctgtgaggtccacccatcctgatgatccatgaggatgtggacacagcctctgtgtgtgtgatggggacagtgtcccagtgtcctgtgagatccatccatcctgatggcacatgaggatgtgggcacagcctctgtgtgtgagatagggaccatgtcccagctctcctgtgaggtccacccatcctgatgatccatgaggatgtggacacagcctctgtgtgtgtgatggggacagtgtcccagtgtcctgtgaggtccatccctcctgatggttcatgaggatgtgggcacagcctctgtgtgtgagatagggaccatgtcccagctctcctgtgaggtccacccatcctgatgatccatgaggatgtggacacagcctctgtgtgtgtgatggggacagtgtcccagtgtcctgtgagatccatccctcctgatggttcatgaggatgtgggcacagcctctgtgtgtgagatagggaccatgtcccagctctcctgtgaggtccacccatcctgatgatccattaggatgtggacacagcctctgtgtgtgtgatagggaccatgtcccagtgtcctgtgaggtccacctatcctgatggtccatgaggatgtggacacagccgctctgtgtgtgatggggacagtgtcccagctctcctgtgaggtccatccatcctgatggttcatggggacgtgagcacagcctctgtgtgtgtgttggggacagtgtcccagttctcctgtgaggtccacccatcctgatggttcatgaggatgtgggcacagcctctgtgtgtgtgatggggacagtgtcccagtgtcctgtgaggtccacccatcctggtggtccatgagtacatggacacagcctctctgtgtgagatggggacagtgtcccagttctcctgtgaggtccacccatcctggtggtccatgagtacatggacacagcctctctgtgtgtgataaggacagtgttccagctctcctgtgaggtccacccatcttgatggttcatgaggacttgggcatggcctctatgtgtgtgatggggacagtgtcccagtgtcctgtgaggtccacccatcctgatggtccatgaggatgtgggcacaacctctttgtgtgtgatggggacagtgtcccagtgtctgtgaggtccacccatccgatggttcatgaggacgtgggcacagcctctgtgtgtaatggggatagcatcccagtgtcctgtgaggtccatccatcctgatggcccatgaggatgtgggcacagcctctgtgtgtgtgtgtgtgatggggacggtgtcccagttctcctgtgaggtccacccatcctgatggtccatgaggacatgggcacagcctctctgtgtgtgataaggacagtgttccagctctcctgtgaggtccacccatcttgatggttcatgaggacttgggcacagcctctgtgtgtgtgatggggacagtgtcccagtgtcctgtgaggtccatacatcctgatggtccatgaggacatgggcacaacctctgtgtgtataatggggacagtgtcccagtgtcctgtgaggtccacccatcctgatggttcatgaggacgtgggctcagcctctgtgtgtaatgaggacagtgtcccagtgtcctgagaggtccatcgatcctgatggcccatgaggatgtgggcacagcctctgtgtgtgtgtgatggggacggtgtcccagttctcctgtgaggtccatccatcctgatggttcatgaggacatgggcacagcctctatgtgtgtgatggggacagtgtcccagcgtcctgtgaggttcacccatcctgatgatcgatgaggacgtgggcacagcctctgagtgtgtgatggggacggtgccctgactgtcctctgaggtctggctgtccttatggttcactgggactttggcacagtctgtctgtgtgtttgtgtgtgatgtggactgtgcccctccctttctaggtggtggcattctggtaattgaaagcctcctggatgaagacaggcgaggtcctctgctcacgcagctctactctctgaacatgcttgtgcagacggaagggcaggagaggacccccacccactaccacatgctcctctcttctgctggcttcagagacttccagtttaagaaaacaggagccatttatgatgccattttagccaggaaataactgtttcttgtgacctggaactaacgtcaaagcacacaagacataataataaagacatgtacctcca

SEQ ID NO: 2884 - DNA, 28080 bp, human
acacgctttgtgatcccctaatacggttaatgcaaatttctagagtgatccgtctttgtttgagtactgggcaggcagcagggagagtcaggcagcagctgtgagcgggtggctcttccccaccttgccagcaggctctgtgctccttgaagcaagcgctccagaggctccggaagccacggctggattggagacaagatgggatcctcagaggaccaggcctatcgcctccttaatgactacgccaacggcttcatggtgtcccaggtaggatacgctctgtgggacaagggggaatagacttccgttcatcacactcacgttccattgttgtgtcagtcgagaaaaatgatgagtctccatcattttaggaggtttattttccaccgtgaaagacgtacacccacgatgtagcctcaggagttcctgaggacatgtgcccagggtggtctggggacagcttggtttgatacattttacagagacatgagtcatcaatcaatgtatgtaagtacattgggccagtcgtggtggctcacacctgtgatcccagcactttgggaggctgaggcgggcggatcacctgaggtcgggagttcgagaccagcctgacccacacagagaaaccccatctctactaaaaatacaaaattagccaggcttggtggtacatgcctataatcccagctacttgggaggctgaggcaggagaatcgcttgaacctgggaggcggaggttgcagtgagccgagatcgcaccactgcactcccgcctgggggacacagcaagactctgtgtcaaaaaaaaaccaaacaaacaacaaaaaaaaagaaacaaagcttaagatgaaatacataggattagaaacaagacaatgtttattgaactgcaagtgttgaaatttttaaaacatttcatgatagagtagtatatgtggttgtttattaacccagtaaataattacactgtgcgtttatcatagaggtgagttttgagggttcacccgtagaggagcaacacctcattccttttttttatttttttgagctggagtctcactctgtaacccaggctggagtgcagtggcacggtcttggctcactgcaacctccgcctccagggttcaggctattctcctgcttcagcctcccgagtatctgggattacaggcacccaccaccacgcccggctaatttttgtatttttagtagagatggggtttcaccatgttggccaggctggtctcgaactcctgacctcaagtgattcacctgcctcggcctcccaaggcctcatttcttcttctcacagaataacatcgtgctcagtgaaggaaggctgacgtgaaaggccccatatggtatgacttcatttatatgaaatgtgcagagcaggcaaatccttcgaggtggaaagtggactggtggtttgcagaggctgggcaggactgcggagggagtgtttaacggagacagtgtccctttttggggtgatgcaaatgttctggaacccggcggaagtgctggctatacaacatcacgaatgtactaagtgcccctgaattatgcttgaaaagggttaatgatggccgggctcagcggtgacacctgtcatcccaacggtttgggggtccgaaacgagggaatcgctttagcccaggaattcgagaccagtctgggcaacatagtgagaccccccatttctacaaattcttttttctttttgagacagagtctcgctctgtcgcccaggctggagtgcaatggcacgatctcggctcactgcaagctccacctcccaggttcacgccattctcctgcctcagcctcccgagtagctgggattacaggcacccgccaccacgcccggctaattttttgtatttttagtagagacggggtttcaccgtgttagccaggatggtctcgatctcctgacctcatgatccgcccgcctcggcctcccaaagtgctgggattacaggcgtgagccactgtgcctggccaaaaatattttaaaaattagccaggtggggtggtgcacacctgtagtcccagctactcaggaggctgaggcgggaggatcgcttaagcctaggagatgaaggctgcagtgagctatgattgcaccactgcactccagcctggatgacagagcaatactgagtctctttaaaaaataaacggcagggcgcggtggctcatgcctgtcatcccagcactttttggggtccaaggtgggcggatcacttgaggtcaggagttcaagaccagcctggccaacatggtgaaaccccgtctctactagaagtataaaaattagccaggcatgatggtgggcacctgtcatcccatttactcgggaggctgaggcaggagaattgcttgaacccggaggaggtagaggttgcagtgagccgagattatgccactgcactccagcctgggtgtcgcagtgagactctgtctcagaacaaaaaccaaaaaccagcatcatcgtgaaagggggtcgtgtgctgacgatattttgagatgtctgcagcagctctcgtgtgacttgaaaatatctgtggtttctctccgtcagcaagccaccggttttttttgtttgtttttttcctttttttttttcagacagagtttccctcttgtcgcccaggctggagcgcagtggcgctatctcggctcactgcaacctctgcctcccgggttcaagcgattctcctgcctcagcctcccgagtagctgggagtacaggcgcgttccaacacgcccagataattttgtatttttagtagagatggggtttctctatgttggtcaggctggtctcgaactcccaacctcaggtgatcctcctggcccccacactttcttctatcatggctgtggtttgccagtacgctcatggttgaagggaacaccacatcttaggaagaggtagtgaaaattagagtgaagtctcttctccttcctggtttgtagagcccgtgaattttacctctaggcccccaagggttaaaaatacctattccccagccactgatacgcagagcggcctccgcctacggggttcaagcgattctcctgcctcagcctcctgagtacctgggattacaggtgcctgccaccaagcctggctaacttttatttttatttttatttttatttatttttctgatatggagtttcactgttgttgcccaggctggagtgcagtggcatgatctcagctcactgcaacctctccctcccaggttcaagcaattcccctgccttagcctcctgagtagctgggatttcaggcgtccaccaccacgcccggctaatttttgtatttttggcagagacggggtttcatcatgttggccaggctggtgtcgaactcctgacctcgggcgatctgcctgcctcggccttccaaagtgctaggattacaggtgtgagctactgcctctggctaattttttgtagttttggtagagatgaggtttcatcatgttggccaggctggtcttgaactcctgaccttgggcaatctgcctgcctcagcctcccaaagtgctaggatgacgggcgtgagccactgacatccagctaattttttgtatttttggtagagacggggtttcatcatgttgtccaggctggtctcgaactcctgacctcgggtgatctgcctgcctcagcctcccaaagtgctaggattataggcatgagccaacatgtctggctaatttttctattttttagtaaaggtgggatttctgttactgtcccagacaacagtaacttgctacctttgcctcctttgaccgcaggcctcctgctggggctattgactgctcattcaaagactgtcgctggttcacagcggtgttcagggaggtggtctggtgggttctaaatcttggaagagcagtcactttaaggcacatgataccatgtcatgggagttgtcagaagtttcacagaaccagagttaatgcagagttaataccaccttaagaggatcaaacttagtacacccttaacagaaacaattagctaatgcagctttcatagaccaagagtgaatatcgccttaagaagataacatttagtatacccttggccaggcacagtggctcacgcctgtaatcccagcactttgggaggccgaggcgggcggatcacaaggtcaggagttcgagaccagcctggccaatatggtgaaatcccatctctactaaaaatacaaaaattacctgggcgtggtggcgggcacctgtagtaccagctacttgggaggctgaggcacgagaatggcgtgaacccgggaggtggaggttgcagtgagccgagatcacgccactgcactccagccttgggggcagagcgggaccctgtctcaaaaaaaaaaaaaaaaagtgggggctggggagggagagcactaggacaaatacctaatgtaggtgacgggttgacaggtgcagcaaaccaccatggcacatgtatacctgtgcaacaaacctgcacgttctgcacatgtaccccagaacttaaagtataataataataataataataataataataataataataaaaagtctttgggagcagaaaaaaaaaaagatcaaagttagcgtacccttaacagaaacagttaatgcacctttcatagaccaagggtgaactcagccataagaaggtaacatttaatatatgcccttaaaagaacaattaattgagacaaccccaaaaggaatgaatacaactttaatgaataaaacaaaacagaacgctaatttaaaaaggttaatacgggccgggcgtggtggctcatgcctgtaatctgagcactttgggaggccgaggaaggtggatcaggaggtcaggagattgagaccatcctggctaacacggtgaaaccccgtctctactaaaaatattttaaaaattagccgggcgtggtggtgggcgcctgtagtttcagctactcgggagactgaggcaggagaatcccttgaacccgggaggcggagcttgctgtgagccgagatcgcaccactgcactccagcctgggtgacagagccagactccgtctcaaaataaataaataaataaataaataaaaaagaaaaaggttaatacaacattaaagaacaagaattaatatagctttttttttttttttttttttttgagacctagtctcactctgttgcccaggctggagggcagtggcatgatctcagctcactgcaacctccgcctcccgggttcaggcgattctcctgcctcagcctcccgaataggtgggattacaggcgtgcaccaccatgcctactttttgtatttttagtagagacggggtttcactatgttggccaggctggtgtcgaactcttgacctcaagtgatctgcctgccttggcctcccaaagtgctgggatgacaggtgtgagccactgcacctggcctaatatagctttaatagaaaaggagctaatacaagcttagaataataaactttatgcagacttactgaaacaaacagtcaatgcaaccttaaccaaacaggaattgataacagtttaataaaaaagctaataccacttgaatagaatatatcttactacaaccttcataagaaaaacaactaatacactttgggagaccgaggcaggcagatcacgaggtcaggagatcgagaccatggtgaaaccccgcctctactaaaaatacaaaaaaattagcctggcatggtggcgggcacctgtagtcccagctagtcgggaggctgaggcaggagaatggcttgaacctgggaggtggaggttgccgtgaggcgtgatcgtgccactgcactccagcctggcgacagagcgagactctgtctcaaaaaaataatgataataataataaacaaataaagataccaaaaaaaaaatacaaaaatttagccgggtgtggtggcacgtgcctgtaatcacagctactcgggaggctggggcaagagaatcacttgaacgcgggaggcgtaggttgccgtgagccgagattgcaccgctgcactccagcctgggtgacagagcgagactccgtctcaaaaaaaagaacaaacaaaaagatagtggtaggtgtaatctgtgtttctttccccatgctgttgaaataaagctaactgtaagtatcctggaagacacgtggcctgaagaaaccatctttccctgtggtttgtttatgacttcctgtcactaaggttgcctgagccttggcacccatccaaaacgatgtgtgcaagaaaagaaatgcatggatgatttattcttgttttattttttttttgagatggagtctcgctctgttgcccaggctggagtgcagtggcgcgatcttggctcactgcaatctccacctccaggattcaagcaattctcctgcctcaccctccccagtagctgggactacaggctcacaccaccatgcccagctaatttttatacttttagtagagatggggtttcaccatgttggccaggttagccctgaactcctgacctcaggtgatccgcccacctcggcctcccagaatgttgggattacaggcgtgagctaccacgcctggctgatttattcattttttatagtttgtgtattatttgaaggcattacctgattactgctttattttatttttatatgtatttatttatttatctattgagacggagtttcgctcttgttgcccaggctggagtgcaatggcacgatctcggctcaccacaacctctgcctcccgggtgcaagtgattctcctgcctcagcctcccgagtagctgggattacaggcatgcaccaccacaccaggctaattttgtatttttagtagagatggggtttctgcacgttggtcaggctggtcacgaactcacaacctcagttgctccacctgcctcggcctcccaaagtgctgggatgacaggcgtgagccaccgcacccggcctatttattttttttgagacggagtctcactctgtccagcccaggctggagtgcagtgatgcgatcttggctcactgcaacctctgcctcccgggtttacgccattctcctgcctcagcctcccgagtagctgggatacaggtgcgcaccaccatgcctggctaatttttgtatttttagtagagacggagtttcaccatgttggccaggctggtctcgaacccctgacctcaagtgatctaccctcctaggcctcccaaagtgctgggattacaggcgtgagccaccacgcccggtcctctgtctctgtttttgagacagagtcttactctgtcacccaggcttggagtgcagtggtgagatctcggctcactgcaacctccgcttagcaggttcaagcgattctcctgcctcagcctcccaagtagttgggattacaggcatgagccaccacgcccggctaatttttgtatttttagtagagatggggtttcaccatgttggccaggctggtctcaaactcctgacctcaggtgatccacccacctcccaaagcgcagggattataggtatgagttaaagcacccagccaggagacatttttaaatgaggttgcacggctatggaaaacagggtggggccaggcgcaatggctcacgcctgtcatcccagcactttgggaggccgaggctggcagatcacgaggtcagaagttcgagaccagcctggccaacatggtgaaaccccatctttactaaaaacacaaaaattagacaggcatggtggaacaggcctgtaatcccagctactcgggaggctgaggcaggagaatggtgtgaagccgggaggcagaggttgcagtgagccgagaccgcaccactgccctccagcctgggtgatacagtgagacttcaactcaaaataaataaattaattaattaataaaaataaataaataaatatgactgttttccatagtggtgcaatctcatttgactctgtctcaaaaaaaaaaataaataaatgaataagaatataaataaaacaatgctttcctccctagcctgccatggtatggggtgtttctaagactgtggttcccaggaggctgagccctgaccttttatttccgctcctgctccaaggttctcttcgccgcctgcgagctgggcgtgtttgaccttctcgccgaggccccagggcccctggacgtggcggcagtggctgcaggtgtgagggccagcgcccatgggacagagctcctgctggacatctgtgtgtccctgaagctgctgaaagtggagacgaggggaggaaaaggtgaggacacgggcgttttgaaggaggcattttacatagacaccctctgcagcccacgtgttctgtaaaaagtgaaacagtctccatcctggctcacacagtgaaaccccgtctctactaaaaaaaatacaaaaaattagccgggtgtggtggcgtgcacctgtcatcccagctactcaggaggctgaggcaggagaatggcatgaacccgggaggcagaggttgcagtgagccgagatcgtgccactgcactccagtctgggcgacagagcgagactccatctgtatttgcaggtttgggggtcgtgtggtttttgtggcagctaccgacctctgccctggggacgtcaaagctgccagagtgtgagacccaggctgggggattccttgagcccaggagttcgagaccagcctgggccacgtatttttaatagagacaggatttcatcacgttggccaggctggtctcgagctcctgacctcaggtgatccaccagcctgggccacttatttttagtagagacaggatttcgtcacgttggccaggccggtctcgagctcctgacctcaggtgatccacccgcctcggcctccctaagcgctgagattacaggtgtgagccaccacgcccggcctcaataagttattttagacattctgtggaatgtaacgtacgtttcctctcgtggctcatctgcctttgtacttgctgcacccaaactcccgatggggatttgtacaaaccgaacccgacgggggtgctagccgccccaggtcacctttgcgccttccacagaaggctccagctgtacaaggcaagaggaagaccccatctctaaagaagagatgggcttgtaatcatgttgaaatcacgatgttgtcgagctggggagcgtccgccggcaggaactcggaatctcactgctttttccctgtttttttgtgtgtgtttcagctttctatcgaaacacagagctgtccagcgactacctgaccacggtcagcccgacgtcacaatgcagcatgctgaagtacatgggcaggaccagctaccggtgctggggccacctggcagacgccgtgaggtgggggctgcccccaggcagatgctgggaggtggtggctgcacccaggcagatgctgggaggtgggggctgcccccaggcagatgctgggaggtggtggctgaccccaggcagatgctgggaggtgggggctgaccccaggcagatgctgggaggtgggggctgcacccaggcagatgctgggaggtgggggctgcccccaggcagatgctgggaggtggtggctgcacccaggcagatgctgggaggtgggggctgcccccaggcagatgctgggaggtggtggctgaccacaggcagatgctgggaggtgggggctgaccccaggcagatgctgggaggtggtggctgaccacaggcagatgctgggaggtgggggctgaccccaggcagatgctgggaggtgggggctgcacccaggcagatgctgggaggtgggggctgcacccaggcagatgctgggaggtgggggctgcacccaggcagatgctgggaggtgggggctgaccccaggcagatgctgggaggtgggcgctgcacccaggcagatgctgggaggtgggggctgaccccaggcagatgctgggaggtgggggctgcatccaggcagtgaccaagtctcaggactaccgccaggggctggtgaagtggcagtggaggaggtgaaagggaaggtttctttttctttgttttttcttttcttttctttcttttttttttttttgagatggagtcttgctctgtcacccagggtggagcgcagtggcgccatctcggctcattgcaagctatgcctcccgggttcacgccattctcctgcctcagcctcccaagtagctgggactacaggaacccgccaccacacccgactaattttttgtgtttttggtagagacggggtttcaccatgttagccaggatggtctccatctcctgacctcgtgatctgcctgcctacatggtggcaggcacctgtagtcccagctactcaggaggctaaggtgggagaactgcttgaacccagaaggcagaggctgcaatgagctgattgtgccactgcactgcagcctgggcaacagagcaaaaactctgtctcagaaagaaggaaacagaaagagagagagaggggagaaggaaggaaggaagggagggagggagggagggagggagggaaagaagggaaataatggaaagtaagagaaagaaagagaaggaaggaaagaaagagagagagagagagaagacctggactcaatagaaaggagtgtctgggtggccggacgcagtagcccatgccggtaatcccagcactttgggaggctgaggcgggcggatcacgaggtcaggagatcgagaccatcctggctaacacggtgaaaccccgtctctattaaaaatacaaaaaattagccgggcgtggtggcgggcgcctgtagtcccagctactcggagaggctgaggcaggaaaatggtgtgaacccgggaggcggaggttgcagtgagccaagatcgcaccactgcactccagcctgggcgacagagcgagactccatctcaaaaaaaaaaaaaaaaaaataggggtgtctgggttaacatagggggttgtggagaccaaattcttattatgtagatgaaatctccaggtagcaggcttcagaaagaatagactgttactgtttcctatctgacttggttctctcctggatcagaaaaaaggaaggaaaaggaaggtgattctctccagaacgtagattttctccacaacaggtagctttacaggagtatttcaagctatggtaaagagaacatgtttggggctaaaatatttttatttccttttttttttttttttttgagacagagttttgttttgttgcccaggctggagtgcagtggtatgatctcgactcactgcaacctccgcctcctgggtttaagtgattcacctgcctcagcctccccagtagctgggagtataggcatccaccacacctggctgattgtttgtgttttagtagagacggggtttcaccctgtctttgaggctggtctccaactcctgagctcaggctatctgcccccgtcttggcctcccagagtgttaggattataggtgtgagccaccacgcccagcctttgattttcttctttatctgtgatgggttgttatgccagagtcaggttggaaagtgagccacgtaatatagggttaaataaaacccatctcacgagactttatagttatagagcataactccctaggccccttagataagaatttgggcaaggaagaaaaaggtcacgtgtaacaattaagtcctcaggtttaaacaattaagcaacagctggccaggcgcggtggctcacgcctgtaatcccagcactttgagaggccgaggcgggtggatcacctgaggtcacgagttcgagaccagcctgaccaacatagtgaaaccccatctctactaaaaaatacaaaaatgagccaggcatggtggcgggtgcctgtcatcccagctactcgggaggttgaggcaggagaatcgcttgaaccgaggaggtggagattgcagtgagccaagatcgcgccattgcactccagcctgggcgacacagcgagactccgtctcataaaataaaataaggccaggtgcggtggctcacgcctgtaatcccagcactttgggaggccaaggcgggcagatcacctgaggtcaggagttcgagaccagcctgaccaacatgatgaaaccccatctgtactaaaaagtacaaaaattagccaggcacggtggcaggtgcctgtaatcccagctactcgggaggctgaggtaggaaaatcgcttgaacccgggaggcggagattacagtgagccaagatcgtgccattgcactccagcctgggcgacacagcgagactccatctcctaaaataaaataaggccaggtgtggtggctcacacctgtaaccccaccactttgggaggccgaggcgggtggatcacctgaggtcacgagtttgagaccagcctgaccaacatggtgaaacctgtctccactaaaaatacaaaaattagctgggcgtggtggcgggcgcctatagtcccagctactcgggaggctgaggcaggagaatggcgtgaacccagaaggcagaggttgcagtgagccgagatcgtgccattgcactccagcctgggctacagagctgaaatgaaatgaaacgaaatgaaacgaaatgaaatgaaatgaaatgaaatgaaatgaaatgaaatgaaaatcagccttctctctcttttcttagagaaggaaggaaccagtacctggagacgtttggcgttcccgctgaagagctttttacggccatctacaggtaacacccatcactttgaaaccaacaactcagataagattctgtttatttttaaaggacttaggaaacccaatccatttactcaaatggcacaacccaggaggaagctgccatttaatttaaaataacatcccctatccccactactaccccagattttgctcatctgatgtttaaattgatcaaattcctgaggaggtgcaacgtgacccttccttcgaaaggactactcacaaactcagtgtttatgtagaaaatggaggcacgcgccgggcgcggtggctcacgcctgtcatcccagaactttgggaggccgaggcaggtggatcacctgaggtcaggagttcgagaccagcctggccaacagggtgaaaccccgtctctactaaaaatacaaaaattagccgggcgtggtggcggacgcctgtaatcccagctagtcgggaggctgaggcaggagaactgcttgaacccgggaggcggaggttgcggtgatctgagatcgcaccactgcactccagcctgggcaacaagagtgaaactccatctcaaaaaagaaaagaaaagaatatagaggcccagtttttgatttggtcagaggtgaaggtgaggccaggtgagacctcagctcttcactttgctttgcgatgtggacacagctttggcctttgcccgaagctcttacctagaattcccagatggaggtgaattgatgggcccgtccagtgttccagctggctgaggcatggagtagggaagggtatgaaggacaaggggatgcctgagtggttcgcctgccccccaacctctcctctcctcccctgctctcccctcccctctcttctccttctgtcctgttccctctcttttcctcttccatcctcctctctttctctccttttccttctcttctcttctctcctctcttttcctctccatcttccccctcctctctcccatcttccctctcttgtctcctctctcttcttccctctctcctttcctctcgcctcccttcccctcccttcacctgcctctctccttctcctctcccgtcttctttctctcatcttctctgttttcatgccccgtatttcacctccttttctcctcctctcttctcctcggtctgctttcctttcccccgtttctctctttctttctctctctctttctttctttccttctttctttccttctttctccttccttccttcgttccttcctctttccttctgcctgccttccttccttccctccctccctcctttctttctttttctttcttccttcttccttctttcctttctttatatatatatatatgtgtgtatacatgtgtatgtgtatgtgaatatatgtatctgtttagggggcacaagtacccatgtcttccatgcttacatgttgcaccttgcagcctaggcttttagtgtgcccatcacctgaatagtgaccgtggtacctaagaggcaatttttcagccctcgctactctgaggcaaacccctacagcaggctctgcagagaggacaggaggagagagggagctgtggggggggaggagcaggaaatgcttccaacaccagagccctgtccgcctctgtgtccacctatccttcttggctccatctcacctgcctcccttcctagttcctgccttttctctagcctcttccccaggatgtgtggacctcccacccgcttcctggatttgtcctctggggctgagctctgtggatgggggaacgtattattgactttcctcttagaaaacatctaaactcctcttcagatagaaatcccttcccatccagagaacaatcgtccgttctgaatcaactccaggtttcccggagctgggtacactttgctggctgacctatggttcccccatcccgaatgacttcctgttccatttcacaaatgcaagccttccaggtgcacctgtggggtatagctccgttctcaacagggggttatgtacacccttgctctgggcacgtccccagatcctcaccatcttgacaagcgtggttttgcatgccaggtccgagggcgagcggctacagttcatgcaagctctgcaggaggtctggagcgtcaacgggagaagcgtgctgaccgcctttgacctgtcagtgttcccacttatgtgtgaccttggtggtaagtacccctcaccactaatacctcggaggtgtggcttctgttctgtatggggaatgtgttattcatgtcttttattttctgcattctgatgctttgacatgtgcggccttactggtcttagaggaatcattcctcccagcactgggcacttcctagagtcagcaaacatctcctctgcgagcacacgtttctttttcttttctttttttaagatggaagcttgctccatcgcccaggctgcagtgcagtggcatgatctcggctcactgcaacctttgcctcctgggttcaagcgattctcctgcctcagcctcccgagtagctgggattacaggcacctgccaccacaccaggctaatttttttttttttttttttttttgagatgaagtgtcgctctgtcgcccaggctggagtgcagtggcacgatctcggctcaccgcaacctccgcctcctgggttcaagcgattctcctgccccagcctcccgagtaggtgggattatgggtgcgcaccactctgtcaggctaatttttgtattttttaatagagacggggttttgccatgttggccaggctggtctcgaactcctgacctcatgatccacccgcctcggtcttgtttttagtttttgagagagggtcctgtttgtcacccaggctcgagtgcaatggtgtgttgatagctcactgcagcctcagactctcaggctcaagtggtcctcccacctcagcctcccaagtagctgggattacagatgactgccgccacacctagctcatttaaaaacttttctgtagagcctgagtctctctacgttgccctggctggtctcagactcctgggctcatgcaatcctgctgcctcagcctccaaaagtgctgggattacaggcgcccgccaccacacccaggctgagctgagcttgttttatttatttatttatttatttatttacttgtatttatttatttatttttttttttgagatggagtcttgctctgtcacccaggctggaatgcagtggtgcaatctccactcactgcaagctctgcctcccgggttcacgccattctcctgcctcagcctcctgagtagctgggactacaggcgcccgccaccacgcccagctaattttttgtttttttttttagtagagacggggtttctccgtgttagccaggatggtctcgatctcctgacctcgtgatccacccgcctccgcctcccaaagtgccaggattgcaggcatgagccactgcgccgagctcattttcaaacttttttgtagagaacgagtctccctatgttgccctggctggtctcagactccagtttcatgcagtcctcctgcctcggcctcccagagtgagtgatgggattacaggcatgagccactgcacccaggctgagcttgctttttgaatacaaatccccaaccccgagctcaccccttaagcacctcctctaccccatagggctgtcacactccaggccgtgatccacccaccctatctccctcctgtgactcagtggatcactcagaacagctcctggctggtagaaggccctttgcagagtgaggagcttctccaagtttattacttttagtcactgtgagcagggatagatagagttcaggatccccctgcctggggagcagcttgggaagaaaataatgaacaagcagaccgggcgcggtggctcactcctgtaatcccagcactttgggaggccgaggcgggtggatctcctgaggtcaggagttcgagatcagcctggtcaacatggtgaaatcccgtctctactaaaaatacaaaaaaaggctgggtgcggtggctcatgcctgtaatcccagcactttgggaggctgaggcgggcggatcccaaggtcaggagtttgagaccagcctgaccaacggggtgaaacccggtctctactaaaaatacaaaaacttagccaggcatgacagtaggtgcctgtcatcccaggtactcaggaggctgaggcaggagaatcgcttgtacccgggaagtgaaggttgcagtgagctgagatcgcgccactgcactccagcctggtgacagagtgagactccatctcaaaataaataaaaagactgactttctacagaaataatggacaaggagcatggggctggaagtctctgtggcccatgatggattttgtgtgcacgacttaccggggcctctgaatggggcttgttattacatccttctcttagctgttggccgcccttggctggacaggtgcgccggcttcaagaacacacagttaagtgcgtggccatatggaagtttggagcttgggtcagcccagccagaaagaccacctgaactcaggggcctgtagacaatcacgtcaccgtcaagattagacatggtggataaaaaaggatgagttcggccgggcgcggtggctcacgcctgtcatcccagcactttgggaggccgagatgggcggatcacgaggtcaggagatcgagaccatcctggctaacacggagaaaccctgtctctactaaaaatacaataaaaaaattagctgggcgtggtggcgggcgcctgtagtcccagctactggggaggctgaggcaggagaatggcgtgaacccgggaggcagagcttgcagtgagcggaaatcgtgccactgcactccagcctgggcgacagagccagactctgtctcaaaaataaataaattaataaataaaaggatgcgttcatgtcctttgcagggacatggataaagctggaaaccatcattctcagcaaactatcgcaaggacagaaaaccaaacaccgcgtgttctcactcataggtgggaactgaacaatgagaccacatggacacagggaggggaacgtcacacactggggcctgtcagggcctggggggctgggaggctgggggagggagagcactaggacaaatacctaatgtaaatgacgagtcgatgggtgcagcaaaccaccatggcacatggatacctatgtaacaaaaccgcatgttctgcacatgtaccctagaacttaaagtataataaaaagaaaaaaaagaccagacatggcggaaggacccaagttcctgggttggacccttcatgagtccatggtgtgtggagggtgagcgatgtctctcaggttcatctctgagggtcaaacgggctgtgtccccttccaggtggggctggagctctggctaaggaatgcatgtctctgtaccctggatgtaagatcaccgtttttgacatcccagaagtggtgtggacggcaaagcagcacttctcattccaggaggaagaacagattgacttccaggaaggtgtgtttgtgtccgtggggaagcagagatgtgtctcacggcttctccagggggactggatgtttctgggaaatgaagaagatgtgatgtggttttcctctcactcccggaaacaccctcaactcaacactgtctgttattcatgatggatggaaagctgggtgtagatatacagttttcttacaattattattattattattgatacagagtcttgctttgtcgcccaggctggagtgcagtggtgcagtctcggctcactgcaacctccacctcctgggttcaagcaattctcctgcctcagcctcccaagtagctgggattacaggcatgcgccaccacatccagctaatttttttttttttttgagatggagtctcactctcttgcccgggctggagtgtggtgacagatctcggctcccttcaagctccgcctcccgggttcacaccattctcctgcctcagcctcccaagtagctgggactacaggcacccaccaccacacctggctaatcttttatatttttagtagaggtggagtttcactgtgttagccaggatggtctcgatctcctgaccgcgtgatccgcccaccttggcctcccaaagtgctgggattacaggtgtgaaccatcacacccggcctctttttgtatttttagtagagatggggtttcaccgtgttgaccaggctggtctcaaactcctgacctcaggagatccacccgcctcggcctcccaaagtgctgggattacaggcgtgagccaccgcacccagccagtcatatcatttctgcagtgaagggtgtggccagggtctccacgactaccttcaggttcaataattcactagaaggacacaccgagctcagaagagccatcatacacatagttatatttacaacaatgaaagaatacagatgcatatcagcgaaggagaaaggagcatgggatagagttcgggagaaaccacatgtgagcttcttgttgtcttctcccagtggagctgtggacagcaatcaattcccccaacaacaaggtttgacaacacacaccactcactgccagcctggagagcctccgcaatccctgacatccaaggattttcttggagactggttacatagacatggcagacaccctgcatggctgactccaatcttcacctcttccagagttcccaaggtgatcctatagtaaatcccactgttagtacaaactatcctgggtggcccagagacccagctgaacaaagatacccttgtgaggtaggacattcttagagattacagttgccaattaagtgccaatcctctctttagaatgtggagggtttggacaacacaggcctgctgagttaaccccccccctttttttttcttgtttttttgagacggagtctcactctgtcacccaggctggagtgcagtggcgtgatccaagctcactgcaacctctgcctcccaggttcaagcaattttttgcctcagcctcctaagtagctgagattttacaggtgcctatcaccatgcctggctaattttttgtatttttagtagagacagggtttcactatctcggccaggctggttttgaattcctgacctcgtgatccacctgcctcggcctcccaaagtgctggggattacaggagtgagccaccgcgcctggcctgagttaactcttttttttttttttttgagatggagtctcgctctgtcacccaggctggagtgcagtggtgggatctcggctcactgcaagctccacctcccgggttcacaccattctcctgcctcagcctcccgagtagctgggactacaggcgcccaccaccacgcccagctaattttttttttttttttgtatttttggtagagatggggtttcaccgtgttagccaggatggtctcaatctcctgatctcgtgatctgccccgctcagactcccaaagtgctgggattacaggcgtgagccaccgcgcctggcctgaattaactcttcactgcacagagctcaccaagatctctcccaagattggcaccttatcattttgcgggaaaactatgacaagacttgagcgtttcacatcgcacacacataaagggtcagtcttgcgtatttactttaaatctggagaacaggtcttgactgtaggttcagttcagctcatcagttaggagctgctgaccgaattcccagggactcctggaatccacggctttgggtgatatcagcagcagtgcttttgcaggggacatcagaaagaaagaaagaaagaacatgggccgggcacagcagctcatgcctgtaatcccagcactttgggaggccgaggcgggcggatcacctcaggttgggggttcgagaccagcctcagcaacatggagaaatcccatctctactaaaaatacaaaaattagccgggcgtggtggcgggtgcctgtaatcccagctactcaggaggctgaggcaggagaatcgcttgaaaccaggaggtggaggttgcggtgagctgagatcaggcccttgcactccagcctgggcaacaagagcaaaactccatctcaaacaaacaaacaaacaaaaaaacaaaaaagaaaccatattatgatttttttttaaaggaggaggagagaaagaggccacacttattcagtattttctttctttttttttttttggagacagtctcgctgtcgcccaggctggagtgcaatggtgcaatctcggctcactgcaagctccgcctcccgggttcatgccattctcctgcctcagcctcccgagtagctgggaccacaggcacccgccatcacgcccggctaattttttttgtatttttagtagagacagggtttcaccgtgttagccaggatggtcttgatctcctgacctcgtgatctgcccacctccgcctcccaaagtgctaggattacaggcgtgagccaccgcgcccgacctcagtattttcttatctttctcctaagcctttttgttttctgaggctaggtctgcaggtgactagcctggaagacctgggaaaggcgtgacccatccaggtgaccttttgtgcccagaataggtttagtcaaatgggattggattgcaggctgacctcggtgtgcctgccctgtgttccaggggatttcttcaaagaccctcttccggaagctgatctgtacatcctggccagggtcctccatgactgggcagacggaaagtgctcacacctgctggagaggatctaccacacttgcaagccaggtaagttgtggggtttgcatttcagcgtgtgcttgtgacacggggcagaattgtacgagtcacatttagaaggcaggcactgaaatcatcccacaggtaagggtagacatcctgcccaatatggctttccttttagataacgacctgaaataaatagggtcctaatttctattctattgataaaaccacataaagatggaaaaagtgaaaggccctctgaaacttcagtggcctcactttggtgaaattctttcagaattaggctagtatttgtgtgtgtgatgaggacagtgccccactgacttctgaggtccacccatcctgatggttcatgaggatgtgggcacagcctctgtgtgtgatggggacagtgtcccagctctcctgtgaggtccatccatcctgatggcacatgaggatgtgggcacagcctctgtgtgtgatggggacagtgtcccagctctcctgtgaggtccatccatcctgatggcacatgaggatgtgggcacagcctctgtgtgtgagataaggactgtgtcccagctctcctgtgaggtccacccatcctgatgcttcacgaggacgtgggcacagcctctgtgtatgatggggacagtgtcccagtgtcctgtgaggtccatccatcctgatggcacatgaggatgtggacacagcctctgtgtgtgtgatggggacagtgtcccagtgtcctgtgagatccatccctcctgatggttcatgaggatgtgggcacagcctctgtgtatgatggggacagtgtcccagtgtcctgtgagatccatccctcctgatgcttcacgaggacgtgggcacagcctctgtgtatgatggggacagtgtcccagtgtcctgtgaggtccacccatcctgatggcacatgaggatgtgggcacagcctctgtgtgtgagatagggaccatgtcccagctctcctgtgaggtccatccatcctgatgatccatgaggatgtggacacagcctctgtgtgtgtgatggggacagtgtcccagtgtcctgtgagatccatccctcctgatggttcatgaggatgtgggcacagcctctgtgtgtgagatagggaccatgtcccagctctcctgtgaggtccatccatcctgatgatccatgaggatgtggacacagcctctgtgtgtgtgatggggacagtgtcccagtgtcctgtgagatccatccctcctgatggttcatgaggatgtgggcacagcctctgtgtgtgagatagggaccatgtcccagctctcctgtgaggtccatccatcctgatggcacatgaggatgtgggcacagcctctgtgtgtgagatagggaccatgtcccagctctcctgtgaggtccatccatcctgatgatccatgaggatgtggacacagcctctgtgtgtgtgatggggacagtgtcccagtgtcctgtgagatccatccctcctgatggttcatgaggatgtgggcacagcctctgtgtgtgagatagggaccatgtcccagctctcctgtgaggtccatccatcctgatggcacatgaggatgtgggcacagcctctgtgtgtgagatagggaccatgtcccagctctcctgtgaggtccatccatcctgatgatccatgaggatgtggacacagcctctgtgtgtgtgatggggacagtgtcccagtgtcctgtgagatccatccctcctgatggttcatgaggatgtgggcacagcctctgtgtgtgagatagggaccatgtcccagctctcctgtgaggtccatccatcctgatgatccatgaggatgtggacacagcctctgtgtgtgtgatggggacagtgtcccagtgtcctgtgagatccatccctcctgatggttcatgaggatgtgggcacagcctctgtgtgtgagatagggaccatgtcccagctctcctgtgaggtccatccatcctgatggcacatgaggatgtgggcacagcctctgtgtgtgagatagggaccatgtcccagctctcctgtgaggtccacccatcctgatgcttcacgaggacgtgggcacagcctctgtgtatgatggggacagtgtcccagtgtcctgtgaggtccatccatcctgatggcacatgaggatgtggacacagcctctgtgtgtgtgatggggacagtgtcccagtgtcctgtgagatccatccctcctgatggttcatgaggatgtgggcacagcctctgtgtgtgagatagggaccatgtcccagctctcctgtgaggtccacccatcctgatgatccatgaggatgtggacacagcctctgtgtgtgtgatggggacagtgtcccagtgtcctgtgagatccatccatcctgatggcacatgaggatgtgggcacagcctctgtgtgtgagatagggaccatgtcccagctctcctgtgaggtccatccatcctgatgatccatgaggatgtggacacagcctctgtgtgtgtgatggggacagtgtcccagtgtcctgtgagatccatccctcctgatggttcatgaggatgtgggcacagcctctgtgtgtgagatagggaccatgtcccagctctcctgtgaggtccacccatcctgatgatccatgaggatgtggacacagcctctgtgtgtgtgatggggacagtgtcccagtgtcctgtgagatccatccatcctgatggttcatgaggatgtgggcacagcctctgtgtgtgagatagggaccatgtcccagctctcctgtgaggtccatccatcctgatggcacatgaggatgtgggcacagcctctgtgtgtgagataaggactgtgtcccagctctcctgtgaggtccacccatcctgatgcttcacgaggacgtgggcacagcctctgtgtatgatggggacagtgtcccagtgtcctgtgaggtccatccatcctgatggcacatgaggatgtggacacagcctctgtgtgtgtgatggggacagtgtcccagtgtcctgtgagatccatccctcctgatggttcatgaggatgtgggcacagcctctgtgtgtgagatagggaccatgtcccagctctcctgtgaggtccacccatcctgatgatccatgaggatgtggacacagcctctgtgtgtgtgatggggacagtgtcccagtgtcctgtgagatccatccatcctgatggcacatgaggatgtgggcacagcctctgtgtgtgagatagggaccatgtcccagctctcctgtgaggtccatccatcctgatgatccatgaggatgtggacacagcctctgtgtgtgtgatggggacagtgtcccagtgtcctgtgagatccatccctcctgatggttcatgaggatgtgggcacagcctctgtgtgtgagatagggaccatgtcccagctctcctgtgaggtccacccatcctgatgatccatgaggatgtggacacagcctctgtgtgtgtgatggggacagtgtcccagtgtcctgtgagatccatccatcctgatggcacatgaggatgtgggcacagcctctgtgtgtgagatagggaccatgtcccagctctcctgtgaggtccacccatcctgatgatccatgaggatgtggacacagcctctgtgtgtgtgatggggacagtgtcccagtgtcctgtgaggtccatccctcctgatggttcatgaggatgtgggcacagcctctgtgtgtgagatagggaccatgtcccagctctcctgtgaggtccacccatcctgatgatccatgaggatgtggacacagcctctgtgtgtgtgatggggacagtgtcccagtgtcctgtgagatccatccctcctgatggttcatgaggatgtgggcacagcctctgtgtgtgagatagggaccatgtcccagctctcctgtgaggtccacccatcctgatgcttcatgaggacgtgggcacagcctctgtgtatgatggggacagtgtcccagtgtcctgtgagatccatccatcctgatggcacatgaggatgtgggcacagcctctgtgtgtgagatagggaccatgtcccagctctcctgtgaggtccatccatcctgatgatccatgaggatgtggacacagcctctgtgtgtgtgatggggacagtgtcccagtgtcctgtgagatccatccctcctgatggttcatgaggatgtgggcacagcctctgtgtgtgagatagggaccatgtcccagctctcctgtgaggtccacccatcctgatgatccatgaggatgtggacacagcctctgtgtgtgtgatggggacagtgtcccagtgtcctgtgagatccatccatcctgatggcacatgaggatgtgggcacagcctctgtgtgtgagatagggaccatgtcccagctctcctgtgaggtccacccatcctgatgatccatgaggatgtggacacagcctctgtgtgtgtgatggggacagtgtcccagtgtcctgtgaggtccatccctcctgatggttcatgaggatgtgggcacagcctctgtgtgtgagatagggaccatgtcccagctctcctgtgaggtccacccatcctgatgatccatgaggatgtggacacagcctctgtgtgtgtgatggggacagtgtcccagtgtcctgtgagatccatccctcctgatggttcatgaggatgtgggcacagcctctgtgtgtgagatagggaccatgtcccagctctcctgtgaggtccacccatcctgatgatccattaggatgtggacacagcctctgtgtgtgtgatagggaccatgtcccagtgtcctgtgaggtccacctatcctgatggtccatgaggatgtggacacagccgctctgtgtgtgatggggacagtgtcccagctctcctgtgaggtccatccatcctgatggttcatggggacgtgagcacagcctctgtgtgtgtgttggggacagtgtcccagttctcctgtgaggtccacccatcctgatggttcatgaggatgtgggcacagcctctgtgtgtgtgatggggacagtgtcccagtgtcctgtgaggtccacccatcctggtggtccatgagtacatggacacagcctctctgtgtgagatggggacagtgtcccagttctcctgtgaggtccacccatcctggtggtccatgagtacatggacacagcctctctgtgtgtgataaggacagtgttccagctctcctgtgaggtccacccatcttgatggttcatgaggacttgggcatggcctctatgtgtgtgatggggacagtgtcccagtgtcctgtgaggtccacccatcctgatggtccatgaggatgtgggcacaacctctttgtgtgtgatggggacagtgtcccagtgtctgtgaggtccacccatccgatggttcatgaggacgtgggcacagcctctgtgtgtaatggggatagcatcccagtgtcctgtgaggtccatccatcctgatggcccatgaggatgtgggcacagcctctgtgtgtgtgtgtgtgatggggacggtgtcccagttctcctgtgaggtccacccatcctgatggtccatgaggacatgggcacagcctctctgtgtgtgataaggacagtgttccagctctcctgtgaggtccacccatcttgatggttcatgaggacttgggcacagcctctgtgtgtgtgatggggacagtgtcccagtgtcctgtgaggtccatacatcctgatggtccatgaggacatgggcacaacctctgtgtgtataatggggacagtgtcccagtgtcctgtgaggtccacccatcctgatggttcatgaggacgtgggctcagcctctgtgtgtaatgaggacagtgtcccagtgtcctgagaggtccatcgatcctgatggcccatgaggatgtgggcacagcctctgtgtgtgtgtgatggggacggtgtcccagttctcctgtgaggtccatccatcctgatggttcatgaggacatgggcacagcctctatgtgtgtgatggggacagtgtcccagcgtcctgtgaggttcacccatcctgatgatcgatgaggacgtgggcacagcctctgagtgtgtgatggggacggtgccctgactgtcctctgaggtctggctgtccttatggttcactgggactttggcacagtctgtctgtgtgtttgtgtgtgatgtggactgtgcccctccctttctaggtggtggcattctggtaattgaaagcctcctggatgaagacaggcgaggtcctctgctcacgcagctctactctctgaacatgcttgtgcagacggaagggcaggagaggacccccacccactaccacatgctcctctcttctgctggcttcagagacttccagtttaagaaaacaggagccatttatgatgccattttagccaggaaataactgtttcttgtgacctggaactaacgtcaaagcacacaagacataataataaagacatgtacctcca

SEQ ID NO: 2885 - DNA, 27863 bp, human; identical to SEQ ID NO: 2882

SEQ ID NO: 2886 - DNA, 27906 bp, human; identical to SEQ ID NO: 2883

SEQ ID NO: 2887 - DNA, 28080 bp, human; identical to SEQ ID NO: 2884

SEQ ID NO: 2888 - DNA, 8717 bp, human
aagagctttttacggccatctacaggtaacacccatcactttgaaaccaacaactcagataagattctgtttatttttaaaggacttaggaaacccaatccatttactcaaatggcacaacccaggaggaagctgccatttaatttaaaataacatcccctatccccactactaccccagattttgctcatctgatgtttaaattgatcaaattcctgaggaggtgcaacgtgacccttccttcgaaaggactactcacaaactcagtgtttatgtagaaaatggaggcacgcgccgggcgcggtggctcacgcctgtcatcccagaactttgggaggccgaggcaggtggatcacctgaggtcaggagttcgagaccagcctggccaacagggtgaaaccccgtctctactaaaaatacaaaaattagccgggcgtggtggcggacgcctgtaatcccagctagtcgggaggctgaggcaggagaactgcttgaacccgggaggcggaggttgcggtgatctgagatcgcaccactgcactccagcctgggcaacaagagtgaaactccatctcaaaaaagaaaagaaaagaatatagaggcccagtttttgatttggtcagaggtgaaggtgaggccaggtgagacctcagctcttcactttgctttgcgatgtggacacagctttggcctttgcccgaagctcttacctagaattcccagatggaggtgaattgatgggcccgtccagtgttccagctggctgaggcatggagtagggaagggtatgaaggacaaggggatgcctgagtggttcgcctgccccccaacctctcctctcctcccctgctctcccctcccctctcttctccttctgtcctgttccctctcttttcctcttccatcctcctctctttctctccttttccttctcttctcttctctcctctcttttcctctccatcttccccctcctctctcccatcttccctctcttgtctcctctctcttcttccctctctcctttcctctcgcctcccttcccctcccttcacctgcctctctccttctcctctcccgtcttctttctctcatcttctctgttttcatgccccgtatttcacctccttttctcctcctctcttctcctcggtctgctttcctttcccccgtttctctctttctttctctctctctttctttctttccttctttctttccttctttctccttccttccttcgttccttcctctttccttctgcctgccttccttccttccctccctccctcctttctttctttttctttcttccttcttccttctttcctttctttatatatatatatatgtgtgtatacatgtgtatgtgtatgtgaatatatgtatctgtttagggggcacaagtacccatgtcttccatgcttacatgttgcaccttgcagcctaggcttttagtgtgcccatcacctgaatagtgaccgtggtacctaagaggcaatttttcagccctcgctactctgaggcaaacccctacagcaggctctgcagagaggacaggaggagagagggagctgtggggggggaggagcaggaaatgcttccaacaccagagccctgtccgcctctgtgtccacctatccttcttggctccatctcacctgcctcccttcctagttcctgccttttctctagcctcttccccaggatgtgtggacctcccacccgcttcctggatttgtcctctggggctgagctctgtggatgggggaacgtattattgactttcctcttagaaaacatctaaactcctcttcagatagaaatcccttcccatccagagaacaatcgtccgttctgaatcaactccaggtttcccggagctgggtacactttgctggctgacctatggttcccccatcccgaatgacttcctgttccatttcacaaatgcaagccttccaggtgcacctgtggggtatagctccgttctcaacagggggttatgtacacccttgctctgggcacgtccccagatcctcaccatcttgacaagcgtggttttgcatgccaggtccgagggcgagcggctacagttcatgcaagctctgcaggaggtctggagcgtcaacgggagaagcgtgctgaccgcctttgacctgtcagtgttcccacttatgtgtgaccttggtggtaagtacccctcaccactaatacctcggaggtgtggcttctgttctgtatggggaatgtgttattcatgtcttttattttctgcattctgatgctttgacatgtgcggccttactggtcttagaggaatcattcctcccagcactgggcacttcctagagtcagcaaacatctcctctgcgagcacacgtttctttttcttttctttttttaagatggaagcttgctccatcgcccaggctgcagtgcagtggcatgatctcggctcactgcaacctttgcctcctgggttcaagcgattctcctgcctcagcctcccgagtagctgggattacaggcacctgccaccacaccaggctaatttttttttttttttttttttttgagatgaagtgtcgctctgtcgcccaggctggagtgcagtggcacgatctcggctcaccgcaacctccgcctcctgggttcaagcgattctcctgccccagcctcccgagtaggtgggattatgggtgcgcaccactctgtcaggctaatttttgtattttttaatagagacggggttttgccatgttggccaggctggtctcgaactcctgacctcatgatccacccgcctcggtcttgtttttagtttttgagagagggtcctgtttgtcacccaggctcgagtgcaatggtgtgttgatagctcactgcagcctcagactctcaggctcaagtggtcctcccacctcagcctcccaagtagctgggattacagatgactgccgccacacctagctcatttaaaaacttttctgtagagcctgagtctctctacgttgccctggctggtctcagactcctgggctcatgcaatcctgctgcctcagcctccaaaagtgctgggattacaggcgcccgccaccacacccaggctgagctgagcttgttttatttatttatttatttatttatttacttgtatttatttatttatttttttttttgagatggagtcttgctctgtcacccaggctggaatgcagtggtgcaatctccactcactgcaagctctgcctcccgggttcacgccattctcctgcctcagcctcctgagtagctgggactacaggcgcccgccaccacgcccagctaattttttgtttttttttttagtagagacggggtttctccgtgttagccaggatggtctcgatctcctgacctcgtgatccacccgcctccgcctcccaaagtgccaggattgcaggcatgagccactgcgccgagctcattttcaaacttttttgtagagaacgagtctccctatgttgccctggctggtctcagactccagtttcatgcagtcctcctgcctcggcctcccagagtgagtgatgggattacaggcatgagccactgcacccaggctgagcttgctttttgaatacaaatccccaaccccgagctcaccccttaagcacctcctctaccccatagggctgtcacactccaggccgtgatccacccaccctatctccctcctgtgactcagtggatcactcagaacagctcctggctggtagaaggccctttgcagagtgaggagcttctccaagtttattacttttagtcactgtgagcagggatagatagagttcaggatccccctgcctggggagcagcttgggaagaaaataatgaacaagcagaccgggcgcggtggctcactcctgtaatcccagcactttgggaggccgaggcgggtggatctcctgaggtcaggagttcgagatcagcctggtcaacatggtgaaatcccgtctctactaaaaatacaaaaaaaggctgggtgcggtggctcatgcctgtaatcccagcactttgggaggctgaggcgggcggatcccaaggtcaggagtttgagaccagcctgaccaacggggtgaaacccggtctctactaaaaatacaaaaacttagccaggcatgacagtaggtgcctgtcatcccaggtactcaggaggctgaggcaggagaatcgcttgtacccgggaagtgaaggttgcagtgagctgagatcgcgccactgcactccagcctggtgacagagtgagactccatctcaaaataaataaaaagactgactttctacagaaataatggacaaggagcatggggctggaagtctctgtggcccatgatggattttgtgtgcacgacttaccggggcctctgaatggggcttgttattacatccttctcttagctgttggccgcccttggctggacaggtgcgccggcttcaagaacacacagttaagtgcgtggccatatggaagtttggagcttgggtcagcccagccagaaagaccacctgaactcaggggcctgtagacaatcacgtcaccgtcaagattagacatggtggataaaaaaggatgagttcggccgggcgcggtggctcacgcctgtcatcccagcactttgggaggccgagatgggcggatcacgaggtcaggagatcgagaccatcctggctaacacggagaaaccctgtctctactaaaaatacaataaaaaaattagctgggcgtggtggcgggcgcctgtagtcccagctactggggaggctgaggcaggagaatggcgtgaacccgggaggcagagcttgcagtgagcggaaatcgtgccactgcactccagcctgggcgacagagccagactctgtctcaaaaataaataaattaataaataaaaggatgcgttcatgtcctttgcagggacatggataaagctggaaaccatcattctcagcaaactatcgcaaggacagaaaaccaaacaccgcgtgttctcactcataggtgggaactgaacaatgagaccacatggacacagggaggggaacgtcacacactggggcctgtcagggcctggggggctgggaggctgggggagggagagcactaggacaaatacctaatgtaaatgacgagtcgatgggtgcagcaaaccaccatggcacatggatacctatgtaacaaaaccgcatgttctgcacatgtaccctagaacttaaagtataataaaaagaaaaaaaagaccagacatggcggaaggacccaagttcctgggttggacccttcatgagtccatggtgtgtggagggtgagcgatgtctctcaggttcatctctgagggtcaaacgggctgtgtccccttccaggtggggctggagctctggctaaggaatgcatgtctctgtaccctggatgtaagatcaccgtttttgacatcccagaagtggtgtggacggcaaagcagcacttctcattccaggaggaagaacagattgacttccaggaaggtgtgtttgtgtccgtggggaagcagagatgtgtctcacggcttctccagggggactggatgtttctgggaaatgaagaagatgtgatgtggttttcctctcactcccggaaacaccctcaactcaacactgtctgttattcatgatggatggaaagctgggtgtagatatacagttttcttacaattattattattattattgatacagagtcttgctttgtcgcccaggctggagtgcagtggtgcagtctcggctcactgcaacctccacctcctgggttcaagcaattctcctgcctcagcctcccaagtagctgggattacaggcatgcgccaccacatccagctaatttttttttttttttgagatggagtctcactctcttgcccgggctggagtgtggtgacagatctcggctcccttcaagctccgcctcccgggttcacaccattctcctgcctcagcctcccaagtagctgggactacaggcacccaccaccacacctggctaatcttttatatttttagtagaggtggagtttcactgtgttagccaggatggtctcgatctcctgaccgcgtgatccgcccaccttggcctcccaaagtgctgggattacaggtgtgaaccatcacacccggcctctttttgtatttttagtagagatggggtttcaccgtgttgaccaggctggtctcaaactcctgacctcaggagatccacccgcctcggcctcccaaagtgctgggattacaggcgtgagccaccgcacccagccagtcatatcatttctgcagtgaagggtgtggccagggtctccacgactaccttcaggttcaataattcactagaaggacacaccgagctcagaagagccatcatacacatagttatatttacaacaatgaaagaatacagatgcatatcagcgaaggagaaaggagcatgggatagagttcgggagaaaccacatgtgagcttcttgttgtcttctcccagtggagctgtggacagcaatcaattcccccaacaacaaggtttgacaacacacaccactcactgccagcctggagagcctccgcaatccctgacatccaaggattttcttggagactggttacatagacatggcagacaccctgcatggctgactccaatcttcacctcttccagagttcccaaggtgatcctatagtaaatcccactgttagtacaaactatcctgggtggcccagagacccagctgaacaaagatacccttgtgaggtaggacattcttagagattacagttgccaattaagtgccaatcctctctttagaatgtggagggtttggacaacacaggcctgctgagttaaccccccccctttttttttcttgtttttttgagacggagtctcactctgtcacccaggctggagtgcagtggcgtgatccaagctcactgcaacctctgcctcccaggttcaagcaattttttgcctcagcctcctaagtagctgagattttacaggtgcctatcaccatgcctggctaattttttgtatttttagtagagacagggtttcactatctcggccaggctggttttgaattcctgacctcgtgatccacctgcctcggcctcccaaagtgctggggattacaggagtgagccaccgcgcctggcctgagttaactcttttttttttttttttgagatggagtctcgctctgtcacccaggctggagtgcagtggtgggatctcggctcactgcaagctccacctcccgggttcacaccattctcctgcctcagcctcccgagtagctgggactacaggcgcccaccaccacgcccagctaattttttttttttttttgtatttttggtagagatggggtttcaccgtgttagccaggatggtctcaatctcctgatctcgtgatctgccccgctcagactcccaaagtgctgggattacaggcgtgagccaccgcgcctggcctgaattaactcttcactgcacagagctcaccaagatctctcccaagattggcaccttatcattttgcgggaaaactatgacaagacttgagcgtttcacatcgcacacacataaagggtcagtcttgcgtatttactttaaatctggagaacaggtcttgactgtaggttcagttcagctcatcagttaggagctgctgaccgaattcccagggactcctggaatccacggctttgggtgatatcagcagcagtgcttttgcaggggacatcagaaagaaagaaagaaagaacatgggccgggcacagcagctcatgcctgtaatcccagcactttgggaggccgaggcgggcggatcacctcaggttgggggttcgagaccagcctcagcaacatggagaaatcccatctctactaaaaatacaaaaattagccgggcgtggtggcgggtgcctgtaatcccagctactcaggaggctgaggcaggagaatcgcttgaaaccaggaggtggaggttgcggtgagctgagatcaggcccttgcactccagcctgggcaacaagagcaaaactccatctcaaacaaacaaacaaacaaaaaaacaaaaaagaaaccatattatgatttttttttaaaggaggaggagagaaagaggccacacttattcagtattttctttctttttttttttttggagacagtctcgctgtcgcccaggctggagtgcaatggtgcaatctcggctcactgcaagctccgcctcccgggttcatgccattctcctgcctcagcctcccgagtagctgggaccacaggcacccgccatcacgcccggctaattttttttgtatttttagtagagacagggtttcaccgtgttagccaggatggtcttgatctcctgacctcgtgatctgcccacctccgcctcccaaagtgctaggattacaggcgtgagccaccgcgcccgacctcagtattttcttatctttctcctaagcctttttgttttctgaggctaggtctgcaggtgactagcctggaagacctgggaaaggcgtgacccatccaggtgaccttttgtgcccagaataggtttagtcaaatgggattggattgcaggctgacctcggtgtgcctgccctgtgttccaggggatttcttcaaagaccctcttccg

SEQ ID NO: 2889 - DNA, 163129 bp, human
ggcgcggaagcggcggcggcgcggccggggcagccatgtcgccattgtctgcggcgcgggcggccctgcgggtctacgcggtaggcgccgcggtgatcctggcgcagctgctgcggcgctgccgcgggggcttcctggagccaggtcagcggggcggggcaggggtcagggctccggggacccgggtgggcgcgggctggctcgggggcgggggcgcgggggctccgcgtgaccttggcgaggcggtggcgctcccggaagtggggctgggcgggggtcgaggtgtggccgggggtggggggggggcggcgtgcgcgctgggacctccccgccccgcgctttccgtccccgccggctcttctgcgcgcctggcccggcccgacccggcccgacccttccctccccgcgcgtgtggcctccccgcctgtcccgggtcgggctccaaccaagcagcccccgtgcagccgcccccccgcgcaccctgacacctccgggccatggccggggacccgggggctcgcacgccccgcgcccaagacatcaggcggctctgcctgccgcctgcggtcggccagtgaccgcgcgcccccgccaggccccggaggggaggagcgggcgtcccagggacctcgacccctacccaccccagggtaagtgaggatgggcccttctccggaggacgtctccagagggggcccagaggcggcttctcgggcactggggagccacggaggtctggtggggagggcaggcccgttaagtggcaactttgtttccttggcctttgtaaacatctctgagtcacagatctccaactttgcaggactcgttcactgtctgaactcatcagtgatgaccgccactgtgttttgtgtatgcagataacttctgttcctagatttgcaggttcagaatttattattattattattttttgtaataggaagtagagatgaagtcttgctctgttgccgaggctactctcgaactcctgggctcaagcagtcctcctgcctcagcctcccaaagtgctggcattacaggcaccagctactgcatccgactaatgttttaaagttttgtagacggggtcttgctatgttgctcaggctggtctcgaactcctgggctcaagcgatcttccttcctttgcctcccaaactgttgggattacaggtgtgagccaccacacctgtctaatgttttaatttttttgtgtagcaatagggtcttgctacgttgcccaggctggtctgaaactcatgggccgaagcaatcctcctacctgggtcccccaaagtgctgggtttacaggcgtgagccaccacgcctggctaatgttttaaattttttgtagagatggcatctcaccatgttgcccaggctggtcttgaacccctggcctgcagcaatcctccagtctgggcctcccaaactgctgggattacagacagagcgccactgtgcccagcccatattctcaatttaaacctagaaacctgtaaacaattatttgtgaactggaataaagggaatgttaattccatgttaggttaaatgatactttgtttcaaaaataacagttttccaaaacagagcgttcagagggtcagtgtggtgggggtgggggtgtacgttgccctgaatgtcttaaatgtccagcctaagaagagagctgttatttctgcctctgtagacagtttcatggcatgtcaggaggcctctggaagacactactgcacgcctctgggagactgggagtcagccaggcgaagcgcttgggtgccttattgtgaaatgacttttgacttccactctgcacccactgaaggaatcccaggggtcccagcgccaccctttgagaagcgtgcctggagtggatgttttaaaatgagcctctctctcccgcctctagccagagaaaaagagctttgagttttctgtgagctaagcttttctttttctgccaaactggccttcagtatttttttttaaacccacttagcataattacaaatgcatagaagaaggagagtaaagggaactgtagtcaggctttcggagggcaggagagcatgtttgtttgaagtaagtaatcagttgcaaggtgaacggtttacagctgctgaacaattgtgtggagtctcgcagaagattatgtttatccgggcagttttgcttacagaaaggtccccttaaacctccttaagggcctgtgtgggccctggcagaagaggccggggttcctgcagcagctcaccaaaatgctggcctttgaaaaacttgctctttgtgcattagaaaaagggctggaatcttttttttttttttttttcccatttactgattaaacaacaacagaaggttgttaaagaggacgagcttctggtgaagtcacgtgtctgccaagggaatctgtacccgggtgtgtatcgaaacagaatggccttctctaaagattaacttaagtggcttgccctcatcgagccccttcctatgtatggattaaaaataattttcgataccagtggaggaatgctgttgtccttggtctgctggtggccagcttcctaaacggcattttttatttgcttctctctggtaggccttcgctgttggtgaggaaacattgaactttgtccagggcatttgagctaagctgtttgaataaccaagagggccaatttccccactgcagattggaagcaagggcagttttttcttagaacttccaaatggagcgtgttcttcttaggtatcgtacaaaggaaatgcctgggttacaccttccacatgagttgacttacatggtatgagaaggaagaaattgtggctggaatccactcctaaatggtgtcttcttacagttcatcatggaaaaacaagataattacaaattaatcatagatgttggtcatgcctttacagagggggtttagaagcaaattgagaattcccataagagggtctgtctctgtgttcttaagactatatccatgcggcccattcagtaagttgtatctgttggttggattttaaaatagatgatttaatcagtgcatttaatatcctaatatggcatcaaaacttgaacattgatatggcctgaaatctgttgaaaatgatcatattgagtaaagaaagtctctacccaccggtattaataacagggtgatctgtttagaaattacattttctctgatacatcaatgagttttgcaaaggagagaaaattgatggtacctgtagtcaagtccagttccaatactgccacagaatttttcttaaaagttctattgtaaataataggccacagaatattccttcactttctgggatgcaaaatggattcgtaaatgctgtaccacaggagtgagtatttacaaaaaatatgccaactggcccacttacaaagctatttatagaagtcctacttttcaaactattttttttttaacctgtaaagggaaagttaattcttgttggttttatgagtagtgaacagtggctattagaaatcaggtagaagtaaaaacagcagttttccaacttcttcttctttttcttgagaccaagtttcgcttttgtttcccaggctggagtgcaatggcgtgatctcagctcaccacaacctctgcctcccgggttcaagcgattctcctgcctcagcctcccgagtagctgggattacaggcatgtgccaccatgcctggctcattttgtatttttagtgagatggggtttctccatgttggtcaggctggtctcaaactcctgacctcaggtgatagtccaccttggcatcccaaattgctgggattacaggggtgagcccctgcccccggcctccaattccttgatcatagaatctctttcaaaaaaaatgaggaccccagacagtttttgtttttgtggattataacagtcaataagtcatcctgttagacattaaaacagaaatttaaaacatatttaacaatctatttaaaagtaatggtaacaggccaattacatgttacatacaaaaatgtatgtaatatatttattgtttttatattttatttttattaaatatatatatttttagaataatttatacttttctataaatataaaatacaaataagttatatttatataatttagatgtaaataaaaacaattgatatttttatataaatatataaatgtgtacacttatggggcacagtgtgatgctttgctgtatgtttgcattgtggaataattaaactaatatctatcacccgctatttttcctttgcggtgggaacatttaaaatctcttttagctatttttgttttttatttccataggttattggggaacaggtggtgtttgattccatgagtaagttttttagtggtgatttgtgagattctggtgcacccatcacccaagcagtatacactgcacgcaagacatttaaaatctctattggcgggccgggtgcggtggctcatgcctataatcccagcactttgggaggctgaggcgggtggattgcctgagctcaggagtttgagaccagtctgggcaatacagtggaaccccatctctactaaaatacaaaaaattagctgggtgtggcagtgtgcgcctgtagtcccagctacttgggaggctgaggcaggagaatggtgtgaacctgggaggtggaggttgcagtcagccaagattgcgccactgcactcaagcctgggcaacagggcgagactccgtctcaaaaaaaccaaaaaaacaaaaaaacaaaaacaaaaataaaaacctcttttagctattttgaaatatgtaatacactattaactatcgccaccacgctgtgcagtaggtcactgaaacggattcctcctgtcgaacagaaacttggtaccctttggccatgtgctgtatgttttttaaaagaaaaatgattgtcatttccaaaataacaaaaacctagggagaagagtggctgagttttagggttttgtcagtctcatccataaagggacggatggcggctggctccttcctctgcttcttcacactggtctcttgcgacgtgtcgttctggtaagagtcatgtgaggcacatccactggcctctcatggatgtgcaattggaaacgtgaaatcgccggccccctgagagcgttttggggagtgtcccccccaaacccccctccccccgcactggggatgctgcaccagtcttgaagaatgaggcagtgagaggctggtttacagcaacctttattcgtggccttgtgtgctcggaagcgctgcaagggaggaggaaggaggaaggagggtactcactgcagaaggtcagctctgctgtggctgttacgtgggttcaggtggaacccacctactgtgtggacggttctttacctgggaatcccatggaattctgacagcaggagacgtgggagggagcttcttgtttctccttccaggagtcacttggttaggggtttgggaattttggctcttagtacaaaacttcactccaggtactagacctgtttcagccaaatgatgatcatcataatagaatagaaacctttgttcacctaaataataacaataatattaataataatagaatataaacctttgttcatggtactggggcgtctttcagcccaataataataacaacaataggaataatgataataatgataaaatataaacctttgcttcacgtcctggaacgtctttcagccaaataataataataatattaatgataatagaatataaacctttgttcagggtactgtgacttctttcagcccagtaataataataataatagtaataatgataataatgatagaatataaacctttgcttcatctcctggaacgtctttcagccaaataataacaataataataataatgacaatagaatataaacctttgttcagggtactgtgacctctttcagcccagtaataataataacagtagtaataatgataataatgatagaatataaacctttgctccaggtcctgggagctctttcagccaaataagaataataatagaatataaacctttgttcacagtaccaggacctctttcagaccaacaataatgacagtaataataattataatgataatagaatataaacttttcttctaggtactgggacctctttcaaccaaataataatagtggaatataaaacttggctctaggtaccagaaccttttttcagccaaatagtaataataagaatagtattaatagaaaacagacctttggtccaggtactgggacacctgtgagccaaataataataataatgataataatagaacataaacctttgactgaagtgccagaacctttttcagctaaataataataataaaatataaacttttgttccaggtacccggacttctttcagcctaataataatcatagaatataaacctttactacaggtcctggcacctttctcagccaaatagtaataaaatagaatataaacttttgttctgttactgggacctctttcagcctaataacaaaagtaataataatagaataaaaacctttgctccaggttctagaacctctttcagcctaataataataataatgatagaatgaaaatttttgttccaggtgtcgagacctcttccagcctaataataataataatgtaataatataagcctttgctacaggtaccaggacctgtttcagccaaataataataacagcaatgataatagaatataaaccttggccccaggcactgggacttctttcagtcaaacaatcacaataataataataataatagaatatggatgtttgctccagctttcaggacctctttcagacagataataataaccgagtacaaacttttcttccaggtatcgggacctcttccagcctaaaaacaatagtaataatagcatatatatctttttttttgttttcttctttctttgagacggagttttgcgcttgttgcccaggctacagtgcaatggcgccatctcggctcactgcaacctctgcttcccgggttcaaacgattctcgtgcctcagcctcccgagtagctgggactacaggcatgtgccactaccacgcccggctaattttgtatttttagtagaggaggggtttcaccatgttgtccagggtggtctcaaactcctgacctcagatgatccacccaccttggcctcccaaagtgctgagagtacaggcgtgagccgctgtgcctggtgccagcataaaaatctttgctacaggtactgagacctttttcagcctaataataataacaaccgtaacaataataattagaatataaacctttgttactggtactgggacctcttccagcctaatcttcataataataaaaataataataataatggaattgaaacctttccttcaggttccagaaccgctttcagccacataataataataataatgataataataataataaatagaatttaaacttttgtttgaggactgggacctctttcagcccaatagcacaaataataataatggaatgtaaaccttttcctcccaattaccaaaacctgtttcagccaaataataatatgatgatgatgatgatggaggatctgatacagctgtgtcctgtcactcaggtcggacttaggaggcctcttgagattcttttccccctccgttgactgtgtaatccaggggccccaccctaactcggctgcagaagatgcagtttgggggttcctcgttttgtggaagtcccggtcatgttattcattctctcagcaccttagaacaaaccagggtgctggcattggccacaggacccccctccttgcaccccagtcttgggaagtggcactgctgggctctggcaatgcccagctcacctggcacgtggcggcgtctccctaaaaagcactgggcgggcaccgttgacggaaagccagcaacgcaggccgcgactgcccgtgaagacggggggcctttctaagacctccactcattatttcgggcaaaattaaccttcagaataccttgctttaataaagtaccagaaaccggagggcttaaaaccatagcttattctctcccagttctggaggccagaagtctgtaatcaaagtgtctcagggctgcgctccctccggaggcttacgcggagggtgcttcctgcctctcccagctcctgggggctcctggcgtccctgggcttcaggccagccacatcatcactctagtctctgcctctgtctccatgtggccttctctgtgtctgtgtctcctcttctgtcttttataaggacatctgtcactgcatttagggctcactcaaatcccggatgatctcatctccagatccttaactcatgagatctacaaaatttctaataaccaagtaagatctcattccacatcctgggctttaggctgtggacagatctttctgcgggccactgttcaatccaccatgattttatccagttcattgtggaggctctagaggaggatccttcctgcctctcccagctcctgggggctccaggcgttctgggtttgtggccgcatcactccagtctcggcctctgtctccatgtggtcttctcctgtgtgtccgtgtctcctcatctgtcttctattaaggacactggtcactgcatttaggaccacctcaattgagaataatctcatctaaagatccttaccttcattattaatacatctgcaaagaccctttttccaaacaaggtcccatacacaagtaccaggtggatacagattttctttggtaggggaggacgcttttcaacccactatagtcatcattgaaatatgcctccttgcactgactgtatcccaacactctgaacgtgcctgggtggtgcattttgatatttaccctcctgagcactgtactggacacttggagacacaattacaccttttaacaaagcccagctgtcattttgggcaacccagtcacagaggtggcctcctgagtggcagctggaagggcctgtatgtgtgagcattcaacctcaacaggaaccctggggactggcttctgggtcatctaagcctccacaccgactgcctgatgtttgcacaggtgtgtgatatttgcccagttgggcctttctgcccacaggtgtgactggacacaatgggcattttgagaagttccagggattgagaaatccatgcttcttcagacgtgcttacagatcacggatgcacctgtgacgttccacatggcttcattttaaaccataaagtttgagaagagtgtgcagtgcctcttagccataggaaagctggctttagtcagatggaggtcctgtttggcttctttaatgcagtgaatgaagctcaggtggcattcagagagtcctgctgtgatggttggcagtggggggtctgcctggccacttgtggattcttctatgtaggcttcatccccagaaaagatctacgcagctttcccacgtggcaggtgcttgggaaactcttaggacaggaacaacaagcccctgcgatgacagaggcattgtcaggctgggcgcggtgactcacgcctgtcatcccagcactttgggaggccaaggcgggtggatcacctgaagtcaggagttcgagaccagcctgaccaacatggtgaaaccctgtctctactaaaaatacaaaaattagccaggcgtgatggcaggtgcctgtgatcccagctactgaggaagctgaggcaggaagatcgcttgaacccgggaggcggaggttgcagtgagctgagatcacgccattgcactgcagcctgggtgacagagcgaaactctgtctcaaaaaaaaaaaaaaaaaaaaactaaaggcacttgtcaggtacagccctgcaaaaatgccgtgctcactcgcaaacctgtatgttgacacgtgcggcatcgctgcagtcggattaacgtggaagaaagagcgtattcctgcgctaggttccctcctccactctgcaaaagtgacccgcaaggaaggtccagccgtccggccccagtgccctttggttgaaagcggagctgccccggcaccctgtctgtctccccggcagggctcccgtgcgtgcctgggtcccttctcatgctgtgtttgtcttggcccttctcagcaggtccccacgcatgagcagccgtccagcaggcaggctccggtggagaagcaatggagaataaaagcctggagagctcccagacagacctgaagctggtggcccacccccgcgccaagagcaaggtgtggaagtatttcggcttcgacaccaacgccgagggatgcatcctgcagtggaagaaaatctactgccgcatctgcatggcccagatcgcctactccggaaacacctccaacctgtcctaccacctggagaagaaccaccccgaggaattctgcgagttcgtcaagagcaacacggagcagatgcgtgaagccttcgccaccgccttctccaagctgaagcccgagtcgtcccagcagcccgggcaggacgcgctggccgtcaaggccggccacggctacgacagcaagaagcagcaggagctgacggccgccgtgctgggcctcatctgcgaggggctgtacccagcctccatcgtggacgagcccaccttcaaggtgctgctgaagacggccgacccccggtatgagctgcccagccggaagtacatctctaccaaggccatccctgagaagtacggggccgtccgggaggtgatcctgaaggagctggccgaggccacctggtgtggcatctccaccgacatgtggaggagtgagaatcagaaccgcgcctacgtcacgctggccgcccacttcctgggcctgggcgcccccaactgcctgtccatgggctcccgctgcctgaagaccttcgaggtgcccgaagagaacacggcggagaccatcacgcgagtgctctatgaggtcttcatcgagtggggcatcagcgccaaggtcttcggggccaccaccaactatggcaaggacatcgtgaaggcgtgctccctgctggacgtcgcagtgcacatgccctgcctgggccacaccttcaatgccggcatccagcaggccttccagctcccgaagctgggggcgctgctgtcgcgctgccgcaaactggtggagtacttccagcagtctgccgtggccatgtacatgctctatgagaagcagaagcagcagaacgtggcccactgcatgctggtgagcaaccgcgtctcctggtgggggagcacgctggccatgctgcagcgcctcaaggagcagcagttcgtcatcgccggggtcttggtggaggacagcaacaaccaccacctcatgctggaggccagcgagtgggccaccatcgaggggctggtggagctcctgcagcccttcaagcaggtggccgagatgctgtcggcctccaggtaccccaccatcagcatggtgaagccgctgctgcacatgctcctgaacaccacgctcaacatcaaggagaccgactccaaggagctcagcatggccaaggaggtcatcgccaaggagctttccaagacctaccaggagacgcccgagatcgacatgtttctcaacgtggccaccttcctggacccccgctacaagaggctgcccttcctctccgccttcgagcggcagcaggtggagaatcgcgtggtggaagaggccaagggcctgctggacaaggtcaaagacggcggctaccggccggctgaggacaagatcttcccggtgcccgaggagcctcccgtcaagaagctcatgcggacatccacgccgccgcccgccagcgtcatcaacaacatgctggccgagatcttctgccagacaggcggcgtggaggaccaggaagagtggcatgcccaggtggtggaggagctgagcaacttcaagtcccagaaggtgcttggcctcaacgaagaccccctcaagtggtggtcagaccgcctggccctcttccccctgctgcccaaggtgctgcagaagtactggtgcgtgacggccacgcgcgtcgcccctgagcgtctcttcggatccgccgccaacgtggtcagcgccaagaggaaccggctggctcccgcgcacgtggacgagcaggtgtttctgtatgagaacgcccggagtggggcagaggcggaacccgaggaccaggacgagggggagtggggcctggaccaggagcaggtgttctccttgggggatggcgtcagcggcggtttctttggcattagggacagcagcttcctgtagcgaggaagcgtgttgtcttacaagtcatccccgcagcagcccattggatgctttgctgtaaatacttacccggtcagcttggttttgaacctcagagaccatccactgtctttgacacctagaaggtggaaaaaggaaagagatttgagaagtgagagagggtcgggggcggtggctcctgtctataatcgcagcactttgggaggccgaggtgggcagatcagctgaggtcaggagatcgagaccagcctggccaacatggcgaaaccccgtctctactaaaaatacaaaaattagccaggactgatggcatgtgcctgtaatcccagcttctggaggctgaggccagagaatcgcttgaacctgggaggtggaggttgcagtaagctgagatcgctgcactccagcctgggcgacaagagcgagactctctcaaaaagaaaaaagaagacacaagagaggtggctttgagtgggtttcctttcctcccctattcccggggcccggacgacttctgcttgggaactgccaacgcttctgcttgggaattgcgtgcagcagagcctagaggagctgttccttccttcacagatacttaagacctccaccatgtctgattcgagttctccctgggagggtttagaagaaacgcaggaacattctgggtggcgtcgaaggagcctttcccgatcatcatgtgtgacttctgcgaggtccagatcactgaattcatgtttacattctcgtgcaagcagggacctcttgcttctgagaaatggggaagagaccttttagccaaaatgcccttcttaaaaagagagacctttttttttaatgttcggttaaaaatgtgacagatgagtacaaaaatgcagacacttaacaaaaagcaaacagaaaaaaaagtgtggaatgtgttgtattttcgacaggttgctgccagagagcctgcttcctgctgcctgccgaaatttcactttgcggagttggtccttaaaactgggcggtggccgggcgtggtggctcacgctgaggtcaggagttcgagaccagcctggccaaccaacatggtgaaacctcgtgtctactaaaaatacaagaaactagccagatgcggtggcacccgcctgtaatcccagctactcgggaggctgaggcggaagattcgcttgagcccaggaggtggaggttgcagtgagccaagactacgccactgcactccagcctggaggccagagtgagactccgtctcaaaacaaaacaaaagtgggtggctcacgggtccggaggttatgtcttcggtgtctcagccctaaaagtccagttcccccgtgcggccagcttttccacataaggtgtttttgatttgattaccggaaaggactcttgattcttctcttttaaactgaataccataggggaaatgaattttaaaatattgcccccggaggggttttccgtggctggattcctgcgagttgctttcagtcattcagggaaacagaaagacgttttccaacatgtagaactgctttttaactggaggaaaaatacttcaggaggcttagcatattgcttggattctacgtgcagcgggttctctgcctccgtgaagacaagctgggctggggagaacggtgtctaggagggatgaccccactcagctccaggcagtgttctgccgagaccccaagaactcggggtgtcagagggcaaaggaactacctgcctttcacggctgctgacttctcagggctgcaagcagcacagaatgttatccttacgtcctgagccggtttaagtctgtggaaaaggaagcacgggagaaatccacgtaacctttgctttctttttaagggaagcggttccgccgtgaacttggaaccctcagctccgggtgttctcggcagaagggcagctggaagggacacagtggggcaggctttggggttgctccctgttctgccccgaggccggggacgcagggcagcccacgcctccgtgggctccattctgtagcattgccagcgttctcttcacgtctctaacaatccttcgcttttcctcactcacgtggaaatgtgaactgtcccggctctgtcttcatttttatttttaagccatcgttcccctcctgaacggttgccccttatttaatgctgtaaagttggactgttgttcaataaaccagagcaatgcattagctcctcattcatttgtctgccgcgtgtccgtctggactgcagtttgtctgaaccccttgatcctgggagtggagggaggtttatcattattattatttttatttttgttgtggtccttgttgaaagcaactttttccagggcacccacggtcagttctgtgctcctctttcttgtctgtaaatcctcaagttatgatgtactttcgggtgttttggcatcaaaatttctgagtgaataaagccggcagctggtgaaagtgttccccgggagcagagatttttgccggttccttcacttagtggatagttgtataaacggaggccccatggacgaggcagcctggatggatccggatggcatcagcgccttccctctccccccagcctccttatcacccctctcttcctgtcttcctcacctcctctcacatggtctcttccttccctcctccttccgtccaaccctccctctcttcttcagccaacaaatccttcctttcttccttctttccttccttccttccctcccatccttgtctcttcttctctcccttccttccctcccttcccttctttctttctctcccttccttccttctctcccttccttccttctctcccttccttccttctctcccttctctcccttttctcccttccttccttctctcccttccttccctcccttctctcccttttctcccttccttctctccgttccctccctcccctccctctctgcctccctttcctcccctccctccttcccccatccctccctccctccttccctctcctccctccctccttccttccctctgtccctccctgtctccctcccttcctccttccttcctttcctccctccctctgtccctccctcccttttctccctccctcccttcctctttcgttttccttccatccctttttccttcctccctccctcttttcctccctcctgagaaaacaatggcccccaagaaacacaggaaggccgggatgtgcacctctgcccagacttgccctttccaagtgctgttggttgactgcctgtccttgggcatcattaaaatgccgaaatttctctttcttgcacgttttgggttgaaaggggttcattttcagtcctcataactaagcatttgcatcgtgatgttcatttaagtgggacatgtttacacgtttttcccattaggagtaattctagtccttgagggtttcttacagagacatttccctaaccccgacggttctcatcccagcctgtgtggcactccttccgcacagtggtgggatttttcggttcggttttgttttcacgcttgcatctggctgcacagccctaactctgagctggttgtttttgtttcccccccactttgcagaattgcctgcttcgaactgttttcccagcaggcctctgaagggtgaggaaaacagcttggggaaagtgagaaaaaggtttcggatgttttagtaaagaggcagctggtgggaaggagccggttgggctgtttctggggtgccgaaatctcggtggtgacgttcatttgctcgtgagtgcagaggaggcccagagaccgggttcctggcgcagccagctcctgcttttgttccgaccatcttcctgcgccttctgcgagtctcagatgtgcttgggcagcagttctactgttttcccctctgtgatctcaggcccgccgccccgtcctttcccagtgatttctgctccgtcaaatcgtggggctcacctgagagttttataaaatgaactcgccatgcccctgcctggtgaacagagaatgcaaactctcacaggaccgtctgcagcaaaacggcagtgttttgctcatttcttcagacgacgaaaacagcagggtttggctcgtttcttccagattttctcaaactgcatgagttcctttctgagcaacttctgggaagctttcgggtttcagggctttgcagccaggctccttcctagctgcggctgcctgtccttttgtgttgcagtcagatgcgggaggtccttggcatgagtaccctgatggtgtcaactttaaggggtcagagaggaaatatttttggctccgcggaccatgcattctctgtctctcaacaacttagttttgccgttgtgtctaaaagcatccattgctgggtgtggtggctcacatctgtcatcccagcactttgggaggccgaggcgggtggatcgcctgaggtcaggagttcaagaccagcctggccaacatggtgaaaccccatctctactaaaaatacaaacattagctgggcatggtggtgggcacctgtaatcccaggtactgaggctgaggcaggagaatcgcgtgaaccagggaggcggaggttgtagtgagctaagatcgtgccactgcgctccatcctgggcgacaagagcgagactccgtgtattccactcccacttcgtgggcactaaattttatataaatgttgtgtcaagaaatattattgctctgttgacttctttttttcccccaaccattaagaaattcagaaaaaaaatgtacgaatgtaaacactgttcttggtgagtgggccttccaaaaataaccgctggactttgttgaaactacttttttttttttttttttttgccactttttcccttttttttctcgaggcaccaattggaatccacttatttgtcctggtttgagaaacagctcagatcgcacactctgggctctgtgtttctttaggtaacacacgtgaggtttttgtcactggaattcagtaatctgtgttaatattatcacaaaagaaccggggggcatttgtgtcttctcagaattgctgattaaaacagctgcatggccaggtgcagtggctctcatgcctgtgatcccagcactttgggaggccgaggcaggcggatcgcttgagcccaggagtttgagaccagcctgggcaacatggccaaacctcatccctactaaaaatacaaaaaattagccaggcatggaggcgcatgtctgtagtcagtcccagctactcaggaggcgaaggtgggaggatcacttgagcttgggagttggaggctgcagtgagctgtgaacataccactgcactccagcctggaaaataaagcaagagatgctgcctctaaaaataataataataataataaaaattagccaaacatggtggcacgcatgtgtgatcacagctacttgggagactgaggtgggaggatcgctggagcccggaaagtcgaggctgcagtgagctgagattgcatcactgtcgtgcagcctgggcaaaagagtgagaccctgtctctaaataaataaataaatgagttcacgattaagcagaagttgtgcttgttctgccaggatttcagttgggttctttgtgccctaatttacgtgagctagtaggttgtgcgttatcttagagggcttgcatgaaagaaagagggtagcctttcttttccctgttttggtagcattgctgaggtggcttttggctgacgggtggacccgtgggtgcagatgttttgatgcagaaggaatgattgccttttcacattcaggctccaactggcttttagcttgtgcgttcttaccctggggtgttcgaggtcaccggactcctattttatttgtgtttaactggaaaggcaggaactctgagaacgtatcaaataggcagttactgcaggatttctagaatttaaattgcttccaaaactgtatccacaagctaagaattatgtttaggttttaaaaggtgttggtttgcttcttacatgtttaaattcttgagggaaagaaatgcaaagaataataaagtttcatgatacaaaaatggtatgagaccgggcacaatggctcacacctgtcatcccagcactttgggaggctgaggcaggaggatgatttttgagcctgagtttgagatcagcctgggcaaacagcgagatcctgtgcctacaaaaataaaataaaaataggctgggtgtggtggctcatgcttgtaatacctgcactttgggaggctaagtcagtaggatcacttgaactcaggggtttgagaccagcctggtcaacatactgagaccttgtctctagtaacaataaaaaaattagctggacataaggtgtgcatttgtagtcccagttacacaggaggctgaggtgggaggatcacttgagccagggagttggaggctgcagtgaaatgtgatcgcaccactgcactccagcctgtgcaacaaggagagagatgctgtctctaaaaaaaaaaaaaaagccagacgtggtggcacacgtgtgtggtcacagctacttgggaggctgaggctgaaggatcgcttgagcccaaggaggctgaggctgccataaactacgatcatgccactgcactccaggctgggcaatagcctgggcgactgtctcaaccaaaataaatttaaaaagataggaaatttcaatgtgaaaatcagtgtcccccagaacgttccatttcttcccagctgggctatttttggagttccatggggagccggctcagtgcagtttgcatgtactcgggaggatgagccctgccatggtgtgtgttaggggacagcctgatctcaccaaccctcctgagcaggcccagccctccgagtaataactgggaacactcgccgctttgtgagacgacctcgtgtgctcactggaaggtcatctcttctggtccatgctgcagtgtggataccattttttttttttaagacagtttcactcttgttgcccaggctggagtgcaatggcacgatctcggctcacagaaacctccgcctcctgggttcaagccattctcctgtctcagcctcctgagtagctgggattacaggtgtctgccaccacagccagctaatttttatatttttcgtagagacggggtttcagtacattggtaaagctggtctggaactcctgacctcaggtgatccacccgcctcagcctcccaaagtgctgggatgacaggcgtgagccaccgcgaccagcccagtgtggatacaccttgagcacataactggaatcctttccttggaaacttggagccccttgtgtcatggtcatataaactgttgaattaagaggagacaccattaaatatgtcacagctgtcctcgaaactgggacttgttttgctttctgcctggaaatgcgagctatctttatagaattattttatagaaaataattgtatacatatataggaggtacgacgtgatgttttaatccgagtacacattgtgcaatgattaaatcaagctggttaccatattattaacctaattaacatatcaataatcaagctaattaacacattaacattcaagctaattaacatattaacaagctaattaacatattcacataatcctaactctgacctatatcacctcacctacttttttttgtggtgagaatgtgtaaaatctacttttagtcattttgaaaaacgcaatgtattattattaatgataatcactgtgtggtgtggtagaactttgaatttatttcttctatctaactggaaaaatttaattttaatgtaatttattttttttgagacagtctcaccctatcacccaggctggagtgcagcatcatgttcatagctcatggcagcctccaactcctggctcaggtgaccctcccaccacagcctcccaggtagctgggactacaggtgcacaccaccacacctggttaattttttaagttttttgcagagatggggtcttgctatgttgctcaggctggtcttgaattcctgggctgaagcgatcctcctgcctcagcctcccaagtagctgggactgcaggtgcatgctaccatacccagctaatttttttttttttttttaaagatgcggtttcattatgttgcccaggcttgtctcaaactcttggcctccagtgatcctccttcctcagccttccatagcattgtgattccagacatgagccaccgctcctggcctccaactgaaattttatgttctttgacaaacacttcatgaagcattcttccctggcaaccaccattgcactctctgcgtttatgcgttcagcttttttagattctacatacgagatgatacagtatttgtctctctgtgcctggttcatttcacttcacattgtatcttccagtcccatccatgttgctgcaaatggcaggatttcctttttcatggctgcatactattccattgtgtgtctatgccacatttgcttgatacgctcatctgttgattgacacatgggttgattctatatcttggaaactgttagtagtgttggcagtgcacagggggtgcaggtatcccattgatgggctgatttcctttcctttgggcacacaccaagcggtgggatgactggatcctgcacaacattctttcctttggtgtttcgcaggcccgtttctggactttagtgaacgtcttcccagtgtccatggcgtccgtcccttggccacatgcttagggaacatcttcagtgtgtacatggcgacagtcccatagccacattcttagggaatgtcttcagtgtgtacacggtggcagtccctttgctgcatgcttagggaacgtctacagtgtggtccattggccacattcttagagaacgtcttcagtgtgtacactgtggcggtcccttggccacattcttagggaatgtcttcagtgtgtacatggcggcagtcccttagccacatgcttagcgaacatcttcagtgtgcacagggcagtggtcccttgggccacatgcttagggaacgtcttaagtgccgtcccttggccgttttcttagggaatgtcttcagtgtgcacatgtggcggtcccctggtcgcattcttacggaatgtcttcagtgcgtacacggtggtcccgtagccacatgcttagggaatgtcttcagtgtgcacagggccatattcttacggaatgtcgtcagtgtgcacatggtggtggtcccttggccacattcttagggaatgtcttcagtgtgtacgtggcggaggtcccttagccacaagcttagggatcatcttcagtgtgcacagtgcgggagtcccttgggccacatgcttagggaatgtcttcagtgtgtacatggtggtggtcccttagccacatgcttagggatcatcttcagtgtgcacagggtgggagtcccttgggccacatgcttagggaacgtcttcagtgtgtacagggcagcagtcctttggctgcattgttagcgaacatcttcagtatgtacatggctgtggtcccttagccacaagcttagggaacatcttcagtgtgcacacggtggtggtcccttgggctacatgcttagggaatgacttcagtgtgtacatggtggccatcccttggccccatgcctagggaatgtcttcagtgccttgccttggctgcattcttagggaacgtcttcagtgcgtacatggcggtggtcccttagccacatacttagggaacgtcttcagtgtgtacaccgtggtggtcccttggccacattcttagggagcgtcttcacttcttacatggtggtggtccccgggccacattctaagggaacgtcgtcagtgcctacacaatggtggtcccttggccgcacgcttggggaacgtcttcagtcacagccctggttggtcccttggccacattcttagggaatatcttcagtgcatacacggtggcagtcccctggtgtcattcttagggaacgtcttcagtgcggtccctcaaccacatgcttagggaatgtcttcagtgctgtttcttagccatattcttagggaacctcttcaatgtgtacacactggtggtcccttggccgcatgcttagagaacatctttagtgcagtcccttggccacattcttagggaacgtcttcagtgtgatcccttggccacattcttagaaaacgtcttcagtttgtacaaggtgacagtccattggccagaatgtgtccctgccacattcttctgagtgtctgtgtctgtgttctttccaccctgtaagctgcttttgcttcttcactgggtgtctgtgactctcatgtggaatccctttcctctgtcaccgcccatcccaggcacagtgagagacgcagccagcctgctcctctctgcacctcgccatcccagacatcctccagccaccgtgctgaccgcattcattccttctcctgccctgtccgcatccttcttcccctacacgtttgataccaagaaatggtctgaatcacagccaaggcttcatttgctttctggaactgcagctccccagccccacccagatcagagattcagaacctgaatcttcggatttctggagatgcccccatcctatcagagacttctagtgtgtttctttatatccgtgtagacttgggaggatgacaggagagaaaccttagaaggtggtctgtgcatttcccgggcccggggtggaaggggcttgtgtcctggctgcctctgtgcacctttcattcttttttttttttttgagacggagtcttgctctgtcaccctgtcacccaggctggagtgcagtggagggatctcggctcactgtaacccctgcctcccaggttcgagcaattctcctgcctcagtctcctgagtagctgggaatacaggcatgtgccaccacgctcggctaattttatatttttagtagagatgggtgttcttcatgttggtcatgttggtctcgaactcctgacctcaggtgatccatccgcctcggcctcccaaagtgttgagatgacaggtgtgagcccccgcgcctggccgcacctttctttcttgatccacctggttttaaactcacagataaactgtttccacctgtgacaaatgagtcatccaccttccatgtggtctggactttgtccctgttacaatattcctgtctcttgtttctggttttttgcatcccacatgttgtccctgtaacagtcctgtctgttgtttctggggtcacccgtgtggcgagctgactgtgccacgttcctgaggctggtgaggatgctgtgggcaccttaatcacggctgtgaacaaactggctagagctaggtgccatggagctttgcagtggacactaagtcgtggtacccattctttgatcagtgacggagccaggtgtcttattaggtcttggggatttgtggaagcccagagcagggaaacagcttctacattgaaaggaatccttctcacactcatgttggcatcgtgaagtccctgatttcctaagacactaccctaatattttaaaagacttacaaaaaatttagtaaaatattcctaatagcagcacatgtggtgtttttttgtttgtttgtttgttttcgagatggagttttgctactgttgccaaggctggagtgcagtggtatgatctcggctcactgcagcctccgtctcccaggttcaagggattctcctgcctcagcctctcaagtagctgggattacaggcatgcactaccacacccggctaattttgtatttttagtagagacgggtttttccatgttggccaggctggtcttgaactcccgacctcaggtaatccgcctgctttggcctcccaaaatgctgggattacaggtgtgagtctccacacctggtcaatcccattctttttcaagaatgcatagtattctgtggtgtatgtacaccaccttttctttatccagtctacgtggcgttgttttgaggaatggatgaaatgatttgcataaaaacagtgaatgctttctattggaatggtgtttgcctcctgggaaactgtggagtcattgcaattgcaatttcctagtagatttgattaattaagagcattgggaatttttggggtgcctgatgcactattacagatatttttttcacagtgtagatatctcagcatgaatatgtctgttttcttttcttttctttcttttttttttttttgagatggagtttctctcttgttgccaaggctggagtgcaatggctcaatcttggctcactgcagccaacatctcctgggcttaagcagttctcctgcgttagcctctggagtagctgggattacaggcatctgccaccatgcctggctaatttttttttgtgtgtgtgtttttagtagagacagggtttcaccatgttggcctggccggtctcaaactcctggcctcaagtgatccacctgccttggactccgaaagtgctgggatgacaggcctgagccatggcggccagctgtctgttttctttccataagaggtgctggtctcaccgtggctctgtgctgtgatgaaatggcattgtccaagttttactcctcacagcctgattttgtatgttaaagacgtcttccttggtgtgaatcaagtgggctgggcagagttaagggagccatttatttagaaggcgattagatcgaattatgtcttggtaattactgcagttacaccaccccattctttccgtggctctcctagctgggtttgtggctagtcatggaggtgccctgaagagcctcattttcccacagctgtaggaagtgtgtggtacacccacaatgtcttagcttttgtattagggaaggtcttcagtgcattcccttggccacattcttagggaacatcttcagtgtgtacatggcggcggtcccttaaccacattcttagggaacgtgttcagtgtgtacacggtggcagtcccttggctgtatgcttagggaacgtcttcagtgagtgtgatcccttggccacatgcctagggaacatcttcattgtgtacctggcggcggtcccttagccacatgcttagggaatgtcttcagtgtgtacacggtggcagtctgttggccccatggttagggaacatcttcagtgtgcacagggcggcggtcccttgtgccacatgcttagggactgtcttcagtgtgtacatggtggcggtcccttggtcgcattcttagggaacctcttcagtgtgtacatgtcggcattcccttagccgcatgcttagggaacgtcttcattgtgttcttggtggcagtcccttagccacatgcttagggaacgtcttcagttgtatacagtggggtcccttggtcattatgcctaggggaacgtcttcagtgccagctgcattcttagggaatgtcttcagtgtgcacatggcggaggtcccttagccacatacttagggagtgtcttcactgcacacagcagtggtcccttggttgcattcttagggaacatcttcagtgtgcacatggtagcagtccctcacccacattcctagggaatgtcttcagtgtatacatggtggcagttctttggctgcatgcttagggaacatcttcagtgcattcccttggccacatgcctagggaacatctttagtgctgtcccttccctgcatttttagggaacgtcttcagtgtgtacatggtggcggtcccttggccgcattcttagggaacgtcttaagtgtgtacatggcggcggtcccttagccacaagcttagggaacgtcttcagtgtgtatatggtggcagtctcttggccacatgcttagggaacgtcttcagtgccatcttttagctgcattcttagggaacgtcttcagtgtgtacatggcagaggtcccttagccacacacttagggaacatcttcagtgtgtgcacagcagtggtcccttggcctcattgttagggaacgtctttggtgtgtagatggccgccgtcccttagccacaagcttagggatcgtcttcagtatgcacagcgtggcagtcccttgggccacatgcttaaggaatggcttcagtgtgtacaccgttgtggtcccttggccacattcttagggagcgtcttcagtgccgtcttttggctgcattcttagggaatgtcttcagtgcgtacatgggggcggtcccttagccacatacttagggaacgtcttcagtgtgtacatggcagtggtcccttggccccattcttagggaacatcttcagtgtgtacatggtggcagtcccttaatcacatgcttagggattgtcttgattgtgtacatggcgatggtcccttggccacatgctttgggaacctcttcagtgcatacggagtggcagtcccttgtccacattcttagaaaacgtcttcagttcgtacacggtggcgatcccttggccacattcttctgagtgtctgtgtctgtgtcctttccaccctgtaagctgcttttgtttcttcattgggtgtctctgactctcatgtggaatccctttcctctgtcaccgcccatcccaggcacagtgagagacgcagccagcctgctcctctctgcacctcgccatcccagacatcctccagccaccgtgctgaccgcattcattccttctcctgccctgtccgcatccttcttcccctacacgcttgataccaagaaatggtctgaatcacagccaaggcttcattatctttctggcactgcagctccccagccccacccagatcagagattcagaacctgaatctttggatttctggagatgcccccatcctatcagagacttctagtgtgtttctctatattcgtgtagacttgggaggatgacaggagagaaaccttagaaggtggtctgtgcatttccggggcccggggtggaaggggcttgtgtcctggctgcctctgtgcacctttcattcttttttttttttttgagacggagtcttgctctgtcaccctgtcacccaggctggagtgcagtggagggatctcggctcactgtaacccctgcctcccaggttcgagcaattctcctgcctcagtctcctgagtagctgggaatacaggcatgtgccaccacgcccggctaattttatatttttagtagagatgggttttcttcatgttggtcatgctggtctcgaactcctgacttcaggtgatccatccgcctcggcctcccaaaatgttaggatgacaggcgtgagcccccgcgcctggcggcgcctttcattcttgatccacctggtttcaaactcgcagataaactgtttccacctgtgacaaatgagtcatccaccttccgtgtggtctggactttgtccctgttacaatattcctgtctcttgtttctggtttttggcgtcccacgtgttgtccctgtaacagtcctgtctcttgtttctggggtcacccctgtggcgagctgactgtgccacgttcctgaggctggtgaggatgctgtgggcaccttaatcacggctgtgaacaaactggctagagctaggtgccatggagctttgcagtggacagtaagttgtggtacccattctttgatcagtgacggagccaggtgccttattaagtctcggggatttctggaagcacagagcaggcaagcaccttctacactgaaaggaatccttctcacactcatgttggcaacgtgaagtcctgcctttggaaatccctgatttcctaagacactaccctaacattttaaaggacttaaaaaaaattcagtaaaatattcccaatagcagcacatgtagtgttttatttatttatttatttttgagatgatttgcactcttgtcgcccaggctggagtgcaatggtatgatctgggttcactgcaacctccgtctcccgggttccaaggattctcccatctcagcctgtaaggtagctgagattataggcatgcgccaccatgctcggctgattttgtatttttagtagtgacagggtttcaccatattggtcagggtggtctcgaactcctggcctcaagtgatccacccatcttggcctcccaaagtgctgggattatgaatcactgctcctggcctactttttaaactttcaggttcaggggcacgtgtgcaggttcattacacgggtaaattgcatgtcctgggggtttagtgtacagattaattcatcaaccaggtagtaagcctactaccatctgataggtagttttttgatcctctcatttgtcccaccctccaccctccagcaggcccctgcagctgttcccttctttatatccaccagtgcccaatgtttagctgtcacttatcagtgggaacaggtggtatttggttttctgttcctgtgtaagtttgctaaggataatggcctccacctccgtgcatgttcctgcaaaggacatcatcccattttttttttttttttgagacagtttcctttttgttgcccaggctggagtgcaatggtgtgatctcggctcaccgctaccaccagctcccgggttcaagcagttgtcctgcctcagccttctgagtaactgagattacagacacatgccaccacgcccggctaattttgtatttttagtagagacggggtttctccatgttgcccaggctggttttgaactcctgacctcagttaatctgccctccacggcctcccaaagtgctgagattataggtgtgagccaccacacccaaccaatcccattctttttcatgggtatgtagtattccatagtgtatatgcaccaccctttgtttatccagtttacatggcgttgttttgagaaatggatgaagcgatgtgcatgaaaacactgaatgcttcctactggaggggtgttcacctttccgggaaactgtggagtgattgcaattgcaatttcctagtagatttgattggttaatagcattgggaatctttggggtgcctgatgccctattgcagatcttttttcacagtgtagaaatctcaacgtaaatgtctttttttttttttgagatggagttttgctcttgttgcccaggctgcagtgcaatggctcaatctcggctcactgcagccaacatctcccgggtttgagcaattctgcctcagtctcctgagtagctgggattgcaggtgcctgccaccacacccggctaatttttgaatttttagtagagaaggggtttcagcctattgttcaggctgctctcgaactcgtgacctcaggtgatccacccacctcggcctcccaaagcgctgggatgacaggcgtgaccgcgcccagcccagtgtggatacaccttgagcacataactggaatcctttccttggcaacttggagccccttgggtcatggtcatataaagggtgttgaattaagaggaaacactgttaaatatgtcacagctgtccttgaaactgggacttgttttgttttctgcctggaaatgcgagtcatttttctggaaaattcatttttcgttaaaaaaagtaattgtatacacgtatatgaggtacaacgtgatgttttaatccacgtacacatcatgcaatgattaaatcaagctagttaccatattaacaatcacattaactaacatattaataatcaggctaattaacatattaacattgaagctaattaacatattaacaatcaagctaatttacatattcacataattctaactctaacctatatcacctcacctacttttttttgtagtgagaatatgtaaaatctacttttagtcattttgaaagacgtgatgtattattaactatcatcactgtgtggtgtgatagaacttggaattcatttgttttatctaactgaaaaaaattaattttaatgtaatttatatgttttttgagacagtctcatcctatagccaggctggagtacagcatcatgttcatagctctcagcagcctccaactcatggctcaggtgaccctcccacctcagcctcccaggtagctgggactacaggtgcacaccaccacacctggttaatttttaaattttttgtagagatggggtcttgctatgttgctcaggctggtcttgaattcctgggctaaagcgatcctcctgcctcagcctcccaagtagctgggactacaggtgcatgccaccatatccagttaattttttcagttttttttttatttgtttagagatagggtttcattacgttacccaggcttgtctcaaactcctggcctccagtgatcctccttcctcagccttccatagcacagtgattccagacatgagccacagcgctcctggcctccaactgaaatgttatgttctttgacaaacacttcagcattcttccctggcaaccaccattgcactctctgcgtttatgcgttcagcttttttagattctacatacgagatgatacagtatttgtctctctgtgcctggttcatttcacttcacattgtatcttccagtcccatccatgttgcgcaaatggcaggatttcctttttcatggctgcatactattccactgtgtgtctatgccacatttgcttgatgtactcatctgttgattgacacatgggttgattgtatatcttggaacctgagtagtgctgcagggcacaggggatgcaggtatcccattgatgggctgatttcctttcctttgggtacacacccagtggtgggatgtctggatcctgcacaccattctttcctctgatgttttgcaggcctatggctggacctttggaacgtcttcactatgtacaaggtggcggtcccttggccacattcttagggaacgttttcagtgtgtacatggtgtcggtcccttggctatatgcttagggaacatcttcagtgggtacatggtggcggtcccttagtcatattcttagtgaatgtcttccgtgtgtacacggtggcagtcccttggctgcatccttaggcaacgtcatcagtgcagtcccttggccacatgcttagggaacgtcttcagtgcatacacggtggcggtcccttggccacattcttagggaatgtcttcagtgtgtacatggtcgcagtctgttagccacatgcttagggagcgtcttcagtgtgtatagggtggcggtcccttggccacatgcctagggagtgtcttcagtgccgtcgcttggctgcattctttgggaacgtcttcaatgtatacatggcggcggtcccttggctgcatttttagggaacgtcttcagtgtgtacatggcggcggtcccttatccacattcttagggaatgtcttcagcgtgtacacggtggcagtcccttggccgcatgcttaggggacttcttcagtgcggtcccttggccacatgcctagggaacgagtcttcagtgccgtcccttggctgcattcttagggaacgtcttcggtgtgtacatggtggtggtcccttgggcgcattgttagggaacgtcttcagtgtgtacatggcagtggtcccttagccacatgcttcggaatgccttcagtgtgtacatggcggaggcccctcagccacgtgcctagggaatgtcttcagtgctgtcttttagcggcattcttagggaacgtcttcagtgtgtacatggtggtggtccctgagccacatacttagggaacgtcttcagtgtgcaacggcagcggtcacttggccttattgctagggaacttcttcagtgtgtacatggcggtggtcccttagccacaagcttagggaacgtcttcagtgtgtacatggcagcagtcctttggaccacatgcttagggaatgtcttcagtgtgtacacggtggtggtcccttggccccatccctagggaaagtcttcagtgccgtcctttggctgcattctttgggagcgtcttcagtgtgtacatggtggaggtcccttggccacattcttagggaatgtcttcagtgtgtacatggcggcggtcccttggccgcatacttagggaacgtcttcagtgtgtacatggcagtagtcccgtggccgcattcttagggaacctcttcagtgcatacacagtggcggtcccttggccacattcttctgagtgtccgtgtctgtgtacttttcatcctgtaaactgcttttgtttcttcattgggtgtctctgactcttatgtggtatccgtttcctctgtcagcgaccatcccaggcacagtgagagacgcagccagcctgctcctctctgcaagtggccatctcagacattctccagccagcgtcctgaccgcattcattccttcccctgcccggtccacatccttcttcccctacacccttgctaccaagaaatggtctgaatcacatcacaggcttcctttgctttctggaactgcagctccccagcccacccagatcagaggttcagaacctgaatcttcggatttctggagatgcccccatcgcatcagagacttctagtgtgattctttatattcgtgtagacttgggaggatgacaggagagaaaccttagaaggtggcctgtgcagttccagggcccagggtggaaggggcttccatccctggctgcatttgtgcacctttcattcttggtccaacattttttttttttttttttgagacggagttttactgtgtcgcccaggctggagtgcagtggtgtgatctcagctccctgcaacctccccgcctcctgggttcaagcgattctcctgagtggctgggagtacgggcatgcaccaccatgcctggctaattttatatttttagtagagatgaggtttctccatgttggtcaggctggtctcaaacccctgacctcaggtgatccatccaccttggcctcccaaagtgctgggattacaggtgtgagccaccacgtccggctgcactttttattcttgatccacctggtttgcaactcacagataaactgtttccacctatgacacatgagtcttccaccttccatgtcctctggactttgtccctgttataatattcctgtctcttgttctggtttttggcatctcacacattgtccctgtttcagtccggtctcctgtttctggtgtttggtgtgccgcacgttgtccctgttacagtcctgtctcttgtttctggggtcacccgtgtggagagctgactgtgccgcgttcctgaggctggtgaggatgctgtgggcaccttaatcacggctgtgaacaaactgactagagctaactgccacggagctttgcagtggacgctaagctgttgtactcattgtttgatcagtgacggagccagatgtcttattaggtctcggggatttgtggaagcctagagcaggcatgcaccttctacgtagaaaggaatccttctcacactcaagttggcgtcgtgaagtcctgcctttggaaatccctgatttcctaagacactaccctaacattttaaagggcttaaaaaatttcaataaaatgttcccagtagctgttacatgtagtcatgtagcgtttttttttttttttttgagatggacttttgctcttgtctcccaggctggagtgcaatggcgcgatctcggctcactgcaatctctgtctcccgcattcaagggattctcccacctcagcctgtcaggtagctaggattataggtgtgcgctaccatgccctgctacttttgtatttttagtagtgacagggtttcagcatgttgatcagggtagtctggaactccttgcctcaggtgatccacccgccttggcctcccaaagggctgggattatgaatcaccgcccccagcctacttttttcactttgatttcaggttgagggggacgtgcgcaggtaaattgcatgtcttgggggcttagtgaacagattatttcatcatgcaggtaataagtccagtaccacctgataggtagtttttcgatcctctcatttctcccaccctccaccctccagcatgcccctgcagctgttcccttctttgtatccatgagtacccaatgtttagctgccgtttatgagtgagaacaggtgatatttggttttcttttcctacgtgagtttgctaaggataatggcctccacctccatgcatgttcctgcaaagggcatcatcccatgttttctttttttctttttcttttgagactgggtttccttcttgttgcccaggctggagtgcagtggtgtgatctcagctcaccacaacctcctgttcctgggttcaagtgattctcctgcctcaggctactgagtcgttgagattacaggcgcataccaccacgctgggctaattttgtatttttagtagagacggggcttctccatgttggccagtctggtcttgagctaccgacctcaggtaatctgcctgcctcggcctcccaaagtgctgggattacaggcatgcgccgccacgcccaaccaatcccattctttttcatgggtccatagtattccatagtgtatatgctccaccctttctttatccagtctacatggcgtcctgttgaggaatggatgtaacaggcgtcgtgttcaggaatggatgtaacaatgtgcataaaagcagtgaatgttttctattggaatggcgtttgcctttctgggaaactgtggagtcattcgaattgcaatttcctggtagatttgattagctaagagcattgggaatttttggggtgcgtgatgccctgttgcagatattttttcacagtgtagaaatctcagcatgaatatgtctgttttcttttctctttttttttttttttttgcgatggagttttgctcttgttgcccaggctagagtgcaatggctgaatctgggctcactgcagccatcatctcctgggttcaagcaattctcctgcctcagcctctggagtagctgggattgtaagtgcctgcccctacaccctgatttttctttttttttgtatttttagtagagacggggtttcacctgttgggcaggctggtttcgaactcctggcctcaagtgatccacctgcctcagcctcccaaagtgctcggatgacaggtgtcagccacggtgcctggccgtctgttttcttttcataagaggtgctggactcacagtggctctgtgctgtgatgaaatgacattgccaaagttttactcctcacagcttgattttgtatgctaaacaggtcttctttggcgtgattgaggagggatggggagacttaagggagccatgtatttagaaagcgattagatcctgttatgtcttggtaattactgcagttacaacacgccattctttccgtggctcacctagctgggttcgtggctagtcatggaggcgccctgaagagcctcattttcccacagctgtaggaagtgtgtggtacacccacaatgtcttagcttttgtattagggaacgtcttcagtttgttcccttggccacatgctttgggaatgtcttcagtgtgtacacggtggctgtccctgggccgcatgcttagggaacgtcttcagtgaggtcccttggccatatgcctagggaacgtcttcggtgccatcctgtgactgcattcttagggaacgtcttcagtgtgtacatggcgggggtcccttagccccattcttagggaatgtcttaagtatttacacagtggcagtctgttggcctatggttagggaacatcttcattgtgcacatggtatcagtcccttgcgccacatgcttagggaattcttcagtgtgtacatggtggccgttccttggctgcattgttacagaacgtcttcagtgtgtacatgtcagcggtcccttagccgtaagcttagggaacgtcttcagtgtgtataaggtggcggtcccttggccacatgcctagggaacgtcttcagtgccctcccttggctgcattcttagggaacgtcttcagtgtgtacatggctgccttcccttagccacatacttagggaacatcttcagtgtgcacacggcagctgtcccctggacgcattcttagggagcgtcttcagtgcgaacatggcgggggtcccttacccacattcttagggaacatcttcagtgtgcacacggcagcagtcccctggacgcattcttagggagcgtcttcagtgcgaacatggcggcggtcccttacccacattcttagggaacatcttcagtgtgtatatggtagcagtcccttagccacacacttagggaacgtcttcagtgtgtgcacatcagcggcccttggccggattgctagggaacctcttcagtgtgtacatggcagcggtcccttaacccaagcttagggatcgtcttcaatgtgcaaagggcaatggtcccttgggccacgtgcttagggaatgtcttaagtgtgtacacggcggtcccttagccacatgcctaggaaacgtctgccatctcttcgctgcattcttagggagcgtcttcagtgcgtacatggcggccgtcccttagccacgtacttagggaacatcttcagtgtgtacatggcggtggtcccttagccacatacttagggaacgtctccagtgtgtacaggtggccgtctcttagccatattcttagcgaatgtcttcagtgtgtacacagcagtggtcctttggccacatgctttccgaacgtcttcagtgcatacagtggcagtcccttggacccattcttagaaaacgtcttcagttcgtactcggtggcgatcccttggccacattcttctgcgtgtctgtgtctgtgtccttttcaccctgtaagctgcttttttttcttcattgggtgtctctgactctcatgtggaatccctttcctctgtcaccgcctgtcccaggcacagtgagagacgcagccagcctgctcctctctgcacgtcaccatcccagacattctccagccagcgtcctgaccgcattcattccttctctttcccttgtccacatccttcttcccctacacgcttgataccaagaaatggtctgaatcacagccaaggcttcctttgctttctggaattgcagctccccacccccacccagatcagaggttgagaacctgaatcttcggatttctggagatgcccccatcgcatcagagacctctagtgtgtttctttatatccgtgtagacttgggaggatgacaggagagcaaccttagaaggtggcctgtgcagttccagagcccagggtggaaggggcttccattcatcactgccttcgtgcacctttcattcttgatccaaccgttgttgttgttgttttgagacggagtcttgctgtgtcgcccaggccggagtgcagtggtgtgatctcaggtcactgcaacctccgcctcccatgttcaagcgattctcctgccacagcctctctgagtagggagctgctaaaataaaataccttcagttgggtaatttataaactagagacatttatcactcacagttctgaaggctggaggttcaagatcatggcagattcagtgtgtggtggggatgcactccctggttcatagacgacgcattttctctgcctgctcacatggtggaaagggcgagggagctctctggggctccttttataaggacagtgatcctattcatgaggcttgatccccatgaagtcatcacctcccaagtctcccacctcctgacaccattgtcttaggggtgaggatttcaatgcaggaatttgggggaggaacacaaactttcagattgtagcaaataccattctttaaaaaaatgcagtaatagttaagctttttttttttaatttgataaattttccaagaaggaggagacacagaaaccctccgtgttttgaaggttaatattagtgctgtaaaatacacgtgggacttgggcttataaaaaattcctggtcatggcaaaatataggtggtttgcagtacctggggaagcccacctttcctgtttctgacatgtaacttttgtggaaattgcctgaaagttgtttctagttacccttcagtcctgtgtccaacccagcatgtccgatactatctaacattgttttttttttgagatggagttttgctcttgttgcccaggctgcagtacagtggcacgatcttggctcgctgcaacctccacctcccaggttcaagcgattctcctgtctcagcctcctgagtagctgggattactaaattttatataaatgttgtgtcaagaaatattattgctcttttgcctttttttcccttaaccgttgagaaattcagaaaaaaacatttatgaacgtcaacactgtttttgacaagtaaacattgttcttggcaagtgggccttccaaaaataagggctggcgtttgtggaaactgctctactgttctttttttttcttgctacttttttctttttttttttttttgaggcactaattggaatccacttattcgtcctgggtggagaaagagttcagatctaacactgggggctctgtgtttccttaggtaatacatatgaagtttttgtcactgtaattcagtaatctgtgttaatattatcacaaaagagcagagtggcatttgtgtcttctcagaattgcttattaaaacagctgcatggccagccgcggtggctctcatgcctgtgatcccagcactttgggaggccgaggccggtggatcgcttgagcccaggagtttgagaccagcctgggtaacatggccaaacctcatctctactaaaaatacaaaaagtgagagcgtgcctgtagtcccagctactgaggaggcagaggtgggaggatcacttgagcgtgggagttggaggctgcagtgagctgtgatcacagcctgggaaaccaagcgagagatgctgtgtctaaaattataaaaataaaaattagccaaacatggtgccacgcgtgtgtggtcacagctacctgggtggctgaggtgggaggatcactggagcccacaaagtcgaggctgcagtgagctgagattgcatcactgtcgtgcagcctgggcaccagagtgagagacaccctgtctctaaataaataaataagttcatgattaagcagaagttgtgcttgttctgccgggatttcagttgggttctttgtgccctaatttacgtgagctagtaggttgtgcgttatcttagagggcttgcatgaaagaaagagggtagcctttcttttccctgttttggtagcattgctgaggtggcttttggctgacgggtggacccgtgggtgcagatgttttgatgcagaaggaacgattgccttttcacattcaggctccaactggcttttagcttgtgcgttcttaccctggggtgttcgaggtcaccggactcctattttatttgtgtttaactggaaaggcaggaactctgagaacgtatcaaatagccagtttactgcaggctttctagaatttaaatcgcttccaaaactggatccacaagctaggaattatgtttaagttttaaaaggtgttggtttgcttcttacatgtctaaattcttgggggaaaaactgcaaagaataataaagtttcatgattcaaaaatggtatgaggccgggcacaatggctcacacctgtcatcccagcactttgggaggctgaggcaggaggatgatttttgagaccaggagtttgagatcagcctgggcaaacagcgagatcctgtgcctacaaaaataaaataaaaataggctgggtgtggtggctcatgcttgtaatacctgcactttgggaggctaagtcagtaggatcacttgaactcaggggtttgagaccagcctggtcaacataatgagaccttgtctctagtaacaataaaaaaattagctggacataaggtgtgcatttgtagtcccagttacacaggaggctgaggtgggaggatcacttgagcctgggagttggaggctgctgtgaaacgtgatcgcaccactgcactccagcctgtgcaacaaggagagagatgctgtctctaaaaaaaaaaaaaaaagccagacgtggtggcacacgtgtgtggtcacagctacttgggaggctgaggctgaaggatcgcttgagcccaaggaggctgaggctgccataagctacgatcatgccactgcactccaggctgggcaatagcctgggcgactgtctcaaccaaaataaatttaaaaagataggaaatttcaatgtgaaaatcagtgtcccccagaacgttccatttcttcccagctgggctatttttggagttccatggggagccggctcagtgcaccttgcatgtactcaggaggatgagccctgccatggtgtgtgttaggggacagcctgatctcaccaaccctcctgagcaggcccggccctccgagtaataactgggaacactcgccgctttgtgagaggacctcgtgtgctcactggaaggtcatctcttctggtccacgctgcagtgtggatactttttttgtttgtttgtttgtttgagaaggattattgctctttttgcccaggctggagtgcaatggcatgatctcggctcactgcaacctccacctcctgggttcaagccattcttctgtctcaacctcctgagtagctgggattacagtcgcccgccaccacacccggctaatttttgtatttttagtagagacagggtttcagcatattggccttgctgttctcaaactcctgacctcaggtgatccacctgcctcagcctcccaaagtgctgggatgacaggcgtgagccaccgcgcccggcccagtgtagatacaccttgagcacataactggaatcctttccttgacaacttggagccccttggaacatagtcatataaactgtattgaattaagaggagacaccgttaaatatgtcatagctgtcctcaaaactgggtcttgttttgctttctgcctggaaatgggagtcacttttatagaaaatttattgttcgttaacaaaaaataattgtgtgtgtgtgtatatatatattgtatgtgtgtgtatatatatatatatatatatatatatatacacacagacacacattctctctctctctctctctatggtacaatatgatgttttaatccaagtacacattgtgcagtgattaaaccaagctagttaccatattagcaatgaagctaattaacattaataattaagtgaattaacatattaaccattgacctaattaacatattaacaatcaagctaattaacatattaacaagctaatttacatattcagataaccctaactctaacctatatcacctcacttcgtttttttggtgatgagaatatgtaaaatctagttttagtcattttgaaagatgcaatgtattattattaactataatcactgtgtggtatgatagaactttgaatttatttcttttatgtaactgaaaaaatttaattttaatgtaatttatgtttttgagacagtctcaccctctatcacccaggctggagtgcagcgtcatgttcatagctcatggcagcctccaactcctggcacaggtgaccctcccacctgagcctcccaggtagctgggactacaggtgcacaccaccacacctggttaatttttaaagttttgtagagatggggtcttgctatgttgctcaggctggtcttgaattcctgggcagaagtgatccttctgcctcagcctcccaagtagctgggactgcaggtgcatgccaccatatctagctaattttttcatttttttttatttttagagatggggtttcattatgttgcccaggcttctctcaaactcctggccttctgtgatcctccttcctcagccttccatagcattgtgattccagacatgagccaccgctcctggcctccaactgaaatgttatgttctttgccaaacacttcatgaagcattcttccctggcaaccaccattgcactctctgcgtttatgcgttcagcttttttagattctacctatgagatgatacgatatttgtctctctgtgcctggttcatttcacttcacattgtatctttcagtcccacccatgttgctgcaaatggtaggatttcctttttcatggctgcataccattccattgtgtgtctatgccacattcgcttgatgcacttatctgttgattgaacatgggttgattctatatcttggaaactattagtagtgctgcagtgcacagggggtgcaggtatgccattgatgggcagatttcctttcctttgggtacacaccgagcggtgggatgactggatcctgcacaacattctttgctctgatgttttgcaggccaatggctggaccttagggaacgtcttcactttgtacaaggtgggggtcccttggccacattcttagggaacgtctgcagtgtgtacacgatgttggtctcttgaccacatgcttaggaaacatcttcagtgtgtagctggcagcagtcccttagccacattcttcccgaatgtcttcagtgtgtacacggtggcagtccctagtcctaattcttcgggaatgtctttagtgtgtacatggcggcagtcccttggccgcattcttagggaacgtcttcagtgtgcacactgcggtggtcccttagccacaagcttagggaatgtcttcagtttgtacttggtggcggtcccttggctacatgcttacggaacatattccctgccgtctcttggctgctttcttagggaacgtcttcagtgtgtacatggtggtggtcccttagccacaagcttagggaacgtcttcagtgtgcacaccgtggctgtcccttgggccacatgcttagggaacgtcttcagtgtgtacatggtggcagtcccttggccacattcttagggaacgtcttcagtgtgtacagggcggcagtcctttaaccacatgcttaggggaaccatcttcagcatgtccacggtggcggttcttttgcggcattcttaggggatgtcttcagtgtgtacatggcggctgtcccttagccacaggcttagggaacgtcttcagtgtttacatggtggcggtcccttggccacatgcctagggaatgtcttgagtgctgtcccttggctgcatcttagggaatgtcttcagtgtgtaaatggtagcagtcccttagccacatgcttagggaacgtcttcagtgtgcacacagcagaggtcccttgcgccacatacttagggaacgtcttcagtgtgtacatggtggtggtcccttggccacatccttagggaacatcttcagtttctacacagtggccatcccgctgccacattcttagggaacgtcttcagtgcctacatggtggtggtcccttggccacattcttagggatcatcttcagtgtggacccttggccacattcttagaaaacgtcttcagttcatacatggggacgatcccttggccactttcttctgagtgtctgtgtcatttgctccctgtaagctgcttttatttcttcattgggtgtctctatcatgtggaatcccactcatctgtcaccacccatcccaggcacagtgagagacacagccagcctgctcctctctgcacgtggccatctcagacattctccagccactgtcctgaccccattcattccttctcctgcacggtccacatccttctttccctacacccttgctaccaagaaatggtctgaatcacagccaaagtttcatttgctttctggaacagcagctccccagccgcactcagatcagagattcagaacctgaatcttcggatttctggagatgcccccatcccatcagagacttctagtgtgtttctttatattcgtgtagacttgggaggatgacaggagagaaaccttagaaggtggcctgtgcagttccagggcccagggtggaaggggcttgcatccctggctgcctttgtgcacctttcattcttcatccagctgttttttttttttttttttgaagaggagtcttgctgtgtcccccaggctggagtgcagtgctgtgatgtcagctcactgcaacctccgcctcctgtgttcaagccattctcctgccacagcctcccgagtagctgggattacaggcacctgccaccacacatggctaatctttgtatttttagtagagatggggtttcatcatgttggccaggctggtcttgaactcctgacctcaggtgatccacctgcctcagcctcccaaagttctgggataacaggcatgagccactgcgcccggccgcacccttcattcttgattcacctggttacaaactcgcagataaactgtttctacctgtgacaaatgagtcatccatcttccatgtggtgtcgactttgtccctgttataatattcctgtctcttgttctggtttttggcgtcccgcacattgtccctgttacagtcgtgtctcttgtttctggggtcacccctgtggtgagttgactgtgccctgttcctgaggctggtgaggatgctgtggacaccttaatcacggctgtgaacaaactggctaaagctaggcaccatggagctttgcagtggatgctaagtcgtggtacccattctttgatcagtgacggagccaggtgtcttattaagtctcggggatttgtggaagcccagagcaggcatgcaccttctacattgaaaggaatccttttgacactcaacgttggtgtcgtgaagtcctgcctctggaaatccctgatttcctaagacactaatctaacattttaaaagagttaaaaaaaaatcagtaaaatgttccccatagaagcatgcagtgttttgtgtgtgctttttattgttttttttttttttttttttgagacgaagttttgttcttgtcgccaaggctggagtgcagtagcacaatctcggctcactgcaacctccgtctccagggttcacgggattctcccgcatcagcctgtcacgtagctgggattataggtgtgtgccaccatgcccgactaattttgtatttttagtagtgacagggtttcatcatgttggtcagggtggtctcgaactcctggcctcaagtgatccacccgccttgccctcccaaagtgctgggattaggaatcactgctcccggcctacttgtttttacttttatttcaggttgaggggcacatgcgcaggttcgttacacgggtaaattgcatgtcctgggggtttagtgtagagattatttcatcaaccaggtaataagcctactaccacctgataggtaatttttcaatcctctcgtttgtcccaccctccaccttccagcaggccccggagtctgatcccttctttatatccacgggtacccaatgcttacctaccacttatcagtgagaacaggaggtattttgtcttctgttgctgtgtaagtttgctaaggataatggcctccacctccatgcaggttcctgcaaaggacatcatcccgtttttttttttttgagatggggtttccctcttgttgcccaggctggagttcaattgtgtgatcttgactcaccgcaacctctggctcccgggttccagtgattctcctgccttagccttctgagtagctgagattacaggtgcatgccaccacgcccagctaattttgtgtttttagtagagacagggtttctccatgttggacaggctggtcttgaactccggacctcaggtaatccacccgcctcggcctcccaaatttctgagattacaggcgtgagccaccacgcccaaccaatcccattctttttcatgggtgcatagtattccatagtgtatatgctcccacctttctttatccagtctacatgacgtcgttttgaggtatggatgaaatgatttgcataaaaacagtgaatgctttctattagaatggtgttggcctttctgggaaaccgtggagtcattccaattgcaatttcctagtagatttgattggttaatagaattgggaatttttggggtgcctgatgcacactattggagatcttttttcacagtgtagaaatctcaacatgaatatgtctttttttttttttgagacggagtttctctcttgttgcccaggccggagtgcaatagctcaatctcggctcactgcagccaacatctcccgggttgaagcaattctcctgcctcagcctcctgagtagctgggattacaggtgcctgccaccacacctggctaatttttgtatttttagtagacacagcgtttcagcatattggtcaggctggtctggaactcctgacctcaggtgatccacccgcctcagcctcccaaagtgctgggatgacaggcgtgagtcacagcgcccggcccagtgtggatacaccttgagcacataactggaatcctttccttggaaacttggaaccccttgtgtcatggtcatataaactgtgttgaattaagaggagacactgttaaatatatcacagctgtcctcgaaactgggacttgttttgctttctgcctggaaatgcaagtcatttttatagaaaatttatttttcgttaacaaaaaataattgtatacatatatatggtacaatgtaatgttttaatccaagtacacattgtgcaatgattaaatcaagctagttaccatattaacaataaagttaattaacatattaaaataaagctaataacgtattaaccaagctaattaacatattaacaatcaagctaattaacatattcacataatcctaactctgacctatatcacctcacctagttttttttgtggggagaatatgtcaaatctacttttagtcattgtgaaagacgcgatgtattattaactatcatcactgtggtgtgatagatcttggaatttatttgttttatctaactgaaaaaaattaattttaatgtaatttatgtattttttgagacagtctcaccctatagccaggctggagtacagcatcatgttcatagctctcggcagcctccaagtcatggctcaggtgaccctcccacctcagcctcccaggtagctgggagtacaggtgcacaccaccacacctggttaatttttaaattttttgtagagatggtgtcttgctatgttgctcaggctggtcttgaattcctgggctgaagcgatcctcctgcctcagcctcccatgtagctgggagtacaggtgcatgccaccatacccagctaattttttgttttttttttttagagatggggtttcattctgttgcccaggcttatctcaaactcctggcctcaagtgatcctccttcctcagccttccatagcattgtgattccagacatgagccaccgcttttggccagcaactgaaattttgtgttctttgacaaacacttcagcattctttgctggcaacaaccattgtaccctctgcatttatgtgttcagcttttttatattctacatatgcgatgatatggtatttgtctctctgtgcctgtttcatttcacttcaccttgtatcttccagtcccatccatgttgctgcaaatgacaggatttcctttttcatggctccatactattccagtgtgtgtctatgccacatttgtttgatgcactcatctgttgattgacacatgggtttattccgtctcttggaaactgagtagtgctgcagtgcacagtggggcaggtatcccattgatgggtacacacccagtggtgggatgactagatcctgtacaccattctttcctctgatgtttcgcaggcccatgactggacctttggaacgtcttcactgtgtacaaggtggtggtcccttggccacattcttagggaacgtcttcaatgtgtacatgacggccgtcccttggccacatgctcagggaacatattcagtgtgtacttggcagtggtcccttagccacattattagggaatgtcttccgcgcgtacacagtggcagtccgttggccgcatgcgtagggaacgtcatcagtgcggtccattggccacatgcttagggaacatcttcagtgtgtacatggtggtctcttggccacattcttcgggaacgtcttcactgtgtacatggcggaggtcccttgggcgcatggttagggaacgtcttcagtgtgtacatggcggaggtcccttatccacattcgtagggaatgtcttcaatgtgtacacggtggcagtcccttggctacatgcttagggaacatcttcagtgcggtcccttgaccacatgcctagggaacgtcttcagtgccgtcccttggctgcattcttagggaacgtcttcagtgtgtacatggtggtggtcccttagccacctgcttagggaacgtcttcaatgtgcacatggcagcagtcccttggccacattttttgggaacatcttcagtgtgtacatggcggcggtcccttagccacattcttagggaatgtcttcagtgtgtacacggcggcagtcccttggccgtatgcttagtgaacgtcttcagtgagtacatggcggcgatcccttagtcacctgcttagtgaacatcttcagtgtgtatatggcggcagtcccttaaccacatacttagggaacgtcttcagtgtgtacatggcagtggtgccttagccacatacttagggaatgtcttcaatgtgtacatggcagtggtttcttagccacatgcctagggaacgtcttcagtgttgtcttttagttgcattcttagggagcgtcttcagtgtgtacacggcagcagtcccttggccgcattcttagggaaccttttcagttcatacacagtggcggtcccttggcaacattcttctgagtgtcagtgtctgtctgtgtccttttcaccctgtaagctgcttttgtttcttcactgggtgtctctgactctcatgtggaatcccatttctctgtcaccgcctgtcccaggcacagtgagagacgcagccagcctgctcctctctgcacgtggccgtctcagacattctccagccaccgtcctgaccgaattcattccttcccctgccccgtccacattcttcttcccctacacgcttgctaccaagaaatggtctgaatcacagccaaggcttcatttgctttctggaactgcagctcccagccccacccagatcagaggttcagaacctgaatcttcggatttctggagatgcccccatcctatcagaggcttctagtgtgtttctttatattcgtgtagacttgggaggatgacaggaaagaaacctttgaaggtggcctgtgcagttccagggcccagggtggaaggggcttgcatccctggctgcctttgtgcacctttcattcttgatgcaacttttttttttttttttttaaagatggagtcttgctgtattgcccaggctggagtgcagtgctgtgatctcagctcactgcaccctccgcctcccgggttcaagcgattctcctgccacagcctcctgagtagggagctgctaaaataaaataccttcagttgggtaatttataaactacagacatttgtcactcacagttctaaaggttggaggtttaagatcgtggcggattcagtgtctggtggggacccacttcctggttcatagatgatgcattttctctgcgtggaaggggcgagggagctctctggggtcccttttataaggacactgatcccattcatgaggctcgatccccatgatctcatcacctcccaagtctcccacctcctgactccattgtcttaggggtgaggatttcaatgcaggaatttgggggaggaatacaaactttcagactatatatagcaaataccattctttaaaaacatacagtaatagttaagctttttttttttttaatttgataaattttccaagaaggaggagacacagaaaccctccttgctttgaaggtgaatgttagtgctgtaaaatatacgtgggacttgggcttataaaatcttggtcacggtaaaatataggtggtacgcagaacctgggaaagcccacctttcctttttctgacatgtaacttttgtggaaattgcctaaaattgtttatagttagctcttcagtcctgtgtccaacccagcatgtccgatactatctaacattctttttttttgagacagagttttgctcttgttgccaagcctggagtacagtgacgcgatcttggctcgctgcaaccttcacctcccgggttcgagcgattctcctgtctcagcctcctgagtagtttggattactaaattttatataaatgttgtgtcaagaaataatattgctcttttgactttttttccctaagcattgagaaattcagaaaaaacatttataaacataaacactgttcttgacaagtgggccttccaaaaataagggctggagtttgttgaaactgctctactgtgttttatttatttatttatttattggtacttttttccttttttttttgaggcactaattggaatgcacttatttgtcctgggtggagaaacaattcagatctaacactgggggctctgtgtttccttaggtaacgcatgtgaggttttcgtcagtgtaattcggtaatctgtgttagtattattacaaaagagcaggggggcatttgtgtcttctcagaattgcttattaaaacagctgcatggccaggcgtggtggctcacgcccgtaatcccagcactttaggccggtggatcgcttgagtacaggagattgagaccagcctgggcaacatggccaaactccatctctactaaaaatagaaaaaattagtatgtgcttatattcccagctactcaggaggcagaggtgggaggatcacttgagtgtgggagttggaggctgcagtgagctgtgaccacagcctgggcaaccaagcgagaggtgctgtgtctaaaaatacaaacataaaaattagccaaatgtggtggcacgcgtgtgtggtcacagctacttgggaggctgaggctgaaggatcgcctgagcccaaggaggttgaggctgcagtgagctagcatcatgccactgcactccaggttgggcaatcgcctgggtgtgaccctgtctcaaccacaataaatttaaaaagataggaaatttcaatatgaaaatcagtgtcccccagaatgttccatttcttcccagctgggctatttttggagttctatggggagctgtctcagtgcaccttgcatgtactcaggaggatgagccctgccatggtgtgtgttaggggacagcctgatctcaccaaccctcctgagcaggcccggccctccgagtaataactgggaacactcgccgctttgtgagatgacctcgtgtgatcatttgaaggtcgtctcttctggtcagggtgcagagtggacacatttttttttttttttgagacagagttttactcttgttgcccaggctggagtgcagtggtgcgatcttagctcactgcaacctccacctcctgggttcaagccattctcctgtctcagcctcctgagtagctggcattacaggcgcccgccaccacacccagctaatttttgtatttttagtagagatggggtttcagcatattggtcaggccagtctggaactcctgacctcaggtgatccacccgcctcagcctcccaaagtgctgggatgacaggcgtgagccaccgcgcccggcccagtgtggatacaccttgagcacataactggaatcctttccttggaaacttggaaccccttgtgtcatggtcgtgtaaactgtgttgaattaagaagagacaccattaaatatgtcacagctgtcctcaaaactgggacttgttttgctttctgcctggaaatgcgagtcatttttatagaaaatgtattgttcattaacaaaaaataatcgtatacatatatatgaggtacgtgatgttttaatccaagtacacattgtgcggtgattaaatcaagctagatactatattaacaatcaagtcaattaacatattaataatcaagctaataaacacattaacaatcaagctaattaacatattaacaagctaattaacatattcacataaccttaactctaacctatatcacctcacctacttttttttgtggtcagaatatgtaaaatctacttttagtcattttgaaagatgcgatgtattattaactatgatcactgtggtgtgatagatctttgaatttatttcttttatgtaactgaaaaaatttaattttaatgtaatttatatttttttgagacagtctcaccctatcacccacggtggagtgcagcgtcatgttcatagctcactgcagcctccaactcctggctcaggtgaccctcctgagcctcccaggtagctgggactacaggtgcacaccaccacacctggttaatttttaaattttttatgtagatgggatcttgctatgttgctcaggctggtcttgaattcctgggctgaagtgatcctcctgcctcagcctcccaagtagctgggactacaggtgcatgccaccatacccagctaatttttttgtttttgttttttttttagagatggggtttcattacgttgcccaggcttgtctcaaacttctggccttcagtggtcctccttcctcagccttccatagcattgtgattccggacataagccaccgctcctggcctccaactgaaatgttatgttctttgacaaacacttcatgaagcattcttccctggcaaccaccattgcactctctgcttttatgcattcagcttttttagattctacatacgagatgatatggtattctctctgtgcctggtttatttcacttcacattgtattttccagtcccatccatgttgttgcaaatggcaggatttcctttttcatggctgcatactattccactgtgtgtctatgccacatttgcttgaggcactcatgtgttgattgacacatgggttgattctatatcttggaaactgtgagtagtgctgcagtgcacagggggtgcaggtatcccgttgatgggctgatttcctttcctttgggtacacaccttatggtggaataactggatcctgcacatcattctttcctgtgatgtttcacaggcccatgactgaaccttggggaatgtctttactgtgtacaaggtggcggtcccttggtcatattctttggaaacatcttcagtgtgtatacggcgttggtcccttggtcacatgcttgggaacatcttcagtgtgtacatggcagcagtcccttagccacattcttagtgaatgtcttcagtgtgtacacggtggcagtcccttggctgcatgcttagggaacgtcttcagtggtgttccttggccacattcttagggaatatcttcagtgtgtacacggtttgtgtacagggcggtggtcccttagccacaagcttagggaacgtcttcagtgctgttccttggccacattcttagggaatatcttcagtgtgtacacggtttgtgtacagggcggtggtcccttagccacatgcttagggaatgtcttcagtgtgtacccgtggcggtcccttggcctcatgcctagggaatgtcttcagtgccgtcccttggctgcattcttagggaatgtctttagtgcgtacatggcttcagtgcgtacatggcggcggcccctcagccacatacatagctaacatgttcagtgtgtacactgcaacggtcccttggccccattctttgggaacatcttccttgcggtcccttggctgctttcttagggaatgtcttcagtgcctacacagtggcagtcccttgtccacattcttagggaacgtcttcttctgtacatggtgtcgatcccttggccacattcttagggaacatcttcagtgagtacatggcggtggtcccttggccacatttttagggaacttcttcagtgtgtacatggctaccgtcccttagcccatgcttagggaatgtcttcagtgtgtacatggaggtggtcccttggccgcattcttagggaccgtcttcagtgtgtacatggcggtggtctcttggccgcattgttagggaccatcttcagtgtgtacatggcggtggtcccttagccacaagcctcgagaccgtcttcagtgtgtacacagctgtcgtcccttgggccacatgcttagggaacgtctgcagtgtgtacacggtggcggtcccttggccacattcttagggaacgtcttcagtgaggtcccttggccacatgcttagggaatgtcttcagtgcctacacagcggcagtcccctgtccacattcttagggaacgtcttcagtttgtacatggtgtgggtcccttggccacattcttagggaacatttttagtgtgtacatggcggcagtcccttagccacattcttagggaatgtctttagtgtgtacatggtggtagtcccttggccgcacacttctggaacgtcttcagtgcggtccctttgccacgttcttcgggaacatcttcagtgtgtacatgatggcggtcccttagccacaaacttagggaatgtctttagtgaatacacagcagcggtcccttggctgcattcttagggaacgtcttcagtgcggtcccttgaccacattcttaggaaatgtgttcagtgtgtacatggcgtcggtcccttggccacattcttagggaacatcttcagtgtgtacatggcggagtcccttagccacatgcttagggaacgtcctcagtgtgtacacggtggcagtcccttggccacatgcctagagaacatcttcagtgctgttcctttgctgcattcttagggaatgttttcagtgtgtacacggtggcagtcccttggctgcatgcttagggaacgtcttcagggtggtcccttggccacattgttagggaacatcttcagtgtgtacatggcggtggtcccttggccgcattcttagggaacctcttccttgtgtacagggcagcggtcccttggccgcattcttagggaaagtcttcagtgtgcccacggcagcggtcccttgggggtgaggatttcaacgcaggaatttgggggaggaacacaaactttcagatagtagcaaataccattctttaaaaaaatacagtaatggttaagcttttttttttcttgattgataaattttccaagaaggaggagtcaaagaaacgctccttgttttgaaggtgaaggttagtgctgtgaaatacacataggacgtgggcttatataaaaatcctggtcacggcaaaatataggtggtacgcagttcctgggaaagcccacctttcctttttctgacatgcaactttttcggaaattgcctaaaagttgtttatagttagcccttttcggccctgtgtccaacccagcgtgtccggtactatctaatgttctttgtttttgagacggaattccactcttgttgcccaggctggagtgcagtggtgcgatcttggctcactgtaacctctacctcctgggttcaagcaattcccccgcctcagcctcctgagtagctgggattaccggtgtccgccaccaggcccagctaatttttgtatttttagtagagacggggtttctccatgttggccaggctggtctcgaactcctgacctcaggtgatctgcccgcctcggcctcccaaagtgctgggattacaggtgtgagctactccgcccagcctaattttttattatttttaatttttaacattttttttttggagactgggtcttgctgtgtcccacaggctagagtgcagtggcatgatcatggctcactgcagctttgacctcctggactcaagccatgctcccacctcagcctcatgatagctgggactccaggtgtgtgccatcatgcccaggcaagtttttaaaaaaattatttgtagagatggcgtctcactatgtttcccaggttcgtctggaactctgggcctcaatggatcttcccacctgggcctcccagagtgctgggattacaggcatggggcacagtgcccagtccctcatgtgtgtaattgttcaacagctagagaaacccaaacacataccctcagacactgtcccgtctgccgcccaggtctcctcacctgcatggtttgctgttgccacttgatttaatggagggcataatgaatgacccttaaacacggcctctaagagtcctcgtaagtgccttcctcattaaaattcaagaggaatcaaatacctgttactgaatataaatgtttagaggagaaagcctgtgagctgagagtcatatcttaaggggtgtgtgcttgcagaattatcacattttcaatttcatgtgtgaataaattgttgtatttgggatcaccaagaaggcagaaacatgtatcaatgaaatttagtagacggctaaaaacaaacagtagcagcctactgaggggctgtggaataagcagattttagatttttagagggaaaacggtgatggtaggttatttccccaatggcttccaggcctccaactcaggcttggaattggccatggtcattggccctttttttttttttttttctttttgagacggagtctcgctctgtcgcccaggctggagtgcagggtgtgatctcagctcactgcaagctccacctcccgggttcacgccattctcctgcctcagcctcccgagtagctgggactacaggcttccgccaccacacccggctaattttttgtatttttagtagagatggggtttcactgtgttggccaggatggtctcgatatcctgacctcgtgatctgcccgcctcggcctcccaaagtgctgggattacaggcgtgagctaccgtgcccggcccattggctcttttttttaccatctcatcttctctcacacgagttattctcactgttggaaagaacttgtccttaaagcattgcttccaggtgagtgtaacggtgcccagcatgtgatacaagttaaaaataagagcagagcccaaatgctgtcattgcttgatccatcatttcccctgtcatgcagctcatttgagtaacagggtctcgtttcggggtgctgtgtccggagaggcagaactccccttggagaatgggtagagaatgtacatcacttgccaagtatggtggttttgcatgctgccttgactggacttgtttgcctttggttttctgtaagaatcttaggatatctgcccaggagttagacccctgggctaaagtaaggttgagggccagccacggtggctggtgcctgtaatccctggactttcggaggctgatgtgggaaaatcacttgagtccaggagtttaagaggagcatgggcaacgcagtgagacccccgtctatataaaatttaaaaaaaattagctggacatggtggtgtgcatctgctcccagctactttggaggctgaggtgggaggatcactggagcccaggaggtggaggctgcagtgagccatgatcacaccactgcactacagcttgggtgacagagccagaccctgtctctacgaaacacaaataaaaagtaaaatgaggttgagaaactccgcctccctcttgatttcaaggtaatactcagcttctagattgacacacacacaagtcattgtcttatcatagtgacatgtgacggaacacgcacgtgtctggtgacagatggtgcattgaggggaacattccttaagctgtgtttccttggggaaagaggcaatagcattctctgttagtacagaacccttcagtttgtacaaatgtcttcggaaagggaatattcctgagagcttctacgtggcagttaacaagtcacacttttcatctcagatgtctcaatttccagaagatggtacttgattacatttcctggggttcttgtttctaggaaatcgcggctgggtttttctagaaataatgcagtgatttggggacctgtggcactgggaagggtatgatctcaggcacaggactgcaaagacacgttgtttaccggccagcatgataactaggcgtgacgctgatggccagtgtgttgcatacgtactgggctttattatccatacctggatggaactgaatatatatatatacacacacacatagacacccataatatattatacaatgtaattatatatcatcatatatcatatatattataatatatacagttgacctttgaacaacacaggtgtaaactccataggtccatttatatgtggattttctgccacctctgccacccccgagacagcaagaacaaccctttttgttcctcctcctcctcctcagcttcttcagcatggagacgatgaggatggagacctttaggatgatccacttccactcgatgagtagtacatatgttttctcttccttaagattttcttaatagcattttcttttctctagcttactttactgtaagaatgcagtatataatacatagaaacacaaaataaatacaaacatgtgttgagaatgtagtatataatatatataaatacaaaatacatgttgattgacagtggcatgatctcagctcactgcaacctctgccttctgggttcaagcaattcttctgcctcagcctcccaaatagctgggcctacaggcgcacgccaccacacccagctaattttttttgtatttttagtaaagacggagtttcaccatgttggccaggctggtcttgaactcctgacctcgtgatccacctgcctcagcctcccaaagtgctgagattacaggcgtcaaccactgtgcccagccgtgtgagtctttatggtagaacaatttatattcctctgggtgtgtacccaataatgagattttcagtagactttgagtgaagccgatagctgttcataatgtgggtgggccttgcctaatcagtggaaggtcttaagaggtaaaaagagtccctcctccaaggaagagggaattctatctggaatccaccttcagacttgagctgcgacatcatgtctccatgggcatctggcctgctggtctaccctgcacattttggttttgcccctcccccacatcttgggagccagttctttaaaatctctttctctctatatatatatcctactggttgtttctctgcagaactgtcactcatgcagatctgtgtccacagatgacatcattgcaaagccactaagagagacatagcatccagggaatggaaggaccaggttcctttcagacttgaagacacgtcaaaacacattccaccgcgttgccttggagaacccagggaccaggcctcttcccctcctgtcaaatagtccttagcctttgttcttcttgctccttgtgaatttcacaggcttccttgactttgaattctgctccttggatgtctttgttggtgaacgtgatgagatagaattttggaaagctccgaggtgtgatcattgcaccctgggactgacacgtgctccgtcttcactgaagacagccggaagccgtggtgttccagaacttgaatgtggctgtggaaactagagtgtccatgcatcctgggcggtagctactggtgccgtctgcgtcgtctgtagctcctcattgctgattctcattcggctgcctcagtcaggacagggctggttacagcgttgctcttcatgctgttcaagtcagggtgatctacagggacagaacgaataggactgatgtgtatatgaaggggagtttactaggataattgactcacacgatcacaaggtgaagtcccacaataggccgtctgcaagctgaggagccaggaagccagtccaaggcccaaaacctcaaaagtaggcaagctgagagtgcggccttcagtctgtggtcgaaggtccaggagcccctggcaaatcactggtgtaggtccaacggtccaaaacccaaagaccctggggtcttgatgttcgagggcaggaagcatccagcatgggagaaagatgaaggctagagatcccgccactgcactccagcctgggtgacagagcgagactccgtttcaaaaaaaaaaagaaagaaagaaaaacatttaaaaagcagaaatgagctggatgcggcatcttctgcttgtaatcccagcattttgggaggccaaggtgggtggattgcttgagcctaggagctcgaaaccagcctgggcaacatacggagaccctgtctctacaaaaaaacacaaaaattatctggccatgctggtgcacacctgtagtcccagctactcaggaggctgagatgggaggtttggttgagcctgggaagttgaggctgcagtgagccatgattgccccactgcactccagcctgggtgaaagagtgagaccttgtctcaaaaaaaagaaaaagaaaaaagaacaaataagaagacagacacacctctcttctttgtgtgggtacagccgttggcaaactttgctgacagatgctactgaccttgttttcctttctgcattctgttcatttcaaaagtgggtaaatcagaagtgggactcactgtgaccttcagtgactcaatgctgaattcacaagattaattggagagtgtgaagaatgcagggcatccgtggacccattttaatgaattttagcatctcttgcatccttgtatccttgcatccagtaccggtccccagccttttagtaactgggctgtgcagcaggaggtgagtagcgtgtgagtgagcaaagcttcatctgtattgacagctgctccccatagctcatattacctcctgagctctgcctcctatgagatcagtggtggcattagagtctcataggagcatgaaccctactgtgaactgaacatgtgagggacctaggtggcgtgctccgtatgaaaatctaatgcctgatgatctgtcactggctctcatcacccgcacgcagatgggaccgtctagttgcaggaaaacaagctcagggcttccactgattctacacgatggtgagtttcataattacttcattctctattacagtgtaataataatagaaataaagtgcatgataaatagaatgcacttcaatcatccccaaaccatcccccaccccacatcagtggaaaaatggtcttccatgaaactggttcctggtgccaaaaagcttgaggaccactggacaaaggaacttgtcagagtatggattgaaggtctttattgatgctttgctgtcactcttactttaagatgaatgcgtatatatatgtatatacattctgtaatgtgtgaatatatgaagctccagctgctctctccctctctttcctctgcagtccaattctcgtagatcagtcttttcctgaaatgaatgacctcttaaattttattttatattttaagcttttatgttattttactttatttttaagctgtttttattttttaagcttttttttttttgagacaaaaaagtctcgctcttgtcacccaggctggagtgcaatggcatgatctgagctcactgcaacctccacctcctgggttcaaaaaattctcctgccccagcctcctgagtagctgggactacaggcgccagccaccacgctgggctaatttttgtgtttttagtagagacagggttttaccatgttggccaggctggtcttgaactcctgacctcatgatccacccacctcggcctctcaaagtgttgggattacaggtgtgagccaccacaactggccagtttgcaggtctttgttgatgctttgctgtcaatcttactttaagacgaatgcatatatatgtatgtgtatacattctgtaatgtgtgaatatatgaagctccacctgctctctccttccctctcctctgcagtccagtactctcctagatcattctgttcctgaaatgaacgaccattttttttttttttattttgagatggagtcttgctctgtcccccaggctggagtgcagtggcgtgatctcggctcaccgcaatgtccgcctcctgggttcaagcgattctcctgcctcaccctcctgaggcaggattacaggcgccagccatctcgcccggctaattttttaatttttagtagagatggggtttcaccatgttagtcaggctggtctcaaacttctgacctcaggtgatcagcccaccttagcctcccaaagtgctgggattacaggcgtgaagccactgcacgtggccggtttgcagtctttattgatgctttgctgtcaatcttactttaagatgaatgcatatatatgtgtgtgtgtgtgtgtgtgtatgcattctgtaatgtgtaactatatgaagctccagctgctctctccctccctctcctctgcagtccaatactcctagatcattctgttcctaaaatgaatgaccattcaggttttttttttttttttctgagatggagtctcgctctgtcacccaggctagagtgcagtggcatgatctcggctcactgcaatgcccacctcccgggttcaagcgattctcctgcctcggcctcccaaagtgctgggattacaggcatgagccaccgcgcccggccagaattcagttttttttttttccccatggttatccaatagcacacaggctcgtgaagccttcaaggtgcttcatctgaggttcgcttagaatggttgccacatattgttctgccggtgagttttcatgaattggactctgaaggttcttaattatggtggttgagtgacacggtctttcttctataagaacctaagttacactgcatatcaggaaaatgtgttcctgggaccagctttgttgggtttttggctgctggtcatcttcactttactctcccaaatttgaggactgtgacacacacacacacacacacacacacacacacacactctctctctctctctctctctctctctgtctctcttaggaaacaatggtatatcaacaatgaaatgatgcttttttttcttcttcttttttttttgagacagggtcttgctctgtcacctaggctggagtgcactgatatgaacatggctcactgcagccttgctctcccaggctcaagcaatcctcccacctcagcctcctgagtagctgggaccacatgggcacaccatcacacctggataatttttgtatttttagtagagacggggtttcactatgttggtcaggctggtcttgaacttctgacctagtgatttttctacctcggcctcccaaagtgctgggattacagacatgagccaccagactcggctgagcatcttttcaatatgaccttgtgtccgggcatggtggctcacacctgtaatcccagcactttgggaggctgaggtgggcggatcacgaggtcaggagatcgagaccatcctggctaacacggtgaaactccatctctactaaagatgcaaaaaaaattagtcaggtgtggtggcgggcacctgtaatcccagctactcgggaggctgaggcaagagaatggcatgaacccaggaggcagagcttgcagtgagccgagattgcaccactgcactccagcctgggcaacagagcgagactcggtctcaaaaaaagagaaaggattcaaggcagtgtataccaaacatgaaagtaaagttcaggaacctctttgatggaggagatgacggtggggtctgtagcctgttcatgcctataattgcaacacgtcgggaggccaaggtgggaggatcacttgaggccaggagtttgagatcagctcggccaacatagtgagaccccatctctacaaaaataaaaataaattagtggggcatggtggcacacacctgtagttccagctacttgggggactgaggcaggaggatcacttgaaaacaggagtttgagatcagcctgaacaatggagcaagaccctgtctctacaaaagattaaaaaaaaaactggcagatgtgctggcacgtgcctgtagtcccagctgcctaggaggctgaggcaggaggattgcttaagtctgggagtttgaggctgcagtgagctgtgttttcaccactgcactccagccggggtgacagagcaagaccctatcagtagtagtagtagtaataataataataataataataataataataataatatgttgctgcaaaagtaattgctgcttttgccattaacttttgcaccaacctcatgataaaacaacaaaaactcaacacctgtacctgccatgccctgaagctcatgacagtagacaaaactcactgtgtctccagccctcagtgttagatgaagggaccagggtgtgggaagatcagcagttcaaacgggaatcataaaacacatagtttttatttttttagttttgttttattatttatttatttatttttgttgttattatttttctgagatggagtctccctctgtcacccaggctggagtgcagtggtgtgatctcggctcactgctacctctgcctcccgggttcaagtgattctcctgcctcagcttcccgagtagctgggattacaggtgcgtgctaccatgcccggctaatttttgtacttttagtacagacggggtttcaccatgttgattgggctggtctcaaactcctgacctcgtgatccgcctgcctcggcctcccaaagtgctgggattacaggcgtgagccactgcgcccagcccccatgaaacatatagatattttcaaaacaactgtactaggatcaagaaggataggacttttgtttttcctgttttttaagaatgaaatatcatatggcgtaagcatagatttatttatttacttacttatctattcatttatttttagagacaggatcttgctctgttgcccaggctggagtgcagtaatgcaatcatagctcactgcagccttcaagtcctgggctcaaacaatcctcccatctcagcctcccacgtacctgggactacacatgcaagccaccatgcctggctaagttttaaatttctttgtagagatggggtcttgctatgttgcccaagctgatctcaaactcctggcctcaagtgattgtctcaccctgacctcctaaagtgttgggattacaggtgtgacccactgcttcctgcctagactttttttttttttttccaattaaggtttttactttgagatcattgtagatttataagcagttgtaagaaataataggaaagaatcttgtgtctacttcccccagtggtaacatcttggaaagcaataataccatgtcacaaggaggatattcacattcaggcaataatgcattgatcttatgttttactcgtatccgtgtgggtttttgtaccgagttctgtgcaatttcatagtgcgtgcaggtttgtgaagccagcattgtccgcaacacacagagcatttctttcaccaacaacccctcctgtttctctctctgcatcctacctcaacctcctctcccgtcctgaacccctgagaattactagtctgttctctatttctgtaccaacctgcatcctacctcaacctcctctcctgtcctgaacccctgagaattactagtctgttctctatttctgtaccttttctcatgtcaagaatgtcatataaatggagtcatacagagtgtaacccctttcaaatcacgtgtgtctttttttccttcactcaatagaattccctggagagccatccaagttgttgctaagaacaataagatgtttctttttaagtaacacctgcaaaaagtcttttataaaatggcgatgaaactaaatggtttttgattctaaacaaggcagccatgaatggttttctcgtatatcttagcatatgtgtgggagtgtatctgtgcaagtaattcttggaagtggaatagctgagccaaaaagaaaatgcatgtaaattttcttttctttattttaaagagacagcgtcttgctctgtcacccaggctggagtgcagtggtgcaatcatagcttgccgcagcctcgacctcctgggctccagtgatcctcccatttcagcctccagggtagctgggactacaggcgagcatcaccacgtctggctaatttatttttatttttgtagaggtagggtcttgctatgttgcccaggctgggcctcgtgctcctagcctccgctgatcctcccaccttggcctctcaaagtgttgggattacaggcataagctaccaggcctggctgcctgtcacctttcaggagtcattgtcaacttatctcctaagaaaatgcagtcttggtgggtacatttgaactgagtatgtaaacttctaacttctccaaggcatacgcattctggataacaaccctactttttaacctattccatgtgattgatgaaagctcacaattgctttattcattatttcattgtcagcgagactgaactttgtttcatatgcttatgttttatttcatatctccaaattgcatattcatttcctttacccatttgtggagggactggggtttggttagaagagctctttatagaccgggcgcggtggctcacgcctgtaatcccagcactttgggaggccgaggcgggcggatcacgagatcaggagatcgagaccatcctggctaacacagtgaaaccctgtctctactaaaaatacaaaaacaaaattagccgggcgtggtggcgggcgcctgtagtcccagctactcgggaggctgaggtgagagaacggcgtgaacccgggaggtggagcttgcattgagctgatattgcgccactgcattccagcctgggcgacagagcgagactccatctcaaaaaagaaaaggttagaaaaatacaccatggaatactacgcagccataaaaaggatgagttcatgtcctttgcagggacatggatgaagctggaaggcatcattctcagcctaataacgcaggaacagaaaaccaaacaccacatgttctcacttacaagtaggagctgaacagtgagaacacagggacgcagggagggggacatcacacaccagaacctgctgggggctggggaacaaggagagggagcgcattaggacaaatacctaatgcatgcagggcttaaaagctagatgatgggttgatgggtgcagcaaaccaccgtggcacatgtatacctatgtaacaaacctgcgcgttctacacatgtatcccagaactttaaaaaaaaaagaaatagtatttcaatatggtctgaattaggatgtctgttattagatataaaggagaacatatgtgttgagggccatttgagcctgttctgtatataaactcttatttttgcccttttctttgtagcatgtttggggtttttctggagttgaactttttagatatctgaaaaatagctgttaatatttctgatggaagttgcaaattttcttccagctcattatttattttttactttgcttatggagatttgttttgttttttaccatgtgattttttttttgagatagtgtcttgttcctcctggagtgcagtggcacgatcttggctcactgcaacctccatcccttgggctcaagtgatcctcccatctcagcctcccagcttgctggaactacaggcacgcaccgccacacccggttaattttttaaattttttgtagagatgaggcctctctctgtttcccaggctggtcctgagcttttggcctcaagcgatacccccacctcagccctcaaagtgctgggattacaggcatgagccactgcccggcctgttttttaaacaagtagttttttaaatagtgaaatctatctaaccatctttctgaattttcgtttaggaagcattttctttctgtggaggttaaactaatgattcctgctttcttgcaatcttctcatggtttaactttgtttttgccttggagttcactcatgcatgctatgaggtctggcactaattttatctgtttcctaatgtggcttcacgtgccccaacacggtttattaaaacgcccatcttttgccccttttgtcgtgtactcaatttccacatgcagttggcctatttttggaaattgtaccctgttccttcctccattaatgcctgtagtacctcccgtttaattatagaagcttctcaaatgttttaatctcctacagggccattgtgttctcaatctttgtacatatcagaattttcctctttgccgcctcatttggaattcttttccccacagcaattttcgaatcgattcgtccagtttgcctaaaagaaattctgtgaactatctttattggatcacatcaaatttgcatattgacttgggtcattctgacacctttaggattgtatcagtttagattttttttccccctccaacttctattttattttttaaattaaaaaaaattttttttttgagacggagtctggctctgtcgccctggctggagtgcactggcgtgatctcagctcactgcaagctccacctcccgggttcaagcgatcctcctgcctcagcctcccgagtcgctgggattacaggtggcacacaccaccacgcccagctaaattttgtatttttagtagagatgcggtttcaccatgttggccaggctggtcttgaactcctgacctcgtgatccacccgtctcggcctcccaaagtgctgggatgacaggtgtgagccaccgcatctggcctcaacttctattttaggttcgggggtacatgtgcaggtttgttccctgggtatattgtgtgatgttgaggtttggagcacaaggatcccgtcacccaggtagtcagcacagcactcaatagttttccaacccttgccccatcccttccttgccccattgaattgctcagtgtttattgttcccatctttatgtccatctgtacttgatgtttacctcccagtaagaagtgagaacgtctgatatttagtttcctggttctgtgttaattcacataggagaatggcctcctcttgcatctatattgctgcaaaggacatgatttcattctttttaatgggtgcatagtattccatggtatagatgcaccatgtcttcctaagaattgaattaacatttgagccagcaatcccattactgggtatctacccaagggaaagtaagtcattctaccaaaaagacacacgtactgtgtgttcatcgcagcactattcataaaagcaaagacatggaatcaaacttaggtgtctgtcaactccggattggacaaagtttgggggttttttttgtctttttttttttttttgtgagatggagtctagctctgtcgcccaggctggagtgcagtggcacaatctcggctcactgcaagctctacctcccaggttcacgccattctcctgcctcagccttccgagtagctgggactacaggcgcccgccaccacgccaggctaattttttgtatttttagtagagaccgggtttcaccgtgttagccaggatggtgtcgatctcctgacctcgtgatccacccgcctcggcctcccaaagtgctgggattacaggcatgagccaccgtgcccggccgtcttttttttgttttgttttgagacagtcttgctctgtcacccaggctggagtgcagtggtatgatcggagctcactacagcctcaacctcccagtcttgcgtgatcctctgaactcagcctcccgggtagctgagatgacagccgtgtgccaccatgcctggctaatttttttgtacctttttttttgttttgtagcaatggggcttcactatgttgcccaggctggtcttgaactcctgggctcaagcgatctgcctgccttggcttcccaaagtgctgggattacaggcatgagccactgcgcctgacccatttgggtctttggagaagcacacaccaagaaggaacatgatgggccagagatttactaggggaactgtgtgtgaagggtcaaacaggcgctggcagaagagtggaggaaggcttgcaggtgatggtgtaggtgcctcacacctgtgaagaaagagacggcgaggaattgggtagaaggagcgtccagccagttctctggtcatgccgagtcattggctgtgaaaacccaaaaccctgaggaagcccgatcttgcgaaacatgttccccatctgcagaggcaccgggtggctggtgtcaggcgattgttgcaacctgttgtgtgcgggggtgtctgtgtgggtacatacatacttctcagccccaatgccagcttcctggtccgtaaggaaaacactaaactcttctagctaaagttacaaatgcagcaagggtccattctgcaatctgtgatgcttttttttttttttttgagctggggtctcgctaccttgcccaggctgcggtgcagtggcacaatcacggctcactgtgcgttttcagggaagaccccacgggcacctccaaaaccatgtggcatgacatcctcaccgagacccgagggcatctttccatggcctcaactctacttttatgtctttaggtttcctgatataggttttgcacactctcgatgaccaagtctcatttcagtgttgctgttgtttctatattataagcaggactgtctcttcccctacctttttaacctgccaattgtttgtgtatgtatggaagctattgatatttgcttctgagttttctatctgactaccttcctgaattctcttcttggatttatttaatgttgattttgttagttttttcctggcataccatcatatcatctgcaaagtatattttgactctccctctgccgttcttgtgtctgttgtaattatttgtctgaccatgttggataagatctccagtagcatgttaaatgacagggtgcactcctggaatccagctctttgggaggccggggtgggaggatgacttgagccccggagatcaagaccggtctgggcaacacagcaagaccccatctttacaaaaaaaaaatagtaaaaaaaattagccaagtgtggtggctcacacctgtagtcccagctacttgggaggctgaggcaggaggatcatttgagtccaggaggtcgaggcttcagcgagccatgattgcaccactgcactgcagcctgggcaatgtagtaagaccccagctcaaaaaaaaaaaaaagcatcacagagaacaggatggatacttgctgcttttccaagtttagctggaagattttagagatttctttattgactaggaagttggcattggggctgagaaatatgtatgtacacacacagacacacccacacacagacacacatgtatacatacacagtatatatgcatactgtgtgtctgtaattacaatttaataatacattcctatttttaaaataaacttagtaaattaagaacatcaatacatctactgatactacatatagtatttgcaagtccctcagcttgggtcaggaacacgggaatgtcattgtacaggttctatcttcaggttacgagggatacaccagaaaacctaagcatatggaaaacttattcggcaattttctaagtgaacataccttttcatcgattcatgcgtgtatcaagaaaaacaaaatgaaagtcttacacaccaagaggattgttcgcacaatactgacaacgaaatgtacgggctgacaaataacagattatatgttgaagcctcctccacaggccccacctcctgataccatcaccctggcgattgtatgttctcaacataggaattattttggggggagaggagacacaacattttatacttggaaaggtgaaatggaaaagcagcataggctttattgttttattttattttattatactttaagttctggggtacatgtgcagaacgtgcaggtttgttacataggtatacacgtgccatggtggtttgctgcacccatcaacccatcatctacattaggtgtttgtcctaatgctctccctcccctagtccctcacctcctgacaggccctggtgtgtgatgttcccctccctgtttccatgtgttctcattgttcaactcccacttgtgagtgagaacatgtggtgtttggttttctgttcttgtgttagttcgctgagaaggatggtttccagcttcatccatgtccctgcaaaggacatgaacccatccttttttatggctgcatagtattccatggtgtccatgtgccacattttctttattcagtctatcgttgatgggcatttgggttggttccaagtctttactattgtgaacagtgctgcaataaacatacgtgtgtgtgtcgttatagtggaatgatttataaacctatttctatttaaattacctttgtatttttatagattttgtgggtatgagtacacttgtgttacatgaatatattgcatagtggtaatgtttgggctgttagtgaggccatcactcaaataacgtacatggtagccaataggtaatttctcatccctcatcccatcccaccctgtgagacttctgagtcctcgatgtctattttttatgctctatgtcgacgtgtacacattatttaattcccgcttataagggataacatgtggtacttgactttctgtttctgagccatttcacttaggataatggcctccagttcccttcgtgttgctgcaaaagacacaacatcattccttttcatggctgtgtagtattccatggtatatatgtgccatattttaaaaaatcaaattgtctgatggtggacacttaggctttatattttaataaagaacattccaaatatgttgaacaaaataatctcctaacttgaaaaagatcatatgtgcctataataattcacagaaagggactttcctgactacctgcctgcaaaatccacttttccctcagtctttctttctcaagggaattcatggaaattccctccttgaattttctcagcccccagtacaaggagtcattcttgcctcatcatgtccccctctctgtccttgtcttgtgatttctttttattttgaacgcgagaagtctgactcccaccagcacccctgtggccagtacctgtgagacatattctgaatccagcacctctcataccacctgtgctgaactgtggcggagctcccccgtcagtccctgcagctgcttcaggagacccttgatagccttgtcttcctccagctcaagtggattctccatgaatctattccttcctgtgaaacatatcacagattggctcagagccccgtgatgacgccctgtctgccagagagaagctcacgaactctggggtgcccctactccttcttccctcctctcttccctccttccatgtgcttggctccagctagccagccagccgccttcctcttcctggaatatcccaggcctgctagacttttgctctcaccgtcacaacatcagctcaggagcccctccttggaagattgttctctaaccctccgtccagaatcactgcttctccctttcctcttcttcctttgaagttcattcataactggaagatgtgagatctggaaagttctgcattattgccagacacatctgtgtatttagagtggttggtatctttcccaggggaaccaaatgtccttgaggcagacaacatgtttatctttgtctaattcatttccctgtatgctgggcacagagtgtgggctctacacatattttataaaagaaggagggaagggttagaagatggacagaaggaaggaggaagaaaggaaggaaagagggaggaaagaaaggaaagagggagggaaggaaagagggaaagaaggaaggaaagagtgagagaaggaagtaaagaggaaaggaagggaagggaaggaaggaaggaaaaagtgagagaaagaagtgaagaggaaaggatggaaggagaaaggaaggaaagggagggaaggaaaaaggaaaagaagaaagaaggagtgagacaaggaagtaaagaagaaaggagggaaagaggaaaggaaagaaggaaagagggagggaaggaaggaatgaagaaaagaaagagggaaggaaggaaggaaagaaggaaggaggaaggaaggaaaaagggagggaaggaaggaatgaagaaaggaaagagggagggaaggaaggaaggagggagggaaggaaagagggagggaaggaaagaatgaaggaaggaaggaatgaaggaagaaaggaaaaagagaaggaaggaggaaggaaggaaagagggaaggaaggaaggaaagatggagagaaggaagggaggacaagtggaaggaagaaaaagaaatacaaatctccctcaaaatgtggatcactcgtcttaaccagaaattcaagtgagatgctatctgcacgtgtgataccagcagctatgaagcaaactgtattaaccaagtcttttattttctgtgttctgatgcatgactttcatggccttgtcaaccctagagaccctgcccctcccatagctagcgaatccccagaggtggtgaagagcccacctatgaacctgtctttcatatgcaaacccatcaatccagaatccaccccccagccatctcctttattggggttgcatattccacgtcactctccacctgccctaaccaccccaaagccaggtaccagagagtcagggacagcccctatgccccagagcctgctgaaatcattcacactagccaactgtaagcctactcgcctgttccttcccttggaaaccacagtgagagctctggtctcctttgtcttcccacctgaccaaacttggtgcgcccctgtgtggtcctgagtggtgtcaacacgcccctcctcttgggacctgtgagtaacaaaccacttgcttaacggcagtctcctgatctgttggccccaccatacctacatcataataaagtctacattttacaacgcaaacgaacaaaaatgtcctgctcagtgctgccctgagagcagaggttattccaggattcttgctcgcctctgtaaagggtatccgttctgcagacctttctgccggtcacactgacggcatattgcagagcctgccagggactcacaggggatgacaggggatttatcaggtggttttttactgcactgtcattactgggggcgaatccactttaatacattcatgcctcctgagcctgtgggaattcaagaggaacagaaccagaaataaatgaaccataactccctttggcatcttgcctctctggaggcttaattcttacaaatatgtgctctgctttcaaatcttagtttgatgattttctcttcttctttttcagttttccccccacgacctgaccgtgtcgctatagtgacgggagggacagatggcattggctattctacagcgaagcatctggcgagacttggcatgcatgttatcataggtgatgacttttacagttacttgtgttttttgttttttcggtttttttttttttctgagacaggatcgcagtccgtcaacccgtgctggactgcagtggtgcaatcttggctcactgcagcctccacctcctgggttaaagtgattctcctacctcagcctcccgagtagctgggtttacagacatgcaccaccacgcctggataatttttgtatttttagtagagacagagtttccatatgctggccaggctggtcttgaactcctgagctcaagccatccgcctgccgtggcctcccaaagtgctaggattacaggtgtgagccactgcgcctggcagagttagttgtgtcttatacctaatgtgagctacttaggtgtcgattcagacatgtatgcaaatgttgatgtgcatatagaaaattcagtcagatccagaaagctcatgaaggtgatattcacaacctagaaaacacagaaaattgttgtacccttttggaagtagatatatattctgcttaaatattgatcctgtgtttctttcacatggtttactggaaaaaaataaccatatatctttatgactttactagggctgttataacaaagtatctcaaggagactggaggttgcttaaaaagccaaaatttatttttcacaattccagaggctggaagttcaatatcacagtgtaagtagggctggttcctcccaattccagaggctggaggttcaatatcacagtgtgagtaaggctggttcctcccgacacctcactccttggcttgtagacaccatcttctccctgtgtcctcacagggtcgtccctctgtgtgttttcatctcctcttctcctgagatgtcttagtccatttcaggcgctataacagaattaccatagaatgggcagcttatatacaacagacattgagtttcccacagtcctggaggctggatgtctgagatccaggtgtgggcagggctggttcctcctgaggcctctctccttggtttctctctgtgtcctcacagggtcatccctctgtgtgtgtccgtgtcctcatatgctctccttataaggacaccagttcaattagatcggggcccactctggtgacctcattttaccttaatcaccactttaaagaccttatttccaaacacagtcacattctgaggccctgggctttaggacttcaatttatgaattttgttcaaacacaagctcctaacagaatctgaacaatgttgcgggatacttgtttcttctgcaaccatgacctatagacactcacggtttgatttctgctcttctttttgaaaatttctctaaaagcttatcgtgatctctgactcctcttcctctgtgacctcttcaggtctcccttcaactgggaatatgaggacagttcaaattaacccattccactactgccaatggagacggagtggggggcggggaggaggggagagagtctattgcatacctggggaagtctaaatcagctagcttaaatgatgtgtggagacgagcttggaaaaataaaagccttaatgtgtattatgcccactcttgacactatctgcatttaattaattattttcagacaggatcctactctgtcagcccagactgcagtgcagtgacataatcatagctcactgcaacctcaaactcctgggctccagcaatcctcctgactcagcctcatgagtcgctgatatgacaggcgtgcaccaccatgccaagctcattttatttatttatttattattgttttttttgagacagaatcttgctctgtcacccaggtggaatgcagtgacacgacctcggctcacggcatcccctgcctcctgggttcaagcgactctcctgcctcagcctccagagtagctgggattacaggcgcccgccaccatgccctgctaatttttgtatttttagtagagatggggttttgctttgttggccaggctggtcttgaactcctgacctcacgtgatctgcccacctccgcctcccaaagcgctgggattacagtcatgaaccaccgtgcctggccctggctcatttaaaaaagttattttggcggctgggcgtggtggcttatgcctgtaatcccagcactttgggaggtcaaggtgggcagatcacttgaggttaagagttcaagaccagcctggccaacatggtgaagccctgactgtcctaaaaacacaaaaattagctgggcttgggggtgagtgcctgcgtggtggtgggcgcctgtagtcccagctactcgggaggctgaggcaggtgaattgcttgaacctgagaggcggaggttgcagtgagctgagatcacgccactgcactccagcctgggtgacagagcgagactcagtctcaaaaaaataaacaaaatgttttggagatactgggtcttgctatgttgcccaggctggtcttgaactcctgggttgaagtgatcctcccaccttggcctcccaaagtgctgggattacaagtgtgagccactaggcctgggcaccctttgcttttaataacttttatggtgtctgcttttataaacatcatactgtaggtctggtttgagatatgcaggatcgtattgacttaacactttccaggacgggagcagtggctcatgcctgtaatcccagcactttaggaagccgaggcgggcagatcacgaggtcaggagatcgagaccatcctggctaacatggtgaaaccccgtctctactaaaaatacaaaaagtagctcggcatggtggcgtatgcctgtaatcccagctgctcgggaggctgaggcgggagcatcgcttgagccagggagccggaggttgcagtgaaccgagatcgcgccactgcactccagcctgggtgacagagtgagactctgtctcaaaaaaagactttccaaaaccaatgcccattattgattgacttcttcctctccgccattctctgtccttctttcccttgttgtcattatggaaagatgatcatggatcataaacaatgcttagggctggagatttcaacatgaatttgtctcagttcttccttatctttgaggagctctgtccaggacagacacttttctgggccttgaatgcctttgcgatagcccaaaaggctcaagcataagagcatgagtctgatctggtgaccagggctcagcaaagagtctttccaggccttgaacctctggacatctgttggtgctcattggacaggctaaaagtcatcatgttacgaatcgatgaagttgacatgcagataaaaggtataaggaaaaaatgaactctccacatcattgtatgcattacatctatacgataaaaactgtgatatactcatgcgtttaaatagctgctctggtcctgggcctcatgcgtttcaatagctgctagcgttctgagcctcgatggccatccacttggctttgagttagctctctccaaaaatctccatggcagtttctgctggggcaaatgcacggctgctgcccacacctctgtgttttctcatcttcatttacaaaagaagaaaatgctaaccttgctgatgctaacctcctgaatttcatgcaggaatccccaggagtctttgactcagatggggaaaccccatgttcagcccatgtggccttctggtctccctggagatgcgtggtccatgtcagcgcacatggctccttgctccgtccttcacttaagtttgagcctttttggcttttgcaaaacatgaatgcaaaacttgaaatttttctatgtcatggctcttcccaactttcacatttttgagacagcgtctcactctgtcacccaggctggagtgcaatggcgtgatctcagcccactacaacctctgcctcctgggctcaagcgatcctcccacctcagcctcccaagtagctgggaccacaggcgtgcaccaccaggcttggataattttttgtagttttagtagagatggggcctcaccatgttgcttggacttgtctcaaacacctgagttcaagcgatctgcctgcctcggcttcccaaagtgctgggattacaggtgtgagccactgtgcccagagtcttttaaaataataattttgtacacgcagttccattcctcatataaccatctttctctgatgcacttcagggtttgtaaaatagtatacagagatgtgtactgtttcacatgatgaagcttagttgtattagataatgataacatcgtgtttggctatgtcataatgaggcaattgagtagaatataatgaaatcttgttggattagttaatgacttgttgagcttcggaagcaggtgagcactttttggtctatatcagtctctttctttccatcaagcagttattttcctcaaagttgtgcctaactcccacttgagcattttttttatccattctttttttttttactttgacatgaagtctcactctgttgcccaggctggagtgcagtggcgcgatctcagctcacttcaacctccgcctcccgggttcaagcgattctgctgcctcagcctcctgagtagctgggactacaggagcacaccaccacacccagctaatttttgtatttttagtagagacggggtttcaccatgttggccaagatggtctcgatctcttgaccttgtgatccacctgcctcagcctcccaaaatgctggtattacaggcgtgagccactgtgcccggccccattctctttattttattttattattttattattattattattattattttttgagatggagtttcgctgttattgcccaggctggagtgcagtggcgcgatctcagctcaccgcaaactctgcctcccgggttgaagcgattctcctgcctcagcctcccaagtagctgggattacaggcgcgtgccagcacaccaagctaattttttgtatttttagtagagggggggtttcaccatgtaggtcaggatggtcttgatctcttgacctcgtaatttgcctgcctcggcctcccaaagtgctgggattacaggcgtgagccactgcgcccggcctcattctcttaatagactgggacaagttaaaactttatgacaatttcttgaaattgtcaagttcatccatgtccctaactctcctgtcttggtgtgtttgggctgctgtagcctgagtgccttgcaaaccatagaaactttttttttaaaattttattattatactttaagttttagggtacatgtgcacaacgtgcaggtttgttacatatgtatacatgtgccatgctggtgtgctgcacctattaactcgtcatttagcattaggtatatctcctaatgctatccctcccccctccccccaccccacaacagtccccggtgtgtgatgttccccttcctgtgtccatgtgttctcattgttcagttcccacctatgagtgagaacatgcggtgtttggttttttgtccttgcgatagtttgctgagaatgatggtttccagcttcatccatgtccctacgaaggacatgaactcatcatttttgatggctgcatagtattctgtggtgtatatgtgccacattttcttaatccagtctatcgttgttggacatttaggttggttccaagtctttgctattgtgaatagtgctgctataaacatacgtgtgcgtgtgtctttatagcagcatgatttataatcctttgggtatatacccagtaatgggatggctgggtcaaatggtatttctagttctagatccctgaggaatcgccacactgacttccacaataaaccatagaaacttattgtcctacagttctcaaggctggaagtcccaagaccagggggtcagtgtggtcagattctggtgtagtctgtcttctaggttgtggatggccactttctcctgtgtcctcacatggtggaacctggatggggtctcttttataagggtactaattccattcattgtgctccaccctcgtgacctaatcatcccgcaaagcctccgcctcccaacagaatcactggggatgttagaatttcaacataggaactttggagggatacaaacattcagtttattgcgccccctctagatgcaaaaggattgggtttagatgaggagaccccaggggagagggtgcccatctgagagtgtatttctagaacttcttatgaacttgagcacctccatgatctgtttacatctccctgggacctgagtaaattagagacaagatgtagggcagggggggttctgagatttagcttggagactgtgaggtggtgatggatggcaacccttggttttgaccatccatgctaggtggatatctgctgtatcattaacaacatgacaaactttccaggactttctatatctcagacttctgccaatatttgagatgactgggtcaaaatgatgctgattttttgaacagggagagcaataggtattctctgaaggttggctggatgtgagcctagtggcttcaatgatggtggagtaggatgaagagagaccctcaaggttgaacaaagatgggagggctcacatccattactggttatatttgatcttttgtctcctccagtgcaatgatctttttcatcttcttaattcttaatttagctaggcaatgtttaattattagtttaattcttaatcaaactaggaaaggaagaaaacaccccatttctttgtgcttttttgcctcattgtggtggtttaggtcatgatgaggtctagttgggcaggtcatgatgaagtctagttgtattaggttctgatgatgtctggttgagttagatcatgctgaggtacagtttggtttggtcatgatgaagtctagttgtattagatcatgataacgtctcctttggttatgtcatgatgaagtagttgagtagaatgtaatgaagtcttgttcgattagatcatgatgactggttgagttaggtcattatgaggtatggtttgattaggtcttaatgaagtctagttcagtaacagcatgatgagatctagttggattagacttgatgatgtgtgacttatttaggtgatgatgaaatcttgttgggctaggtcactttgagatctaattgggtaggtcatgatgaggtcttgttgagttaggtcctgatgaaatgtagttgagttaggtcacattgaggtctagttgggtaggccatgatgaggtctatttgtattaagtcatgatgaggtttggttgtattagatcatggtaaggtacagtttggttaggtcatgatgaagtctagttgtattagttcatcataatgtttagtttggctatgtcatgatgaggtagttgagtagaatgtgatgaaatcttgttggattagattaggatgactggttgagttagatcattatgaggtgtgatttaattaggtcttaatgaagtctacttcagtaatagcatgatgagatctagctggatcagatcatggtgatgtgtggtttggctaggtcatgatgaagtctagttgggttaagactcaatgagttctagttgggtcaggtcacattgacgtctagttgggtaggtcatgatgacgtctaattgggttagatcatgaggagatctagttaggaaggtcatgatgaggcctagtggatagatcatgatgaggtctagttgggttaggtcatgataaggtctagttggattaggtcatgataaggtccagctgggttatgtcatcatgaggtagttgaatagaacacaataaagtcctcttggattagatcatgatgacaggttgagttagatcatgatgatgtgtggtttggttaggtcacagtgaggtctagttgactgaggactttgtaggcacaaagcaatgaagacatgtgagcaagcttcttgttcatgtgcatgggaatctcaagtgttaccacttcatttagatgatgtttactgagcatcaggagcagtatatgtcagcaccaatgtgccttttttcttgagataaacagaaagtaaacaccacatctgcaccccacctgtgtctcctatcccacagagctcctgatgtcagtgtttaattttcactgtgagttacagttttgacccttcaggtcaatccaatcaattatgcagtcttatttcccctgtgtgactttgaggataattggatatattctgagagaggcattttttcattttgtatggcagtttgattcaaagtcaattaatgaaaaaatatcattgaacacaatgaattttatattaaatacaaaataagagatgggaaatttaacttcaaaattttaattaaaaatttattaatatttaaagaataatcaattacttgtaaaataattcagattataacctgggtccaactgaagcacattaatattactagacacatatatcagttgttcaaattcccatctgtccacaagatcttagttctcattgtttcaaaatattattttggtgggggatcattttttttcataatgctcaatggactgtcatctaagatgaaagtggggtgggtaaactttttctgtaaagagacagataataaatgtgttcatatgtttctctcataactatgagctctgccctagtagtgagtaaccacccataggtaatacttaaaacaacaggaaagtctatgttgctgtaaaactttttgtacaatatccagctgcaggccaggtttagccgcagattggtgactctggtttgggctcaaaatctttttatttagtaagaggaaattatactgcttttttccaatataagaaatctcttgtacagtcctcaggaagggtagataatgatgaggtctagttgggttataatgaagtttagttgggttatgatgaagtctacttgggttggtcatgatgagatctagttgtattagatcctgatgagatccagttgggtaaggttctgatgaggtctagttgattggtcatgatgagacttagttaggctataatgaggactagttgtgttggtcaggatgagatcaagttgtattaggtcatgacgagatctagttgggtcaggttgtgatgagatctggttggttggtcatgacgagatctagttaggttatgaggaggtccggttgggttggtcatgaggagaactaattgtattaggtcttgatgagatctagttgggttaggttatgatgaggtctagttgggttggtcatgatgagaactagttgtattaggtcatgatgagatctagttaggttctgatgaggtctagttagattggtcatgaggagatctagttgtattaggttatgatgtgatctaattgggtgaagttattatgaggtctagttgggttggtcatgatgagatctggttgggttaggttatgatgcgatctagttggttggtcatgatgagatctaattaggttatgatgaggtctatttgggttggttgtgatgagatctagtcatattcagtcatgatgaggtctagttgggttagattatgatgaggtttagttgggttaggtcatgatgaggtctagttgggttagggtatgaggagatttaattgagttaggttatgatgaggtctagttgggctggtctttatgagatctagttgtattaggtcatgatgagatctaattgaattatattacgatgatatctagttggttggtcatgatgagatctagttgtattaggtcatgatgtgatgtagttggggtaagttatgatgaggtctcattgagtttgtcatgatgagagctagttgtactagatcatgatgagttatagttgggttaggttatgatgagatctagttggttggtcatgttgagatccagttaggttatgatgaggtccagatgcggtggtcataatgaaatctagttgtattaggtcatgatgagatctagttgtggtaggatatgatgaggtctagtgcattggtcatgatgagatctagttgtattaggttatgatgagatctagttggattaggtcatgatgagatctagttgtggtaggatatgatgaggtctagtgcattggtcatgatgagatctagttgtattaggttatgatgagatctagttggattaagttataatgggatctgtttggttggtcacgatgtgatctagttaggtcgtgatgagttctagttgggtaggtcgtgatgagatctagttgtctcatgtcatgatgaggtctagttgggttaggttatgatgaagtccagtttggttaggtcatgatgaggtctagtgggattggtcattatgagaattagttgtattaggtcataatgaaatctagttggcctaggctatgatgagctctggtaggttgttcatgatgagatctacttgtattgggtcatgatgagacccaggtgtgttaggttatgataagatctagttcgttgtcataatgagatgtaatttgtttatgatgcagtctagttgtgttgctcatgatgggatctagttgtattaggtcatgatgagacctagttgggttaggttatgatgaggtctagttggtttggttatgatgaaatcttgttggattatgtcatgaggagatctagttggatggtcatgatgagatataattaggtcatgataaggtctagttgggttggtcttgatgagatatagttgtattaggtcgtgatgaggtctagtttggttaggttatgatgaagtctagtttggttaggtcatgatgagttctagttgggttagggtatgaggagatttacttggataaggttgtgatgaggtctatttgggttggtcatgatgagattttgttaggtcatgatgaggactagttttgttggccttgatgagatgtagttgtattaggtcataatgaagtcttgttgagttaggttatgatgtagttaagttgggttaagttatgatgaggtatagttgggttggtcatgatgagagttagttaggtcacgatgaggtagttgggttggtcatgatgaaatctagtcatagtcagtcatgattagttcttgttgggcttgtttataatgagatttagctgtgtcaggtcatgatgaggtctagttgagttggtcatgatgtgatctagttgtattaggtcatgatgaggtctagtttggttaggttatgaggtctagtgtcgttggttgtgatgagattcagttaagttatgatgaggtgtatttgggttggtcataaagatacctgtttgtattaggtcatgttgaggtttatttgggctaggttataatgagatttagttgggttaggtcatgatgaggtctagttgggttagggtataatcagatctatttgggttaagttatgatgaggtgtattttggttagtcctaatgagatttagttgggttagagtatgatgaggtgtagttgcgttggtcatcataaaatctagttttgtaggtcacaggaagtctagttggttaggttatctaaattgcaactgtcttttaaaaatgacttgtgccacatatactttgtattgtccatgaatagtacatgtgaaacgtgtaaaatatttaaacttgtatttaattatctatttacttattttaatagacaaaaacaagttacatatttttatggtgtacaaaatgtggttttgatatatgtttccatctggaatggccaattcaagctaattcacatatccattaccttacatgtttctttttgtgtgtgtttttggaaacacttaaaatctactctctttgcaattttcaaatattaattatagtcactgtgactaattatagtcaggttcaagattatagtcactaatttagtcaccttaagtacaatagatctcttgaacttataccttctgtcaaactgacatttggtgtcatttgaacaaaatctcagcaacccacccccctagcacctggtaatcaccataattctttttcttttctttctttcttttttttgagatggagtctcactctgtcaccaggctggagtgcagtggcgcaatctcggctcactgcaacctccacctcctgggttcaagcgattctcctgcctcagcctcctgagtagctgggactacaggtgcatgccaccgtacccggctaatttttgtatttttagtagagacaggcttttgccaggttggccaggatggtctcgatctcttgaccttgtgatccacctgccttggcctcccaaagtgctgggattacaggcatgagataccacgcctggccaataatcatcataatactttttcttgtgagttcaacttctggagactctacatatgggtgagatcatgtgggatttggttttatgtggcttattttacttaacatgatgtactcctggttgatccatgttgtatcacaggatagggtcctctggttttcaaagactgaatggtattccatggtgtagctatcccacattttatttatctacccatccttagatggacacttaggttggtttcatatcttggctcttgtgaatcatgctgcaacgaacatgggggtgtagatatctctataaggggctgatttcatttcctttggatctatacagaggagtgagattgctagatcctatggtaggcataatgatcattttttgaggaactcttaaaaaaaaaaaggccacccctttagacacaccttaaaatccaacctttctggtcaaagacatttgaaaaaaatgacgacaacatcaaactatagtctcctgtccaagcacgttcacttcctaagatgtgaaaaaaaccaggccgggtgcagtggctcatgtctgtcatcccagcactttgggaggcaaaggcaaacgggtcacccgaggtcaggcgttcaagaccagcctggccaacatagtgaaaccccatctccactgttttccataatggctataccaatttccattgcacatataacatgtaacgccctcccctgcccccccaaatacaaaggatgaagcagaaggcagatgcactgtgtttgggacgtgtgcggtgtttctgcatatgcagtacttgctcagcaaatgtaggaaccactccagcaaatgcatatgaggccaaatgtcccacgtccagttccttaaagcagctccctccaggtctgaggagacaattgctgaaggtgacattggccaaagaagataccgcacgtgccacctcaccttctccattcctccagtgtggtgcttctgtcctatgccagcgttgacggtgccaccatggaaaatggcctgcccatgaaggtggtcttcccaaataatcacttcacctggctttttttgatgctcccagctttttctggtcacttttgtctttcttgagaaggtggaggctcccatcttacttcgtcccagcttccggcatgtttccctttgtttttttttgttttgttttgttttgttttctttttgagatggagtctcgctgtgttgcccaggctggagtgcagtggcgcaatctcatctcactgcaacctctgcctactgggttcaagcaattcttctgccttagcctccagagtagctgggattacaggtgcctgctaccatgtctggctaacttttttttttttttttttttttgggacagagttgggctctgtcgcccaggctggagtgcagtggtgtgatctcagttcatggcaacctctgcttcccgggtcctggttcaagcaattctcctgcctccgcttccctagtagctgggattacaggcacacatcaccatgcccatctaatttttgtgtttttagtagagatggggtttcctcatgttggccaggctggtcttgaactcctgacctcgtgatccgcttgcctcggcttcccaaatcccaaagggctgagattacaggcatgagccaccgcacccggccgcaccctttgatcttgagatggctgatacggcagagcagcccagcagtggatgagtgcttacatttaaaaagttcatgggatttcataaataagctcatgaatgtacaagtccccagtgtaaaggttaccttgactttgaatttttttatcctttctttttttgttttgtgtttgatgcataggacatttatagatggaatatacctttcaggctatttcttcctctccctcccgtcgaaacccacctccctgaaatgcctgctgcctcctcagtgccaaaggactgtcaaagcaaaaatgtaataatggtatcatgttctgtttctttaaggaagtcaaaggtgcaaattacctttgcagcttcagtcttctgatgtctgcaactttgaattccttcaaggaagtgacaatttagatattccatttactctgccccaaaggatggactttgcactatttatcttagccgtctcccactggagccaaaaacatttccaacttcataagtttcactgcttctcctcttttatatattttttcactctttgctgaaaacattttcattgttttttgaaaagtgcattctaatagttaatttgggagcccatggccttaacacagaagaaagaataccgaatacaatgataggatatcaaacagcatggtctcttccttgtgttagagtgtgtaaattcaatacgccgtgttgactcagtattcaggaatgccaaagagagggattatttggtaatgtattttcatggagacccggggacggtgctgtactacagaacacctcactggcccgggctgggtgcaggtaggatggagatagaccggccccacccccttggtaactgctccttgcagatcagctgtttgaagctctccgggcacccaagacgttcttgttcaagcctgtgcgcttcccctgctagttctcatctcccttctctcaacactttttccgtgaccctccctgaaagggagttttgggcttggctcaccctggaaagcagctaatcccacatgttgccaacaggttaatgaaggatgaggctgaaggaggaaaaatttgccaaactcctttcccctaaagagccgccccttcagaaacaccttaaaatccaacctcccgggtcaaagacatttgaaaaaatgacgaagacaacatcaaactatagtctcctgttcaacgcatgttcacttcctaagacattaaagaaaccaggccgggtgtggtggctcatacctgtcatcccagcactgtggaggccgaggcgggaggatcacctgagatcaggagttcaagaccagccttgccaacatggtgaaaccccctctctactaaagatacgaaaaaattagctgggcatagtggcagtcacctctaatcccagctactcaggaggctgaggcagcagaatcacttgaatcagagaggtggaggttgcagtgagctgagatcgcaccactgcactccagcctgggcaacagagcaagattctgtctcaaaaaaaaaacaaaacaaaaaaacaaaacaaaaaaacccaattaacattctttcaccccggatttcctagtctttattttagctataacaagcaaaacacctctttccatccttctaaaggcgtgttcctgaaacctcacttggagagttttacggaagtgcagtgagaggagtaagaaatcctgagcacacagccaactaacgcaggaacagaaaaccaaagaccccatgttctccttcataagtgggagttgaacaatgagaacgcatggacacagggaggggaacatcccacaccagggcctgtcgaggggttgagggggcagggcagggagagcattaggagaaatacctaatgtagatgatgggttgatgggtgcagcaaactgccatggcacgtgtatacctatgtaaccaacctgcacattccgcacatgtgccccagaacttaaagtagaattaaaaaaaagaaacagaaagaaatcctgagcacgtagtaggaaccacggtctgtgatcacgtgcatcgtgcagtctgtgtgtgcacactgggatgtttccagcataaaagctccttcgaaaattcgtttccatcctgacattttaatgcacattttttatgcttatgctattctcagctctcacgtgcaaattacaccagcaggtgccccgggtccctgtcactattgaaaagtagaatgtcaaatgcatttgtactttttgccaatgcaggctaaagaaaatgactcttaaatggatagctttagtctgccaaaatggctgtcaagttagacgctaggataaagggaaagtccatcaaaggcacatttcagatttgtgttatacttctcttaaaacctctttttttttttgcagttaatagtttctggataatcctacaagtcaccgtatcttttttttctttttccttttagctggaaataatgacagcaaagccaaacaagttgtaagcaaaataaaagaagaaaccttgaacgacaaaggtaccgagagatactccaatggcttttttttgtttttttttttccttgggacaggtcgtttgcgtggttcatggctgagcttcagtcacgtgccaggtggcatttgggagagatggctctgatttttgcactcttcttttggggatttctggccccatcctagagcaggagatggtcaaggcaaggcgaagatagcatcactcagctctgacatctgctaggaaaggcatgcagatgtgctggtagcttgcactcttactcaaatgtgtgttccccagggaacaggagccattgtcctttcctgttgacctccagggcacatgccaggaggtgcctctgctggttgggagttcttgacttaagataaatcaggccgggcgcagtggctcgcgcctgtaatcccagcactttgggaggctgaggcgggtggatcacgaggtcaggagttggagaccagcctggccaacatggtgaaacccaatctctactaaaaatacaaaaattagccaggcatggtggcatgtgcctgtaatcccaatgacccaggaggctgaggcaggagaatcgcttgaatctgggactgcctgggagagagagcaagactccgtctcaaaaaaaaaaaagaaagaaagaaaaaaagataaatcaaacaggaatatgcttgcccttaagattttcgaccaggtgctagaccaaattctggtgtgctctttctgtctgttcacactaaggaaggtgtgcacacaactttctaatatccatctagattctcaatgctctgtccttttatttatttattattttatttttcatttgtatacaggtagggagtgcaagtacagttttgttaacatggatgaatggcgtagtggtgaggtctgggcttttagtatagctaacacctgaatcacgtacattgtacccgagaggtaatttctcatcccttgctcctcttccacctcccacccttctgagtctccagtctctgttattccactctttccatgtggacacattatttagctcctgcttataagtaagaatgtaggaggtcggtcagggtggtaggaaaaattgtagaagatgcaaaccttcttgggaggccagaaggttttgcaaatgctcccgaataagatttggctgaaggcagccagattctcttatccagtgcctgaaagcttaggttagataacgaggggatgtaaagaaactgatctagataagttagtttgcttaggcctcagaacctggcctttaatcatccacgcacagaactactctctccctctctccgggttgcgggggacgaccatatgaattgcccacgaatgtgttgactcaaggcctttgtcattaaatgtatactaaataaaggcccacagcagcagcttgtcaaagccgtggctgctgactctttaaaacaccctcctcagtgtctgtgagtggccccatcccctagcccacgctttcactggaaatctgtgtctgagtgcatttgttcatccgtcgctcagccaaagtctgcgagtcggacccagcaaattggactcgacctaagaagaatggtatttgactttcggtttctgagttatgtcccttagggtaatggcctccagttccatctgtgttgctgcaggagataggatttcctcctttttcatggctgcatagtattccatcaggtatagatatatattttctttatgctttcgtgtgttgttggacacctaggttgtttccatatcttggctcctgtgaatagtgctgcaatgcacataggaatgcaggcatctctttgatacactgatttcatttgctttgagtctgtgcctagcagtggaattgctgaattatgtggtgcttttatttttaatgatttgaggaacttctgtactgtttttcatagtgactgtactaattgacattcccaccagtggtgtacaagggcccccttttctctacaccctccccaacacttgtaattaactgtagaaatcatcattctggccagcgtggtggctggcacctgtaatcccagcactttgggaggccgaggcgggtggatcacctgaggtcaggagttcgagaccagcctggctaacatggtgaaacctcgagtctactaaaaatacaaaaattagccgagcgtggtggcaggggcctgtaaccccagctactcaggaggctgaggcaggagaattgcttgaacctgggagttggaggttgcagtgagctgagatcacacctttgcactccagcctgggtgacagagcaagactctgtctcaaagaaaaaaaaaaacaaaaaacaaaaaaacacaaacaaaaacacccttctgacaatatccattttagctggtgtgagatagtagctcatggtggttttcatttgcatttccctgatgattagtgatgttgagtaccttttctttgtttatttttttgtttctttttgagacggagtctcactctgtcacctaggctggaatgcagtggtgcgatctcggctcactgcaacctccggctcccaggttcaagcgattcttctgcctcagcctcctgagtagctgagattacaggcattggcgaccatgcccagctaatttttgtatttttaatagagacggggtttcgccatgttggccaggctggtctcgaactcctgacctcgtgatccgttcgcctcagcctcccaaagtgttgggattacaggcgtgagccactgcacccggccgactaccttttcctataagcaccttttcatatacctgttggccatccaaatgctaagtgcttttctcggccatgtttatgtgtggtaccttattttttttttttttttaaatgcacatcccttccttggctgtttgaatttgagatggtgttttgagaattcccccaagtgggggatgggtgtattttgattctttatttgtttgtttgttttttgatacagggtctcactctgttgcccaggctggagtacagtggtgttatctcggctcactgcaacctccgcctcccaggcccaagtgtttctcctgcctcagcctccccagtagctgggaatacaggtgtgcagcaccacacccagctactctttgtagagttggggttttgccttgttgcccaggttcatcttgaactactgggttcaagcggtccattcacctcggcctcccaaagtgctgggattataggtgtgagccactgtgcctggcctattttgatgatgatgacgattattattaatattttgagacagagtctcactctatcacccaggctggagtgcagcaatgtgatctcggctcactgcaacctctgtggcccgggttcaagcgattctcctgcctcagcctcccgagtagctgggattacaggcgcccacccaccaagcccggctaatttttgtatttttagtagagacggggtttcaccatcttggccaggctggtcttgaactcctgacctcatgatccacccgcctcagcctcccaaagtgctgagatgaccggtgtgagccaccgcgcccggccttgattctttttaaagccatgagagtgaaatgaacgctacacagagctgagcctggtcactgcctatgcccctatctcctcctttctaccctaagctgctgtgaaacaccttgttattacctctgccaagggctggggtatgttgaaatttcatagccggcattgcaggatccctgtgattttcaggaacacactcccacaggggctcccgctcagccagagccaagcccagtgtacaatgtcacagagtggcagcagcctggccagatcttttctcctcattaggatctgccttggggcaaaaggattggtttctgtgtagagggataattaaggaattagagacaccgaggggttgaggaggaattatttaattatttatttgtaccgaccccgtcggattaacatttaaaggaccgagttttgaacaaagagtttggttattttttaagtattttctggggcggggggagctctgtgtagggggaagtatatcatagaagtgagaaacaaagacagttgtttaattgacacatgcattatattattttttattttttaaggaataatatgttttatgatttgagattatttgcctagtgactttgtagctgtatagctagagaagcagagtttttataatgcttgggaaaggaagagacaaggcttattagccgcagaaaaacaggcagttaatttttaatggacttcaactctttctcttcctcagggagaactgggttttcttacatacaactgagtttttgcttatacatttttaaattttttaaaattcctgtttcatctgtgacagggggtcctattccctgccaccttggcccttcctcatttgcagcaggttttcaaaggagtggcattttctaacacaatgaatccaaaagtgccttctccgggcctgtcacatcagcatttccggggagtaaacaagaaatgcaggtgcccagggcccatctgtgaatcggggcctctgggggtgggggcggggccctggaatctgcattcttatgaggccgttaaatgatccccacgcaccttcaaatggtacacttgctgctgtcctgaaggcattcaaccatcaatctggagcccaaagagaagtttctggaaactgacaagtgaggcattcttttctcatgactttttgcttttaatctgaacggcttaaaaactatatatagttccccaaaattcacatatgtgatccacctaaccaaaatgacagccaagaaacaatgatttataatcaccaacttaattttattagattctgaaaatgtttcagatttagacaacatgaattttgaccaataattttttttttttttttttgagacagagtttcactcttgttgcccacgttagaatgcagtggtgtgatctcggctcactgcaacctccgcctcccgggttcaagcgattctcctgcctcagcctcccgagtaactgggatcacagacacccaccaccaggcccggctaattttttgtatttttagtagagatggggtttcaccgtgttagccaggcttgtctcaaactcttgacctcagatatccacccacctcagcctcccaaattgctgggattacaggcgtgagccactgcatctgaccacaataacaaatcattgctgttttcttggaaaagtttgtgtaggatattcgatcatcagtttttaaagtgcagtgttttgtggacaagtagcatgacgaatacatgatttgtccccaccattaaaaaatgttagtttacttgtggcatataaataccgatggcctttaagccaatcttacagaaaagaagaaaagaatcgtttgcactttctgtggctgtttaaaagctttaccatcttgtaagagggtgggaagatggggtgtgccgtggagatggttaatgggcacaaaaatatactttagatagaatgagtaaggtctcgtatttgatagcacaaaagggtgactacagtcaacaatccttcatggtccatttaaaaataactaaaagttgctggacatggtggctcacccctgaatcccagcactttggaaagccgaggcaggtggatgacttgaggtcaggagttcgagaccagcctggccaacatggtgaaaccccgtctctactaaaaacacaaaaattagccgggcgtggtggtgcacacctgtagtcccagctacttgggaggctgaagcaggagaattgcttgaatctgggaggcggaggttgctgtgagctgagattgtgccaccgcactccaacctggactacagagactccatctcaaaaaaaaaaaaaaaaaaaaagaaaccaattaaaggtgtaattggaatgttagtgacacaaacaagtgatgaatgctcgaggggatggataccctatttgccctgatgtgagtattacacattgcatgcctgtatcaaaatacctcattatcccataaatatatacacctactatgtgtgcatgcaatttttttttttaaaagaaaaaagtttaaaatctgaacaggtttggacattcatcagtggtggccctggtatgtccactgctgggggactctccagtccttgatagatgatgctgaggcccagctgggtggggacatttcggctgtggccattgagcctttacctcgactgagtctgcctccaggctcaggagcccccagatccgtggtccagccacacggcagggtctgccctctgcctgtgagtggtatctgctgcccacaacatcttatggacgaccacagctcctacaggcatcccttccctcctcagctgagacctgggcacacctccaccaaacccgtacgaaccttgctctaaattgtgcttctctctggactggcctgcacctgctggaactctgattcttgtccccacaacctccagttgcccagcgagggacagagggagctgaatgtgctgtttcgttcttgctctgctgggatcccggcatcgggtaaccccggttcagccatgtggatttatttttaagcaagtcggctcacgtcctgactccaggagcacagattgctgtggagtgtcagtcacacaattatttcaacatgctgggcgcctgtctagcctgctttcccctcctgcctttcctgctctcaattctctctccttagttcttgggttaatactctggcctgcgtactttgttgtactttctgtctttgaagtcgtgctcctctgagatcccacgctgggcagggcatgggaagctacgtgcccacagaaggacggctaattgagctctcggaattataaatgcgcgattgttttcaggaatctgggcgagatggctcatttcccaagctagggattttccagggaagcgttttcactccttatcatcacttagccattgtgcccacacctttgtggctcctgggtaattatgtgctgatgaaagctgtcttacttagaacaaatagtctcattcacttaccgaaactcctccaaatataaataaatcaaaccccagcggctccatgaaagcaaacacagaaaggcatagccgtgttcaaatgaactcagatggggagagataaccagttaaacactcttaaaagcactgaaggcaggcccattctcttttgcagctcgtacatgccatggtggaacccctgtaatcctaaatcctaagagagatcagactagacacgtgctgtgtatcctctttggaaggtgcacggtgtcctcattttctataatgattgtgtaactttaatcacaaacagcatcttctgattcatttagcttcctggctaggcacgatggctcacgcctgtcatcccagctctttgggaggcctaggcgggcagatagcttgaggtcaggagtttgaaaccagcctggccaacacggtgaaaccccatctctactaaaaatataaatgttagtcaggtatggtggcgggtgcctgtaattccagctactcaggaggctgaggcaggagaatggcttggacccgggaggcggaggtttgcggtgagccgagatcatgccactgcactccggcctgggcgacagagaaaaacttcatctaaaaaaaaaaaaaaaaaaaagcttcccaaatattattcttccagtagcttgtgccgtcttcatcagaagagggactagctgtttggttcatgtgcttccacccagttattagaccaagtttgttttcaataaaagaaatcactggtcaatgccttctgtaattgatgggtgtcaagaaggtaaattttgcacgccgccttgggaggcacttctactttgaaaatagatctttgtgaaccatcattttggcctatccaatgacctataaaatacttgaatttatcatgaaaacagaatactgtgaaatcaggatgaaggttgataacaggtcatcaacgtaattgagtagattgaaaatacaagagtcagtgaagtgtaggatgaatgcttgttgtcagtaagagagctctttgtgacccgttccacgtgcaagagatgagggttgttgttttgggaatactcaccctcctcatcgcctgtccctgctaaaatcagagctttgtgagggcagagatggattctgtgcacaggtatcttctgagtctctgattcagtgcctgaaacacagtggctcccgagacaatctacctcagtgcctgttttacaggctcacctgtgacacatgactgggacatatgttattcatgatgacatgcaagagtctctgtgtaggtgtctactggtcttcatcatcaaacagagcgagaactccaagtcaggaggcagacatatcttggggcaagaagacacctagaatttttcttcaacctgtagactttcggattgggtagaaggattgttaaggaggttgcgaaacttggaaaaaggatgatgtgagtgttgatggcatggaattctccccacacccctgggtatccatttttaatgtacagaattcttgtgacatgattttagggcatagaatccttgagagatcatgtctgtgctgaagttggaatcacagcactttatgtgaatgtgttcgccaacgattaattatgtttattcccgagaagttttaaccagattgtggatgtgtattctggttcagcatatattcacaattacctttgttttttgttttgttgttttggagacaaggtcttgctctgtcacccaggttggagtgcagtggtgtgatcatagctcactgcagcctcaaactcctcagtaggaaacttcctaccccagcctcccgagtagctgggactagtagcatgcaccactacacatggctaattttgttttttaaattttttctagagacggggtctcattatgtcgcccaggctggtctcaaactcctggcctcaggcgatcctcccaccttccaaagtgctgggattacaggtgtaagacaccaagctcagcccctgtgtttttttgtttttttttttttttttgctttttgtttgtttgttttgagacggagtcttgctctgttgcccaggctggagtgcagtggtgcgatcttggctcactgcaacctctgactccctggttcaagccattctcctgcctcagcctcccaagatgctgggattacaggcgtgcaccatcacacccagctaattttttgtatttttagtagagacagggattcaccgtgttagccaggatggtcttgatctcctgactttgtgatctgcctgccttggcctcccgaagtgctgggattacaggcgtgagctatcacgcctggcctgtgttttttttttttttaaacataaaatggcccttattgactgttttccttttcatagtgagtccttttgtttctttcatgttttcgagaagtgtcccgagtcaggctgtagacaggcatatgcgtagataaacagatagactcatgcgttcctgttggtaatttttccttgaggtcaccgtatgtgttctcatgcgtgggcatagatgtcccacactctctgaaagtttaattggtcctcgcaggtctcattgtgttccttctcttcagggctcttcatatctcagggtggtaataaccttccaaatctctatggccgaggcgggcagatcacgagatcaggagatcgagaccatcctggctaacacagtgaaaccccgtctctactaaaagtacaaaaaaaattagctgggcttggtggcgggtgcctgtagtcccagctactcgggaggctgaggtgggagaatggcgtgaacccgggagggggagcttgcagtgagccgagatcgcgccactgcactccagcctgggcgacagagcgagacaccgtctccaaataaataaacaaataaatagaaatacaaaaattagccaggcatggtggcgcatgcctgtaatcccagctactcaggaggctgatgcaggagaattgcttgaacctgggaggcggagttttcagtgagccgagatcgcaccactgcacttcagcctaggtgacacagcgagagtccatctcaaaaaaaaaaaaaaaaaggaatatgcatttaacgtttctttgcgtcttttcgtggctcgatagagcccagtatatattttcactaaagagcaaaagcgcctttccatgggcctttaaatacttaagaataagcacatccacacatgggcctcccagatagtcggtgcgtttccagaaatgacggtgtgttgtggttcacagcctctttgggttttggtctccaactcccagcctcaggcgatcctcctacctgagcctcccaaagtgctgggatgacaggcacagtgagccaccatacccagctattttttgaaaactcatagtctcatatttccctaatatttagggttagggctagagttaggtagaggttagaggtgctctgacgagtgtttcccaagtcttggagcccacctctggccaaatcaccgcctgcagttggaagcaaggctgtttctgagatgagtcatactgacatattttgctattgaatgcacggttgccctgatccattcagagatacttctgcagcaccatgagctccttaatccctgcccctgttcacctacaagggtctgcaagcgagcccccttccgcaactcatctctttgtgtaatccttctccagaccctgaatatatcagcctgttggcatatgtatctatgtgtgtgagatcagcctgttggcatatgtatctatgtgtgtgagatcagcctgttggcatatgtatctatgtgtgtgtgtgtgtgtgtgtgtgcgcgctctgaggatattggcactttttaatcttcttccattagacgacaaggctgagggcttccacttgccgccgacttgccggcacacctggggcatgtttaataagtaattgtgtatggtctgctttgcaaatgcgctacttcacatttttccatcccgcccgtaacgaggactggggttgttttacaagttaattacccaaaagattatcgagtgggtttagaggcacaaattctacgcgctatttaacagataagaattaatgagtgttgttaaaatgggaaaaaaaaaatgtctctgtcagtggagggagttatctctaccctgcctggctgtgttactgttgtttttttttttgtctgtgaatgagaaccgaggtagagaaacaaggcgagtgttctcattgctcttctcccaccagagcacaggcggcacgtgtgaaaataactattcacagtttctttcccaccgtgtctcaagaggggtgaatgccagggtcgggcccggtggctcacgcttggaattccagcactttgggaggctgaggcaagaagattgcttgaggccaggagttcgacagcagtcagggtggcgtagagagactccgtctctacaaaatattaacaaatcagtctggcttggtggggtgcactgtggtcccagctactcgggaggcagaggcaggaggatcgcttgagcccaggacttcaagaccagcctgggcaacatggcaagaccttgtctctacaactaaataaaaaaattagtcaggcgtggtgtgcgtgcctggagtctcagctactcaggaggctgaggcaggaggatcgtttgagcctggaggtcaaggctgtggtgagccatgatcgcgaccctgtactttagcttgggcgacagagcaagacccttttctctaaataaaaatggaataatagtaaaaagaagctgaatttcagctgttttcagccattctctttattccttcaaatgcctctgtattctgcagtatcctttaaaatattaagagcaattttagctaatcaggaggctgagacaggagaatcgcttgaacccaggaggcggaggttgtggtgagccgagatcgtggtattgcgctccggcctgggcaacaagagtgaaactccatctcaaaaaaaaaaaaaaaagggagacacagataaggccatgtggagacagagactggagtgatgcggccatcaacttagggataccaggagctggaagaggcaggaaggatgccccctagagtcttcagaaagtatcagacacctttgggaggccaaggcgggtggattgcttgaggccaggagttcgagaccagcctggccaacatggtgaaacctcatctctactaaaaatacaaaaattagccaggcgtggtggcgggagcctgtcatcccagctcctcgggaggctgaggctggagaatggcttgaacccgggaggctgaggttgcagtgagctgagatattgccaatgcactccagcctgggagacagagcatgattctgtctcaaaaaaaaaaaaaaaaaaaagaaaaagaaagaaagcatcaaacacaattgcaaggggttgaatgctgatctccaaaagatatgtccatgtcctaatccccagaacctgtgaacaggaacttatttggaaatagggtctttgcagatgtaattagttaaggatctcaagatgagatcattctggattagggtgagtcttaaatccaatgatagctgtccttgtaggagacaggagaggagacacagacacagaggagaaggccttgtggagacagaggcagagactggagcgatgcggccacaaacccagggactcctggagcccccaggaactaggagaggcagggaggccccttcctgagagcccccggagggagcatggtcctgagacacctgatctcagacttttggtctccagagccagtagaggatgaattcctgttgaattaagttccccaggtgtggtcatttgtcacagcagcctcgggagacgagtagagacatagatcgggcaggaatagaatatctagttgcattgctgatagaggcatactacagctgtgtgacatggtgtgacatcagcacactgtgtcctgaccccaggtcatgggacaagaacttggggagacatagtcacccccctggctcatcagggaaatgcatggcttccggtaaggtgaccctgaacatgcgtgtgtcactctgaagtgttggcctcagactctgcctccaaattccaagtcccctgggggttccgctggaggtggacacgcccccatccatgccttccttgcagtcacgggaacatcccttactcagtcctctctggtcaccgatggggcatgacaggaggcgctacatgtttccaagcagccggggttccagatgcttggaaattctgcgtgcggcctctctatgggaaaaagggaggtctgccaggagtggaaccccagtgagaaagtaaactcaaaacagaaatgaaaggtttctagacacagtacaagccccctttgtggtgcgcgcagggacttacgtagctcggcccctccaccccctggctggccccagtggccgaggtgtgttgggtgctgatctgtgacaccctcctgcttcacacgggcagggaggggttctggagagagtgcaggtgggctggagagctgagctccctgcagcaggtgagtgtgagtcctgaacagactcgttccaaggaaacaggtgcaggaaagaacacaggtcttggaggaatcagggttgagccagccctgtgacctcgggctgtccttggccccagtgatggcttatctttacctggaacttcaacctcttatcatcacctataacgctgaccactgatcctcacctgggactcgaacctctccccatcacctgtaactcggaccacttgtcctcacctaggactccaacctccctccatcacctgtaatgctgaccactcattgtcacctggaagtccaacctctcatcactacctggaactccaactccaactcttttttttttttttcatgagacggagtctcactgtgttgcccaggctggagtgcagtggcacaatctcggctcacggcaacttccgcctcccaggttcacgccattctcccgcctcagcctactgagtagctgggactacaggcacgtgccaccacgcccatctaatttatgtatttttagtagagatggggtttcaccatgttggccaggacggtctcgatctcttgaccttgtgatctgcccgcctcagcctcccaaagtgctgggattacaggcgtgagccactgtgcccggccccaactccaactcttatcctcatctgtagctctaacctgttatcctcacgtgtaaatgtgatgtcatcctcacctgtagctgtaatctcatcttcacctggcattctgacctcttaccctcacctgtagctctaaccggctatcctcaccgatagctctgacatcatatcacctgtagctgtaacctcgtcctcacctggaactctgacctggctgacgtgcttgcagcatgtgggtggggccgatttccctcctgccccagctccctgctgctgccaagtccaggtctctcctgtggggcaggtatacccctccctgggtctcagctgggcccactggccttcacagggagcctgctgtctgcactcccattcttgtcctgccctctcctccggcgccctgtctgctcagatgtcctcatggcctaggcacctgcagccgccaggacagtgagcccggacacaagcagccttccatccggttccccctgcatctgccaacccatcttgcccacagccaagcttctgtgaaaaatcatagcagtcatgaaactcatgagtgctcgggcaaatcagaaaaattgccagggatcctaccatggacacgcgtccctgaaccccgaatggtccctgtgtgttgtgtgtgcgcaggagacgggcaggtcactgtgtgtcgtgtgtgcaggagacagggaggtccctgggtgttgtgtgcccaggagatggggaggtccctgtgtgtcgtgtgtgcaggagacggggaggtccctgtgtgtcgtgtgtgcaggagacagggaggtccctgggtgttgtgtgcccaggagatggggaggtccctgtgtgtcgtgtgtgcaggagacggggaggtccctgtgtgtcgtgtgtgcgcaggagacagggaggtccctgtgtgtcgtgtgtgcggaggagacggggaggtccctgtgtgtcgtgtgtgcaggagacggggaggtccctgtgtgtcgtgtgtgcagaggagatggggaggtccctgggtgtcctgtgtgcgccggagacagggaggtccctgtgtgtcgtgtgtgcggaggagacggggaggtccctgtgtgtcatgtgtgtgcaggagatggggaggtccctgtgtgtcatgtgtgtgcacaggagatggggaggtccctgtgtgtcatgtgtgcgcaggagatggggaggtcgctgtgtcttgtgtgtgcacaggagatgggaggcgtcaacacacatttcatgctcacatttccattcactgtccacactgcacacttgtacatggtcaatgtctagacatttatagtttgtttatgtgttatattcatctactttatatatattcatattttaggttcatatatttattgtatacacatttatatatttgatctatattaatattttaggtttatatacttactatatatttattattataaagcatatacattaaattataatgtattattatatatgatgtattatgttcaatgtatatattaaatacataatgacataatatgaatttatattataatgtatatacatatgaattcacattcatatgtatgttacattttgtaatgtatatatattttgtaacatatatttgtaatataaaattatatacaagatatactttgatatattttatttatatatttatatataaaacataatataatatgcacaatacattttgtgtatatataaaatatatattacataaatatataatgataactataaattatatttgtgtcattataaataatttatattaaatatttatgctattctataaatagtatatatatttagtatatatttttatatcatactttataataaacacgaatttataatatataagtataaactatagttattggatgtttaattttatgtatatattattttatatatatcatactatgtaacacataatatataataaatataatatataataagcatatatcataatatataatataaataaacattgtaacatataatatataatacatatatatcagtatacaaaatataaaattaatatatacataaaattatatacctacttattttattttattttttaagagacgtgagtcttgctgtgttgcccgggctggctttgcctctggaactcaagcgatcctcccacctcagcctctcgaggagctgggactacaggcgtgcaccatcatttcctcctaaaattgtatgtgctgcatatataaaatgataaatgctttacatatactttatgaaattatatatgctttagataaaagcagaggtttcataaaactgaactgtaacatgcatggcatttaaatcccattgaagtgaagggctgggcttgagggtagcgtcaccctccctgaccgtcatacccatttccatttccccaggaaggaccaggatgctttgtttaagcagcacgtttgaattgctggcattgcctgtggcctccctgtggcgagggatggtgaacgacagcgttttccctcctccttcctcaccttgcaaacctcacttcgttggatgcataattgctgactcatccccatggatcgccttggactgtgtagcaatcactgctcttttcacagtccctcttgaatttctttcctttttttttcttttagtcggaatttcgctctgtcacccaggctggagtgcagtggtgcaatcttggcccactgcaaccttcacctcctggattcaagcaattctcctgcctcagtctccccagtagctgggattacaggtgtgtcccaccacacccagctaatttttgtatttttagtagagatgggaatttcaccatgttggtcaggctggtctcgaactcctgacctcaggtgatctgcccacctcggcctcccaaagtgctgggattacaggagtcctcttgaatttcacttaagatgggctgggtgcttcgtggcaggcttttcacatcagcctttgcatttctgggtgtgacccctgtgtctgctgccttctatattcctctcttacttggcaggattccacccctaggtgggtttattttttcccccagtcccctgcctgcctgagaattcctacctatggctcctcctgggaaagggctcttggctgcgtcttaaatcttgggttatgccttggtgcatactggtgttgcaccagtggtgcaacgttgccggcatcccttttgcctgagggcaggtcacttgtattctgtcttgaaggaacctgacttttaaggagggacgacctggagagtttctttattattgaacttcactgactccctgaggatagactgatcctgccaaattcttgggtccccaataaaacagcattccatgaaataaaaagtaagaacagatggcaccaggaattccactgctgggtatatacctcaaagaattggaaacagggtctccaacagatatttgcacaaaccacgtttgcagcagcagtattacttacaataacccgaaggtggagagaaactgtgtccttccagaagcaaatggataagcagaatgtggtatatccaaacggtggaatattacgcagccataaaaaaggaagggtattcagatgcatgctgcgatgtgggctaaccttgaggacattaatgctaagtgaaataatccaatcctaaaaggtggagagaaactgtgtccctccacaggcagatggataagcaaaatgtggtgtatccaaatgatggaatattacacagccataaaaaaggaaggatattcagatgcatgctgcaatgtgggctaaccttgaggacattaatgctaagtgaaataaaccaatccccaaaggacaaatactgtaggattccactcctatgaggtacacagagtacctttaaatttttagagacagaaagtagaatggggtagttataggggttgggcgaggaaaaggtggggacttaatgtttaatgggaacagagtttccatttggcaagatgaaaatattttggagatgcatggcagtgatggctacataacaatatgaatgtatttaataccactttactgtgtacgtaaaaatggttaaaatgctaaactttatgtgatgtgtatttttccacaattcaaaattataaaaaaaaaaaatgcagctgggcatggtgactcatgcccgtaatcccagcactttgggaggccgaggcgggtggatcacctgaggtcaggagtttgagacgagcctgaccaacatggagaaacctcctactaaaaatacaaaattagccgagtgtggtggtgggcgcctataatcccagctatttgggaggctgagcaggagaatcgcttgaatccgggaggcagaggttgtggtgagctgagatcgcgctattacactccaggatgggcaacaagagcaaagctccattaaaaaaaaaaaaaaaaaaggttaaaatgctaaactttatgttatgtgtatttttccacaattaaaaattattttaaaaatgaggccgggcacggtggttcatgcctgtaatcccagcaatttgggaggctgaggcgggtggatcacttgaggtcgggagttcgagaccaccgtggccgacatggcgaaaccccttctctactaaaaatacaaaaactagcctggcatggtggctcaagcctgtaatcccagctcctcgggaggctgaggcagcagaatcacttgatccccggaggcggaggtcgcagtgagccgagctcatgccactgcactccagcctgggtgacacggcaagaatccatctaaaacaataaaaaaaaaataaaataagtaattgcccttaaattggaaatgctcaacaacccacgtgattctgaatctgaaaaggccagatcagggagatacagagaagaataaataaaacacaaggcaagagaagatttatctctggagcatccttgtgcagctgttggtgagtgactcgtgtgtgtcaattgatcatacactcatgagtggataaaagtacccatgttttaggtcaagaaagactgtgacacacgtgtccagcacgccaagcacacagcccgtggggtgtcatccatgtgctgtgccctccctgtctccctctcccaagctcctgcatggaaacagaggtggacacgaaacctacctacccaccccctcccaggttaccgccatcactttcatcacaaaacagagtctggattcagggattcagcccagggcaggagctcaggtcatcttcctctttcagaagggagatttctgctgcctctggcccagcctttccctctctttccccccatgagctgccattggagcacccacctgggtgcaggtgagagagaggaggaaggagaccaggtgaccccttcctggctggttaccctatgtcccggtaacagacggttagagctgattctcatggcagaagcgtgactgccagagaccacctgcggcgcttctaatgctctggtccgtgtattcgtcttgtagcgttgccgagtgttacagagatccacagaccaggtggtttaaacaaaagatacttattctctcacagctgtagaggctacatgtctgaggtcaccgtgtcggtaggcttgctttctctctggcttgtagacgccgtcttctccctgtgtcctcacagagtccttcctctgtgtgtgtctgtgtcctcatctcttcttatgaaatgtcttagtctatttcaggctgctgtcacagaataccataggctggatgacttacaaacaagacatttattctcccacagtcctggaggctggatgtctgagatcagggtatgggcaaggctgattcctcctgaggtctctctcctggacttggagatgctgtcttctccctgtgtcctcacagagtccttcctctgtctgtgtctgtgtcctcatctcctcttcttatgagatatcttagtccatttcaggctgctatcacagaataccataggctgggtggcttagaaacaatagacattgattctcccacagtactggaggctggacatctgagatcagggtatgggcagggctggttcctcctgaggtctctctgctggacttggagtcaccgtcttctccctgtgtcctcacagggttgtccctctgtgtgtgtctgtgtcctcatctcctcttcttataaggagccagtcccattggatcagcctccccccaaccccctgaaacctcattttaccttaattgcctctttaaagaccccatatccaaatatgatcacattctgaagtcctaggggtgaggatctcaatgtatgaatttgagggggacaaaattcagcccatgacaaccagtgtttctttccaaggggctacctgaaaacgtttctgcaacccccagcaagctggcatcgtctcagcatcttgccatggggttccctccatgcctcccaatggctcctttgagtaagaccaaggacaaacccataccactcccttctcctgttttctctgccctcattgtcccctcaagccctgaggctgatcagtccccacaggaccacagctaccctgtagctatgagcagtggcttcctcaggagtgagccaggctcctgtaccccatgcctccctggcacagaacaagatttaggttctgggggtacctgagggaatcccgttttttttttttttttttttgcaggggagggtggaggctcagagtagggaatttttttttttttccgcctgctgtgaggaaattcacccctgttatctgatccatgcacactctggagctggctgaggtcctaactatttcctctgtaaacttctgcccttggaatgggttctgcgatgattaatacttagagtaaacttgattggattgaaggatgcaaagtattgatcctgggtgtgtctgtgagggtgttgccaaaggacattaacatttgagtccgtgggctgggaaaggcagacccacccttaatcatctgggtggccaccatgtcatcagcaggccagcgaggctagactataagcaggcagaaaaacatgaaaagactagactggtctagcctcccagcctgcatctttctctgtgctggatacttcctgccctggaaaactggactccaagttcttcagctttgggacttgggctggcttccttgcccctcagcctgcagacagtctattgtgggaccttgtgatcgtgtgagttaataccgaataaatgcccctttctatatatctatcctgttagttctgtccctctagagaaccctgaccaatacagggtccgttccttaccccctacatctataaccctgctgcctcagttgatagggaagcagaaagagccgcttttttaatgtttaattttattaagtttgcagtttcccagtgcccaaactcatgttgatttcaaaaactgtccttttaaagcatgtgggcagggtgacaattcatagcaggtgacaaaaatgttttataaataatatccatggaaatggaagctgtcactgtctgcagaatgcagccaaaatattcagaagatttgtatcactctaagttctcgtgctagtaagaaataaaaaagcaaatgatgactgggcctctaagaaataaagtaaaattaggaagcaggagtatgaaaataatgacattgtgcagaaataaatacaaaaggaaagtagcagagaagcaaaaaaaaaaaaaaacaaaaccatcaatagtagtttccttaagaaaaatgaaagaataatatcccaccatttattcatccttcattccacacacaaaagaagcaaggacagattagcatgaattggaacaagaaagaggaaataacatgtaataaaaatatgatttaaacttatgcaaaaaaagtaatttattcttaactcaactaacatatttgattacctcctcctgggcaaaggatgaaaggctgtcttattgcaaaaaattagaattttgctaaattcatgcaaatggaattacagatcacagataaaacaacatgctgaaatttcaaccgtcagaactttccaccaagtgttcctaatgaattcttgaatatctggttgggtgcagtggctcacgcctgtaatcccagcactttgggaggctgagttgggcgggtcacctgaggtccagagttcgagaccagcctggccaacatggtaaaaccctgtctctactaaaaatacaaaaattagctgggtgtggtggcacaggcctgtaatcccagctacttgggaggctgaggcaggagaattgcttgaacctgggaggtggaggttgtagtgagctgaaatcatgccactgcactctagcctggtgacagagcaagactccgtctctctgtctctctctttctttctctctctctctcacacacaaaataaataaataaataaataaataaataaataaataaataattgattatctatatactttttccaaaccatcaaggacaatctagatcaagaatctggaaactgttgaccctggaacatatctgacccttaacttgtttttctcattaaagttttcttgaaacacagccatatacattcatttacttattgcctgtgactgtttttgccttaggtacacaggtttgaagagttgcaacagagaccttatggcccacaaatcctaaggtgtgtagtatttggccatttatccaaaaatctactggctgtactcttcaaagtgaccagagccaccaacctgtgtctgagtaaaccgttttactcccaaatgaacacttttcaaagaagcatcatcggctggttctacttaccaacctaaataaagaaaatctagtttaatcttatccactgaatagacttccaggttaaaaaaaaaattactcctgacttagttgcaactcatccacctgtagaccaaaggatgcttctcattaggtaacagggaagcatttgggataattcaacatccattaattagtaaacctctgaaggaattaatctcataacagcagccggaatgcaggagatgctctacacccgaatcacaaattgaatggatggcaagtggattttccctcctaaggctgattgattggttctggctgccagcaccctgagataagaatgatcctgcagcaaggaatagtcatcaattagtgatgcctgctgtggctatggaatgagaattacggtctgtgtgctacattctttccattcttggtggttctctcataaaccacaataaagcatgcatcttttaaagcaaccatgaccatcactagccaccaccatagccctctggctgattcatggatgaatttccaaattcaaatgtgaatttccagtgtcacatttgtgttcctttccctaaatgatgatgatggtgatgatggtgatggtaatgatggtacttgttggatgtgtgtatgtatgtatacacacacacacatatatatacacatacacacacacacacacacacacacacatatatatttgagatggagtctcactctgtcgccaggctggagtgcagtggcacaatcttggctcactacaacctccgccttccaggctcaagcgattctcctgcctcagcctcccgagcagctgggactacaggtgcgcagcaaatgtatatatatatatttttttttctttttttttttaaatttatttattttttattattatactttaagttttagggtacatgtgcacattgtgcaggttagttacatacgtatacatgtgccatgccggtgtgctgcacccaccaactggtcatccagcattaggtatatctcccaatgccatcccccccctccccccaccccacaacagtccgcagagtgtgatgttccccttcctgtgtccacgtgatcccattgttcaattttaaatacaaccaaataagcttgcttcttgcctgtgtggaatttatagtccagctggagtgaggaattaaataatcatccacttatctgagtgagcaaaattatgataaacactcttaaaaagtgtcctttaacagctgtcttgaaagattcaattccatcctctcatgaggttccaccctctgggtttgctttctccaagacctaccctcctgtgtggcttctttcttgactgtttcttttatgctgcctttcctcagcgtttcctcgtagcatctcacactacacacctttccttaggtcttgcaaccacgtccgtgttctccaaaactctgctctgctagttctcaccaatatatttgtttccaaactcctgcctcctacacctccctgcttccacagcaagtgcaggaatgtatttgacattttccttctctctgtgtaagtcagtggactaccatcctctcagctgcctacagtcgatcctagagtgtctgagatgcttttctccaccttggcattcctctccctggtggcaactgagagctctgtagaccacctacatgcttatcaaaaacactccgtcattttcggtatcactccctacagcaggtcacacctatcccttacctgcttcataactctgcttcctggctagtctctcggcttccaggtttccctccctgaactgtctacactgcagtcagagagatcctgctgagtcacactgttgtcttaacctgcttaaacccatatgggcagaatgcccttcatgcctccacctgtttgctgtagctgtgcacatgtggttcctggttcttgagaattcttcccctcctctgcctcctgaccatccaagtccctttcatgctagtcttctcagcttttatagcatgctgtaaagcagttgtcctgaagccaggtgccttacaactccctgctcccttgggacacttaatcccttctatcgccaacctcacacattgtatcgttggttgtttaattgtgtcactgatttccccagccccatgatggtccatggaacatcactgggatataaaaagtactggccaaaggaataaaatacaggaaaatattttgtgcattgtgggatctcatgaatgacagctgccacaatgatgatgttgatgataatggtgattctgatggtgatgatggttgtgatgatggtggtagtgatgatggcaatgatgatgacagtggtaatggtgatgatggtgataattatggtgatggtgatatagtaatgactgtgatgatggtgatgatgatgatgatggtgatgatcatgacgatggtgatgatggtgatgataatgattatgctgctgctgctgatgtgataatgatgatggtgatggtgatgatggtgtttatgatggtgatgatagtgatgatgaaaatattggtgttgatgatgctgatgctgatggtgatgatgatggggtgatagaaatgataatgatgatggtgatgaggatggtgatagtgatggtcatggtcatgtgatgatgatgatggtcagtgatgatgatggtcatgatggtgatgacaatggtggtggtgatagaaataatgatgatggtgatggtggtgatgctgctgctgctgatgatggtgatggtggtgatgatgatgatggtgatagtggtggtaatagaaatgataatgatgttggtgatggtgatgatgctgctgatgatggtgatgatggtgatggtgatgatagaaatgataatgatggtgatgatggtcatgctgctgctgctgctaatgatggtgatgatggtgatggtggtgatgatgatgatgatagtgatgatgatggtgataatgatgatggcgatgatgatggtgatgatggtggtgatgacggtgatggtgatgatgatggtgatgatggtgatggtgatgatgatgatgatgatagtgatgatgatggcgatgatgatggtgatgatggtggtgatgatggtgatggtgatgatggtgatgatggtgatggtgatgatgatggtgatgatggtggtgatgatggtgatggtgatgatggtgatgatggtggtgatgatggtgatggtgatgatggtgatgatgatggtgatggtgatgatgatgatggtgatggtgatgatgatgatggtgatgatggtagtgatgatggtggtgatggtgatgatggtaatgatgatggtggtggctatgatgttggtgatggtggtgatagtgatgattatgaaaatggtaatgattgctgttcatggattctgtgaaagaaccaaccccttttcctgaaacaatcttgctctacttgactatctgtggactgttctgtgtccttcctcccaagtctctgtggcttgcatgtcctccttctggtgggtaggttggccaagtctgacaccctcaactctgccctccttccatagctaacaacagccctaatatccgaagactcagggattctgctgtcagctcccttggctcagccaagcaaagactgtgcttgtgggagcccagaaagagggaatggaatacttctccagagagtaggtgttgcatttctgaatattgtaattaagccagatgagtctaggcaggcccacaggacctcttcaggcatcttcttgtccatgttttgcactatgcaggagaagtgatgctgtcagccatgcaagccatggccccccatacagcagactctcctacgaagccatgtagcttgcaaacaatgccatgttttagtttcatgttacccctcctgcagatttgcacatctaggctctgcttttaaaataatcatgcacctgtcaggctggaagttttcaggaaaatccttctcacctcatgtgtgttgctggctttttttttttttttttttttttggttgtggcttcctgagaacggggatgctacagcctgccactgttggaacaaaggtgcttttagtcactctacctgtcgctcttagggaacgtacgtgccctcaggggaaataggcggatgcacattttgcttctggctcttttgcctctttatttttttcatttttatttttttgaggcagagtttccctcttgttgcccaggctggagtgcaatggtgtgatctcggctcaccacaacctctgccctctgggttcaagcgattctcctgcctcagcctcctgagtagctgggattacaggcatgcgccaccatgcccagctaattttgtatttttagtatagacggggtttctccctgttggtcaggctcacacttctggaggctagaagtccaagatcaaagcatgccacgttcagtgtctggtgaggacctgcttcctggttcacagacggtgccttctcactcttgtcatcacgtggcagaagggtcgagggagctctctggggtcccttttagaaggacactcatctcattcctgaggccccaccctcatgacctcatcacgtcttaaagggctccacctcttaacactatcaccttgtaggttatgtctcaagacagggatctggggccgggtgtggtggctcacgcctgtaatcccagcactttaggaggctgaggcaggcggatcacctgaggtcaggagttcgaggccagcctggccaacatggtgaaaccctgtctctactaaaaatacaaaaattagccgggtgtggtggtgcacacctgtaatcccaagctactcaggaagctgaggcaggagaatcgcttgaacctcggaggcggaggttgcagtgagccgagatcacaccactgcactccagcctggcgactgtgtgagactccgtctcaaaaaacaaaacaaaacaaaaaagcaaaagcaaaaacaaaacaaaacaataaccaaaaaatggggatttcgagaggacacagacattgaaaccatagcacatggcgaccttgagtctttgagtttacgtgtgcagcatgaatgctcggtggtgatggatgaagagagagcaaggggggaatgccacacacttctaaactgtcagacctcgtgagaactcactcactatcatgagaacagcaagggggaaatccgccaccatgatccaatcacctcccaccaggtccctccctcaacgctgggaattacaattcaacgtgagatttggatggggacacagagccaaaccataacagcagcaatagtaaactcatacatcatatctatacatctctcctgaaccatccctgctagactcagtaggacctgtagagaccatctttccctgtattccttcaacatcctgcttccttatcatatgtttctaaggttgtatagttccatgagagattacagctacttttttttttttaagacatctcatcctgcaatgcagtcttttttttttttttttttttttttttgagacggagtcttgctctgtagcccaggctggagtgcagtggcatgatctcagctcactgcaacctccgcctcctgggtcccggttcaagcaattctcctgcctcagcctcccgagtagctgggattatggggacgtgccaccatgcacagctaagctctgtatttttagtagagacagggtttcaccatgttggccaggctggtcttggactcctgacctcatggtttgcccgcctcggcctcccgaagtgctgggattacaggtgtgagcgaatgggcccggccaatgcaatcttttagcaggaaatccatccaggattttggaatcaacagaaaagaaaaaccttgggttttggagtctcagattctggcggtcctgctagatgtgttgacgagtgtgttgggccagttaattaccctcataattgttctaattgcttttatcctgcaaatatccctctgtgttcattagctttgccattacgactgagcccaagtggattaaagaaagcctgtgatgccaccagacatcatttttgtttcggcaaaacagctttctctaggaatctggccttaatgtgttttggatgccccccacactgacagggtccttcatgagctctcctggatagaataacacaaaaaactcaaagcccattttaagaaacagcagcatcattaaaaaaaaaaaaaaaaaaaaaaaacctccactgccagcccacaggtcgctcattttcttcctagaaataaattccagttgagtggacacgtcttttacgggggaatttcagtcgtgattgatcatccgttgacctgtttaaaatgattgtcaagtgactgggctatcctcattcacagataactcaggcaggctcagattaattaacccttcgtttgtttgccatgtaggactaattagtcatcatccatctactgggaatcagacgtcattggcacagttatcaaggacagggactttgccggcttatcatgtagaaggaagaattaatggtgttggtgatatatggtcttgtgtagtggtagggtattcctctccctcttttcttcatgttcttctttctttgcttgccacacattcatttacaggggactctgaagccacgtgagggttaggggcacgtgaagaccttgtgtaactcttcactcccccaaaacttaactaatagcttgctgttggctggaagcctttcctgcaactagacggtcccatctaggggtaatgggagacagtgacagatcatgaggcaggtcattattgcaccagacacaaataatatagtaatattcttacaataaagtaagccaaaggccgggcgcggtggctcacgcctgtaatcctaacactttgggaggttgaggcaggcgaatcacctgaggttgggagttcgtgaccagcctgaccatcatggggctaccccgtctgtactaaaaatacaaaaaagtagccaggcgtggtggtgcgcacctgcaatcccagctactcggggggctgaggtaggagaatcacttgaacctgggaggtggaggttgcagtgagccgagatcgcaccactgcactccagcctgggtgacaagagcacaactctgtctcaaaaaaaaaattaatcaagagaaaaaaatatagtatgtattatatactatattcttacaatgaagtaacctagagaaaaatatagtaaatattctatattatattcttacaataaagtaagctgtgattttccttaagaaaatcgtaaggatgagaaaatatctttactgtttatcaggtggaagtggctcatgataaatgtcttcatcctcgtcatcttgacgttgaggaggaggaggaagagaagggggtgtctcgggtggcagaggcagaagaaaatccacatataaggggacacccattcaattcaagcccgtggtgttcaagggtccactgtcataggggaggctcaatattttagtttcctggagctgctgcgacacaattctacaaaccagctggctgaaagccacagaagtcaaatctctgacagctctgaacaccagaagtccacagccaaggcaggctgaccacctggtcatccaagggcagagcccgtgtcaaaggacattcctggagcagaaagccaacacatccgggtggaaatacaaccttccagtcactaagtatatttgcaaatctccagcaggtcactattgcaccagacacaaagaataagcgttcagtaagttgaagtattgtgtgcacacggccgggcgcagtggctcatgcctgttatcccagcactttgggaggccgaggcaggcggatcacgaggtcaagagatcgaggccatcctggccaacatggtgaaactccatctctactaaacatacaaaaaattagccgggtgtggtggcacgcacctgtagtcccagctactcaggaggctgaggcaggagaatcacttgaacccgggaggcggaggttgcagtgagctgagatcatgccactgcactccagcctggcgacagagcaagactctgtctcaaaaaaaaaaaaaaagtattgtgtgcacactgcaattatgaaatgcatttcattctggagtattaaggcagggctgtgccccttgcggaggctctggaggaggatcctccgctatctcttctggcttccttcgctagctagcaatcctggttgtttcttgtcctgtagaacagaggactccaaccccctggctgtggactggtactgagcaaagcttcatgtgtgttcacagccacttcccactgcacgcattaccgcctgaggtcacctcctgtcagatcagcagtggcattagattatcagaagattgagaaccctattgggaagtgggcagaccagggatctgggttgcatgcttcttatgagaatctaatgcctgatgatctgccactgtctcccatcaccccccggatgggaccatctagttgcaggaaaacaagtttggggctcccactgagtctacatggcaatgagttgtattgtagaattacttcatttaacgtatcatcatagaaataaagtgcacaataaatgtcatacgctcaaatcatccccagatccttccccctgcactcacagtgactgtctttctatgaagacagtttttgtgtgtgtgtggaaaaattgtgttccatgaaactagtctctgtgccagaaaggctggggacggctggtgtagaagcatcaatacagtatctgcctttgtcgtggccatctctgtgtctctatgccacagtgttcctcttctccttttttttttttgagatagagtttttgctcttgtcacccaggctggagtgcagtggtgtgatctcggctcactgcaacttctgcctcccgggttcaagtgattctcctgccttagcctcctgagtagctgggactacaggtgtgcaccaccgtgcccggctaatttttgtatttttagtagagacagggtttcaccatgttgggcaggatggtctcagtctcctgacctcaagatctgcctgcctcagcctcccaaagtgctgggatgacaggcgtgagccactatacccggcctccaatgttccttttcttataaggacaccagttattcagttaacagcgtacactactctaatgcaacctaattgtatgcaatgacaacctagttgtatgcaatgacactactctagtgcaacctaattgtatgcaaagatctgatatccaagtgagctttcattcctaggttctgggtggacacatcttggtgaggtcacagttaaacccacgtcacccaaggctaggggcagaatcagagtggatgttagatctccaggctcttgttctgggagtgtcattcaaagcctttcttcatggccacctgaatgacgatgtcatcctctgtgggtaacagacaccagcattgtgaatgatgctggcttcctttgctggtttctttctgacatttcccttttgtgctttcgtttatggcaagtgtagacatacatgcacactcagacacatacacacacgcacacatgcactcttgccatctacaatgcctcagatccgtactgcaattggccccagccaccctgtagaatttagatttagcgaaaaaagacttcacgtgttcgccaaattctgcgtttcctcctgagtcagaggcacctgcaatgcaggcagcgggaagttgttcttctaccagaacaagagcccctaggaaaattgccccttttattactgttttggtcaaaatatggcaacaacattggtgactccaggcgagttagtaaaaatcacagagaggcacattttgtgtccggggaatgctgggatgctcctaaaacccactgagccggccgggtgcagtggctccagcctgtcatcccagcactttgggaggccgaggcaggtggatcacgaggtcaggagatcgagaccagcttggccaacatggtgaaaccccgtctctactaaaaatacaaaaattagccaggcgtgggggtgcacgcctgtagtcgtagctactgaggaggctgaggcaggagaatcacttgaacctaggaggcggacgttgcagtgagccgagatcgcactactgccctccagcttggcgacagagtgagactctgtctcaaaaaccaaccaaccagccaaccaaccaaccaaccgaccaaccaaccaaccatcccatcgagccgttctcttgctgactcaagagagaataaatcaagaaacaaacacacaaggaaaccaaaacaaccctgtagctgaggattctcccctaggaggaagaaaacgggcatccacacggcgtgtgcccagctaaatataaactgcgaggggaagggaggagacagtgatgacaagccccagccttttccacaagaagaaaaaggtttaagttttcaatgctgcccatgatatccaagaacgaaccgcatttcacagccgcggtgtgcataccatactttcacttatcggaagctcattcattgtgtgatgtgcactaattacccgctggagatttgagaacgcacctgctgactgggagggcgtattcccacctgatgtggttgctttctgcactccagaaattccctttgagatgggctccatccttccatgacagcgtgaccgcttgtcctgtagtcacagtgttgtctgaagaatgcaggatagtttattttcatttttgtttatttatgtttctgttttagaggcaggttcttgctctgttgcccaggctggagtgtagtggtgctatctggctcactgcagcctctacctcttggactcaagcgatcctcccacctcagcctcctatgtagctgagactacacatacatgccaccaacacccagctatttttattttttatagagacagggtctcactatcttgccctgggtggtcttgaactccagggctcaagggatccttccaccacggcctcccaaagtgctgggattacaggactgaacctggccttgctgtggtctgtttcgagaagactttgtttttcgttttttgttttttggtttttttgagatggagtctcgctgttgtcacccgggctagagtgcaatggcgtgatctcggctcactgcaacctccgcctcccgggttccagcaattctcctgccttagcctcccaagtagctgggattacaggcatgtaccactatgcctggctaatttttgtatttttagtagagatggggtttctccatgttggtcaggctggcctcgaactcccgacctcaggtgatttgcctgcctcggcctcccaaagtgctgggattacaggcgtgagtcactgtgcccggctgctcacccagctatttttattttttggatggggtctcactatgttgccctgggtggtcttgaactcctgagctcaaggaatcttcccaccacggcctcccaaagtgctgggattacagccctgagcctggcctcactgtggtctgttttgagaagcctttgtttttaaacagaaccacatgttggtatttcagagccaactcttctgtcaagaatccaaatcagccaggcacggtggcatgcctgtgtagtcccagcaattccagaggctgagacagaaggatcatatgagcccaggagtttgagatcagactgggcaacatagtgagactccatttctttagaacaatactaatcacatgagggtggtaggccattgcctgggctggacaggtgagtagagggcaggtgtgcaggtgcagaggtctttttttgtcctcattccatgcacgactgtttctcaaacttgctatgctaagatgctacaggaacttactttacgtcacaatatcattgaccttttttcttccttcctgtggcttcctcttcccccactctctcacctgtgtgccctattttggataaccctcctcctgggttcctttctcaccatctcctgctgtcaacatctcacctctatttcctggccggatgatgcctcctccaggaagcctgcctaggtttcctgttggcttgcaaactctatgtgggtgcgaactgtccacaccgcgtcaggtacgcaggggcccttgaagtatcacacgttggcagctcagccctgaaaacttcagctccagatacaacaaccccttccccttttctccaacctgataatttataactccagggtgactcggttcagcggcactgcagtccctcagctcttccttgcagcagccgtggtttccatgggatgtagagggttatcctgcttggaaagcattagagctgggggactagagaccccctaattctggcgtggggagaatggaggccccagaggaaatggagcaggtgttttagtggaaaagctggttttgaaattccagcctcgcctcagaacacagcatagcttccctagatgatgtttcttttgaaaggtctcctctgaaaagagtgtgaggattctggcaaacttgcaacaatctctgtaacgatgggatggctgtgtccccacccacatggcacctggaattgtaatgattcccacctgtgaagggtggggccaggtggaggaaattgaatcatgggcgcggtgacccgcatactgttctcgtggtagtgagtgtgttctcacgagatctgatgttttataaatggaagttcccctacaggagccattttgcctgccgccgtggaagatatggttttcgtcttccgtcgtgattgtgaggcctccccaaccccgtggaactgtgagtccattaaagctctttttctttataaattaccccgtctcgggtatgtctatcagcagcgtgagaatgaactaatacagatgcaaagtagagccgcggtttatgagccacaagaaataccaacccccagccaggcgcggtggctgacgcctgtaatcccagcactttgggaggccgagaccggcggatcacctgaggttaggggttcgagaccagcctcgccaacatgatgaaaccccgtctctctactaaaaatacaaaaaattagccgggcagggtggcgggtgcctgtaatcccagctactcgggaggctgaggcaggagcatcgcttgaacccgggaggcggaggttgcagtgagccgaggttgcgccattgcactccagcctgggcaacaagaggaaaactccgtctcaaaaaaaaaaaaacaaagaaggaaaagaaaagaaataccaacctctccctttcaaacctaaaaccccaacatgctggatgctctagggggtctctggggcttcgctgcttacgtttgcccttgttgggtcctgggtttttatactcaacgggatcctggaatttatgtttcatttgtgattcggttccaatttgacacaactgcctgccttcccccagcggttcgtgtgatagacacactcacgctgtcaatcatggagctgtggggcgcgtctgggagatctatagcaaaactccatccactccggttcccttgtataatacaaaagggttttatcagtcatgtatttcgcctcaaaactagaagcatggatttcccaacccgattcaccattaaaattgtgaatttttctggttctggtaaggatacgttgactgtataatggattacataacagtgtgttttcttcaccttagtaagtagccctgggagtttgtagcaaagaaagaagaaacccgagcctcaagaaaatttctccgacgatggtgcccagaacaggggtcaggggtcacgtgtgatgcgcgaaaattaaataagtgataattaagggaaaagaaaaactcagtgcctcattgcactaactgtctggcaagcgcccagtgtccagctgtggacagcacagttgtctggggcagggaagatatggactttcctgcagagagtgctactctgcagcagtgaggtacacctttcagggatgtcccatgatggtgacagagacaccagatacacaggtagcaacagtttcatttgaaaagatcattcccacagatgggagcttttgcaataagaggaggagggactactgtaatgggaggaggaggggctgtgataatgggaggaggaggggctgtgataatgggaggaggaggggcggtgataatgggaggaggagggactatggtaaggggaggagtgtggactatggtaacgggaggaggaaggactggtaacagaaggagggactctgctaatgggaggaggtactatggtaatggaaggagggactatggtaacagaaggacggactatggtaacggaggaggggctgtggtaacggggagggtctacggtaacgggaggaggagggtctatggtaacgaggagggactatagtaacgaaaggagggtctgtggtaacagaaggagggactatggtaatgtgagaaggggggactgtggtaacggagggtctatagtaatgggaggagggactatggtaacggaaggagggactatagtaacgggaggagggtctatggtaatggaggagggactatggtaacagaagtagaagggtctatggtaatggaggagggactatggtaatggggagggactacggtaacgggagaagggactgtggtaacggaggagggtctatggtaacggaaggagggactacggtaatggaggaggggggactatggtaatggcggggagggattatggtaataggggaggaactattgtaacaagaggaggagggactaatgcaaccactggtggacgctgcctatagcaccatgaagcacacccgagcagtgacatctgggagcctcttggagcgcaggcagcataccattttcttttctagggacaggcacgtgatgctcggaacaaccgtgattggggtcgttcgatgtggggttcagtcatggataaaagctgccaaaccctgtggctgcatagctaattttgagcaggtcctaaggaagcgttgcttgatcctctgacgtttgctccaggtgaggctggcccaacatcccggggcctgataggaggagagaaacccaaccaaaatgtgatcacgttagatgggaattttgttcaggtcaaggaagacgaggaattcagtccatccctgaaggggcaaataaagaatgtgaatttggaggatgtggccagccttgtcctaggctgacttggaagcatctgtgagtaatgaggaagggaattttttttttttttttttcagtaaaaccattttctggaagacaaaggcagtggggaattcttaaccttcacagattcccaacagcacagttgtgtggaatgatggactgattgtgtctccgtaaaatacaaagccctcagctgggcgcggtggctcagactgtcatcccagcactttgggatgccgaggcgggtggatcacctgaggtcaggactttgagaccagcctgaccaacatggtgaaaccccatctctactaaaactacaaaaattagccgggcatggtggcgggtgcctgtaatcccagctactggggaggctgaggcaggagaatcgcttgaacccaggaggcggaggttgcagtgagccgagattgcgccactgcactccagcctgggagacagagtgagactctgtttcaaaaaaaaagacgaactgggactcctcaaactgggggaatggtgcatttgtagacaaaactcatggtgtgccatctgcaggtgtcattgtcaggaaggtgagcttggttcatctgtgcccacttgcaagctctttggagagtgaggagcaggttgggaagcatctatcctcagtcatgaacccggagctcctgctggaaaagacagccttggggtctctgtcatgcacatttcagtaggggagtccgggccgggcacaggggctcatgcctgtaatcccagcactttggaaggctaaggcgggcagatcacttgatgtcaggagtttgagaccagcctgaccaacatggtgaaacccgtctctactaaaatacaaaaaatagctggggctgggtgctgtggcttaggcctgtaatcccagcacttggggaggccgaagtgggtggattacttgaggtcaggtgttcgagaccagcctggccaacatggtgaaaccccgtctctactaaaaatagaaaaaattagccccggctaattttggtggtgtgagcctgtagtcccagctacttaggaggctgaggcaggggaatcgtttgaacctgggagatggaggttgcagtgagctgagatcgtgccactgcactccagcctgggtgacagggcgagactctgtctccaaaaagaaaaacaaacaaaaaaaaacaaaaactaaacacataggagagtcccttagcccctcacgaatactccacacacacatctagtccagctgcatcttgttgactcacaagacatcaagataagcctgattcaatgaagttcttcaaaatcagagttcatttgctcattttcttttcttctctccaccaattagtggtgagagtttcgcctgaatcacagtacctgctgtctccagttctgatgttggtatcacccatcttcagacaagatttcttgtgttatttccacatcagcttagccactgtctctcaacatgaaatgctggctggggggaagtttcaaccgcagaagcaaagctcttaaactcattgaaaagacaagctctttcccccttggtagggtcacgaaggctcctcagtgaagggtgtggtaggtttgcttctatagggtagaaatgagacaccctgaaaatcaggaggctttcattggcttttaatttacacagaaggcaatgtgtagtttcaaaatattcttttttatttacttatttacttttatttatttatttgagatggagtcttgctctttcgcccaggctggagtgcagtggtgcgatctcggctcactgcaagctccacctcccgggttatttatttttttgagacagagtcttgttctgttgcccaggctggagttcagtggcacaatcttggctcactgcaacctccgcctcccaggttcaagtgattctcctgcctcagcctcctgagtagctgggattacaggcacctgtcaccatgcctggctaatttttgtatttttagtagagacggggttttgacatgttggccaggctggtcttgaactcctgacctcaagtgatccgccctccttggcctcccaaactgctgggattacaggcgtgagcttccgcgcctggcctcaaaatattcttaatgagtaaatacccgtaagcatttgaatacaaccatttatgttttttgttgtttagcaattgtttgaacttcaatgtgcctcataaaaatgtttcattataaaacatttcacacatttgaaagacgcagagaataatttgaacagcatttgtgtacccaccatccagttgtatcaaatcgtaatgttttgccaaattagttataaattacgtatgtgacttgggtacccctctccaattattttgttattacataaaaaatgactttataacatgggtcaataggagaccttttttcttttttttttttttgagacagagtcttattctgttgcccaggctggagttcagtgccacaatcttggctcactgcaacctctgcctcccaggttcaagtgattctcctgcctcagcctcctgagtagctgggattacaggcacacggcaccacgcccggctaatttttgtatttttagtagagatggggttttgacatgttggccaggctggtcttgaactcctgacctcaagtgatccaccctcctcggcctcccaaagtgctgggattacaggtgtgagcctccgtgcctggcctcaaaatattcttaatgagtaaatacccgtaagcatttgaatacaaccatttatctttttcattgtttagcagttgtttgaacttcaatgtgccttctaaaaatgtttcattataaaacatttcacacatttgaaagacgcagagaataatttgaacagcatttgtgtacccaccatccagttgtatcaaatcataatgttttgctaaattagttataaattatgtatgtgtctttgtgtgcctgagtgtacatgaaataagacatttcagagactattgtgctcttgggtacgcctctccaattattttgttattacataaaaaatgactttataacttaggtcaataggagacatttaaaatattattttccatgcatctttgtccttgtttattttctctagaaaagaaaaatgtatttccctgttcttattttcaattcccaaatgaagcttcaatgtaaaactaattttctgagaatgtagcatcgttcttttttttttttcttttttctttttttttttgagacagtcttgctctatctcccaggctggagtgcagtggcacaagcttggctcactgcatcctctgcctcccaggttcaagcgattctcttgcctcagcctcctgagttgctgggattacaggcacctaccaccacgcgtggctaatttttgtatttttagtagagacgggatttcaccatgttggtcaggctggtcttgaactcctgactttgtgatccgcccacctcagcctcccaaagtgctgggattataggtgtgagccactgcgcccggctagcatctctctgtatttgctgaagccatgtgtgctgtgaagattgtagttttagccattgtggttcctcttgaaagggggccctatatcttcctgatggggaatggcttaactgaagcctggggaatggctggtgttcgtgaaatggctgcattcagatgagaaaccgcacatacacatcctcacaaagtctcagagtcagctttccagggggctgggttttattccggtgcaaaggagtgagaatattgtacacacgaatgatccatggtggctcctgcctgtaatcccagcacttttgggaggccaaggcgggagcatcacttgagcccaggaatttgagactagcctgggcaacatagcaagatctcgtctctacaggaaaaaaaaaaaaaattatccgggtatgatggcatatgcttctggtctccctctcaagatgctgaggcaggaggattgcttgagcccaggaggtggaggctgcagtgagctgtgactgctccactgctcttcagcctggctgatggaatgagacagtgtcacagaaaaagaatgagaaaaataagcccaggatgcagcaaagaatgctatcctttatttattaaccccctaccctggttgtatattgatggtcatttaaatattagagggtataaaaatacaatttccaagaattacctgaactattttctttttcttttcttttctttttttttttgagactgagtttcgctcttgttgcccaggctggagtgcagtggcgtggtctcggctcaccgtagcctccacctctgggttcaagtaattcttctgtgtcagcctcccgagtagctgggattacagccatgcccaaccactcctggctagttttgtatttttagtagagatggggttttactaggttggccaggctggtctcaaattcctgacctcagatgatccacctgcctcggcctcccaaagtgctgggattaaaggtgtgtgccaccacacccggcctattttcttagaattaatattttatcctctgccatcagccgtcgtaggggtatgagcagtttcctgcctattgtaagggtttagagaagggtttgtgataaattggccgtgtggtgaagagattcccattcgggaaagacattgggcagagggtaggatgtcatgtgaagacagcattcatttcaggcagggagagggggttcatagaacgctagtgttcagtgaactgttcctagaactagttcatatgtatacatgtgccatggtggtttgctacacctatcaacccgtcatctaggttttaagcccagcatgcattaggtatttgtcctaatgctctccctccccttgccccccacctcccgacaggccccggtgttcacagagctctagtatccacccaaggctcaccaaaggcagtcaccctttgctatggtggagtatcctgggagccataggtatccctgagctacctcaggttaaagactgcatacctgtgaaagcatgtgaggatttacccatttctgtgtattttgaggaaatctcacttccatcttcagagcttggtagccccaaggtaaaattttaagaagtaaagagattgtaagtttgcatattctgggaggtgatatgaggacaagctcttaggatgaactctctaggcatacaggagaaagaagtaaaggtcaaagcaaagtggcatcaaaaaggccaaaacctggccaggcacggtggctcacacctgtaatcccagcactttgggaggccgagatgggtggatcatttgtggtcaggagttcgagaccagcctggccaacatggtgaaaccctgcctctactaaaaatacaaaaatcagccaggcgtggtggtggctgcctgtagtcacagctaccagggaggctgaggcaggagaatttatttaagttccttgtagattctggacattagacctttgtcagatgaatagattgcaaaaattttctcccattctgtaggttacctgtttgctctgatgatagtttcttttgctgtgcagaagctctttagtttaatgagatctcatttgtcaatttttgaggcaggcattgttattaccccaatttcataaatgaggaaatgacagacagatagatagatagatagatatgccagttgtccctgaggaggcgaaattttgctcagttgaaaaccactgtgatatagatagatgatggatacatagatagatattagttagacagaaaatagctagatagataatagctagatagatagtaatggtcaatgatagattgtgatcaatgataggtaatagatgacaggtagataaatgatcgatggtcaatagatgataggtagatgatagacagtagatagagagtaaacagatgctatataatgatcaaagatagataaatgatagataaatatgtacttgatagataataaatggtaaatagataaatgatggtagataagtagatgatagatgataaatggtaaatagataaatgatggtagatagataagtagatgcttgattgtaaatggtaaatagataaatgatagacggtagataagtaggtgataggtggtaaataggtcgatagatattctataaatagttgatagataaatggtaggtgatagatgataggaagtgagttggatgataggcacacagacaaatggatcacatatgcatacaatctgtcatgctaaggcaggctttgtcaaccttggcagtatgtccatctggagctggatgattctctgtggtgaggccatgctgtggactgtagcgtgttgagcaggatccctgggctccacccacttgacatggatgtacccactataccccccaccgcagttataacaaccaaaaatacctccagacatttctatatgttcctgggggagggggaaacaaaaaggcctccaatggaaaaccactgatgtagatccctacagatgccagcccagttctgtggggatgtgcctactaccattcaatggcagtaacctggacctaagaccagtatgctctctgaggctctggaaagggactcccagcctcgcatcttgaggagagcttagacatcctacgtagcattatgattcccctccaaacatggctgtgctgtgtggatcaggggtctcctcccttatctcctccatcccacccagccgtctcctttcacctcagtccctgtgtgttgagtgtggaaatatctctgtgcccaggatcctgggccggttttgtggcggggattcttctcccacagctccatcatgcatgttccctcatctccttcgatgctgatgtgttattattcgtagaacagtgatgaaatggcagcatgataccatagaacggtgataaaatggcagcatgatatcatagaacggtgataaaatggaagcatgataccatagaacggtgataaaatggaggcatgataccatagaacggtgataaaatggcagcatgataccatagaacggtgataaaatggcggcatgataccatagaacagtgataaaatggaggcatgataccatagaacagtgatgaaatggcagcatgataccatagaacagtgataaaatggcggcatgatatcatagaacggtgataaaatggaggcatgataccatagaacggtgataaaatggcggcatgataccatagaacagtgataaaatggaggcatgttaccatagaacagtgataaaatggcggcatgataccatagaacagtgataaaatggcggcatgacaccatagaacagtgataaaatggaggcatgatatagaacagtgataaaatggaggcatgataccatagaacggtgataaaatggcatgataccatagaacggtgataaaatggcagcatgataccatagaaaggtgataaaatggcatgataccatagaacggtgataaaatggcggcatgataccatagaacggtgataaaatggcggcatgataccatagaacggtgataaaatggcggcatgataccatagaacggtgataaaatggcggcatgataccatagaacggtgataaaatggcatgataccatagaacggtgataaaatggcggcatgataccatagaacggtgataaaatggcggcatgatatcatagaacggtgataaaatggcggcatgataccatagaacggtgataaaatggcatgataccatagaacggtgataaaatggtggcatgataccatagaacggtgataaaatggcggcatgatatcatagaacggtgataaaatggcggcatgataccatagaacggtgataaaatggaggcatgataccatagaacggtgataaaatggcggcatgataccatagaacggtgataaaatggcggcatgataccatagaacggtgataaaatggcggcatgatctcaagggttgggattagacacccagaaatgggagcacctgtggttgggtggagttattgatccatccttctccagtgttcaactcctccacctatgctcatatcacttataaggcagacctggccaggcatggtggcttatgccggcaatcctagcactttgggaggctgtggtgggcggatcacgaggtcaggatttcgaggccagtctggccaacatggtgaaaccccatctctactaaaaatacaaaaattagtggcatatggtggtgggcgcctgtaatcccagctacttgggaggctgaggcagaagaattgcttgaacccgggaggcggaggttgcagtgagccaagatcacaccactgcattccaacctggtcaacagagtgagactctgtgtttcaaaaacaaacaaacaaaaacaaggtagaccttatgggtctttccctgggagccttctacagagtggttgttgctacagacagcagtgatatgagacaaaccatctaaggccctgaaatatgagtcttgaaaatggctgtggacaaggaaaatcaatgaaataacagtgacaccagcaccccactctctctagggctcttaaaagttcttagcctgtagcctcttttccaatccactccagccttccttttctttgaatttgaaaatgaactttgaaatttctttcagtgacaagaaaatgtcactgtgttacgtgttgtatatccatgtgtctccttgggaagaaaattaaaggactaattgaagaaagaattagaaacactgaatccacagaaacgcagccacactctgtaattaatttttgaagaaaagaaaatgaaatgcttgccgatggtgaacctctccagcatgttcattagatatttgcattttctgcctattccattaaaagtacctctaatcagacagtcaatcaaaagtgcttatccagacatcttctttttagaatttgaatcatgccatgttctgtataggagtgagaccttaccacataaacagggtagggcttgctgtgtgctcagaaacgacacattaaccaggctgaactgatggaactccagctctctgtatccttctttgtccctctaatacttgggcagattctgccccaccattaaaaattcaatcattaataccaagaagaaaattgaggggtttcaaagaacctcaataaaccacagatttaggtctttataagaccttggtaagcagttgtggattctatagtttgtacctaccataagttatgatgatcattatagcattactgataacattttaaaaacttttattgagctgggtgcggtagctcacacctgtaatcctggcactttgggaggctgaggcaggtgtatcacgaagtcaggagtttgagactagcctgaccaacatggtgaaatcccatctctactaaaaatacaaaaattgggtgtggtggtgggcgcctgtagtcccagctactcaggaggctgaggcaggagaatcgcttgaacccgggaggtggaggttgcagtgagccgagatcgcaccactgcactccagcctggcgacagagtgaaaactccatctcacaaacaaacttttatgataatgtgtatggaaagtgtctcctcttgaaatgttccattttctctaaccaaagccaacgctccagccagccagtaggtagcagccagtaggagctgtcagaactgattgctcttatcatcactaaacacacaaagagggaaaagccatttcctcattccccaaattccagctccatccttcctctgaaagcatcatgccatttctcgctccggatatgtatttggtgtttagtcattcaaccgtgacatatctaacgttggcagagagggggcagaattcgaagttcttgccattccaggaagaggaagccatgttccctgtctaagcatctgcccacatcgggccgtgtctcggtaccaactccaccaagagagcagtgagtgacaaaggcaaggatgttcttaccaaacttggcgataacctggctccattaccatcctagattaataacccttcagtcattccagaggtggatgttgatacccaagaaatggtgggtgatgtgtatttttttgttgttgttgttgaaacagagtctcactctgttgcccaggctggagtgcagtggcgcgatcttggctcactgcaatctccgcctcccgggttcaagcgattctcctgcctcagcctcccaagtagctgggattacaggcacgcaccaccacacctggctcatttttgtatttttagtagagacagggtttcaccatgttggtcaggctggtcttgaactcctgccctcgtgatccgcccaccttggcctcccaaagtgctgggattacaggcgtgagccaccacgcctggccccattataaccctcttgcatagtctatccttcactcttgcgaaatgtttaatgagatgttgaataaatgttactatgctttgtatctttttttttgcttctatgtcacttttctttttgccgtgggtggcaatggtgagttcttttgcactcagggaagcttcatgcctcatcaccccaaccttctggaaattttgattcttatagttcaaacttccataatttttaaaaaccatttttaagttcagggatacaggtgcaggtttgttacataggtaaactcgtgtcatgggggtttgttgtatgattatttcatcacccaggtattaagcccagtacccattagttattttcctgatcctgtccctcctcccaccttctgataggcctcaatgaatgctattcccctctctgtgtccatatgttctcatcatttagctctcacttataagtgagaacatgtagtaatttggttttgctgttcctacatagtttgctgaggataatcgcctccagctccatccatgtttctgcaaaggacatgatcttgttcttatttatggctgcatagtattccatggtgtctatgtaccatattttctttttctttctttctttttttttgatatggagtctcgctgtgtcacccaggctgctggagtgcagtacccttgaaaattcctctgcctcagctcactgcacccttgaaaattcctctgcctcagcctcccaagtagctgggattacaggtgcacgcccccacgcccagctaatttttttgtatttttagtagagacggggtttcaccatgtgttggccagactggtctcgaactcctgacctcgcgatccacccgccttggcctcccaaagtgctggaattacaggcgtgagccaccgcacctggcctatgtaccatattttctttattctgtctaccactgatgggcattcagattgatcccatgtctttgctattgtgaaaggtgctgccacgaacatacacgtgcatgtgtctttatgacagaatgattgatgttcctttgggtatatacccaggcatgggattgctgagtggaatgatatttctgtttttaggtctttgaggaatggccacactgtcttacacaatgttggaactaatttacactcccgccaacagtgtttaggtgttcctttttgtctgccaccttgccagcatctgttgttttttgatgttttagtaatagcctttatgactggtgtgagatggtatctcattctggttttgatttgcgtgtctctaatgagcagtgatgttgaatgtttttgcataggcttgtcggctggatgtatgtcttttttttttttttttccgagacagagtctcactctgtcgcccaggctggagtgcggtggcgcgatctcggctcactgcaacctctgctccccgggttcacgccattctcctgcctcagcctcgcaagtagctttggtttttgactttagttacatgcactttttcagaaatcaaggtatgcataagcaaagcacatctgtctttccaaactggatttaaattcgccatttactaactaaggaatattgtgcaatttagttaacttctctaagcctcattttcctcgtctatgaaatgggaagaatagtaagatctacctcaaaagaatgttgtaaaggttaaacaaggtaatcaaattgtttagtaatatgcctcccacatatcaagccctcaaccccgccaccatgcctggctaattttttttgtattcttagtagaggcagggtttcaccgtgttagccaggatggtcttgatctcctgaccttgtgatccacccgcctcggcctcccaaagtgctgggatgacaggtgtgagccaccgcgcccggccagctgcatgtgtatcttcttttgaaaagtgtctgttcatgtcctttgcctgacgtggcaaagggtgtgctttcaatgggattttttttgtttttatttttgttttgttttgtaaatttgtttaagttccttataaattctggatattaaacctttatcagatgcatagttggcagatactttctctcattctgtaggttgtctgttcacgctgttgatagtttcctgggctgtgcagaagctctttgaaactttcgtaactttaaaccaagtgttagctaactccgtttctcaactgagtaacttcagaaattaaattagaacaacaggttctgccttttgaagacaaagtagcataaccctagccatccaccacatgctatcacttgattctgattgctgttttgaggattctttttgtcccaatctctaattagttttttaaaataagcgttttgtagagaggatgtttttctcaagagttaccctgttttgactatggtagccacaccccagtgatgtacatgtgtttctctattttccatttcataaccaccgttatgtaggtgaatccttgatctgacacacagtgcctgtctttccctatgaatggcttagtgatttgcctggaaatcttagcttgctgtagtgtgtgtgtgtgtctgggcacagttttagagaaacaagcaatgattcttttttttttttttttttttaatttcctgagtcccaaagtgtttgagacaaatctcgttttcccatatcgggtctagggttatttgttcagatcctttgtcattcaggactctgtagctctttctttattccttactgaaatctcacattgacgaagagctctttccacctgatttgcttttccattggcagatgtcctttttgttcctcccttgatgcttttaggattttctcttgatctttaaagctccacggtttcatcaggatgaggttgatggacatatgggcatttaaaaataaatcgtatggcttactatacatcttataatggcagatctgggtttttatctcagggattttttttttctttgcacgaaacctttccatttacaattgacccttgaaaaacatgggggttagggacaccaacccctcacacagtcaaaaatccatgtgtaactttttttttctttttcgagacagagtttcactgttactgcccaggccagagtgcaatggtgtgatcttagctcactgcaatctccgcctcctgggttcaagcgattctcctgcctcagcctcctgagtagctggcattacaggcgcacgccaccatgcctggctaatttttgtattttcagtagagacggggttttaccatcttggtcaggctggtcttgaacttgtgacctcaggtgatccacccactttggcctcccaaagtgctgggattacagatgtgagcccctacgcctggcccatgtgcaccttttgattctccaaaaacttaattattaatagcctactgtttacaggaacccttgccaataacataaacaggtgattcactcattcatattttctatgttctatgtattgcatactttatgcttagactaaagtaagctagagaaaagaaaacgttaccaagagaatcatgagaaagagaaactacatttactattcatcaaatggaaagggatcatccccgaggtcttcatcctcatcatcttcacatggaggaggctgaggaggagaaggaggaagagggaggttggtctggctttctcaggggtggcagaggcagaagaaaatccacatataactgacctgtacagtccaaacctgtgaaggatcaactatgtttctgtgtctctttctcccagttcttgtcttcagagataccaacattggatgttgcctctcaactggtttccttctctttcatgttcttttctccaatcacttcatgtcatcatctttttcttctacattctacacgcttccacaagcctgccctctgcacccctgacatgattctccacattcattttttttctttttttgagacagagtcttgctttgtcacccaggctggagtgcagtggcacgatcacggctcactgcaacctctgcctcctgggttgaagcaattctcctgcctcagcctcgtgagtagctgggattacaggtgcccaccaccacacccagctgtattttgtatttttagtatgacagtgtttcaccatgttggcctgcctggtctcgaactcccgacttcagttgatctgcctgcctcggcctcccaaagtgctgggattacaggtgcacaccaccagacccggctaattattgtatttttttttttttttttgagacggagtctcgcacttgttgcccagggtggagtgcaatggcgcaatctcggctcactgcaaactccacctcctgggttcaagtgattctcctgccttagcctcccgagtagctggaactacatatacctgccaccacacctggctacattttgtatttttagtagagatggggttttaccatgttggcctgggtggtctcaaactcccgactttagatgatctgcccacctcaacctcccaaagtactgggattacagggtgagccaccatacccagctgagtctcctcattcttgattttgatcttccctctgtctactattgtccgggcttctctaggatgtgatgttatatctcctactcgtttccggcacccttcttattatgttaccgcattaacccttttgttaaacgtttaatatttttgtgctctgaatttattattttttatctgatatgaatatattaggttggtgcaaaagtaattgctgtttttgccattaaaagtaatgatagtcttttttttttttttttttttttttttttttttttagatggggtctcgctcttgtcacccaggcaggagtgcagtggcaccatcttggttcactgcaacctttgcgtcccaggctgaagacatcgtcccacctcagcctcccgagtagctgggactacaggcatgcgccacaacgcatagctaatttttgtattttttgtagaaacaggctctcactatgttgctcaggctagtctcaaactcctgagctcaagcaatccgtcgtcctcggcttcgcaaaatgcagggattccaggtgcgagccattgtgcccggcctgataatattttgactctgactttcttttcgtttctatttacctttaaatctcttttatgttccacctgaattactcctctgtgggtatcttttataggctgtatatttgtgttttccttccaacctatttcttgctataattgagatagtgaaggattagtggtctcaggtccttctgcctcgccccacataaatcttcatttcaactgatgctcttcatttcttttttatggaatattactttcctgttttttgtgtttgcctgtttttcccatgagtcccaagatggatattttccctccatacgggcatttattttaatgcccagtcttcacccctggaggatgcgtgagttggttcttttttcctccttgccccgtggacctcagacatggacacacgtgtctgtggttttgagggctttgttttatccgttcagttcttcagctgcttaagatggacggacagaggccgagcgcagtggcttacacctgtagtcccagcactttgggaggctgaggcgggcagaccacaaggtcaggagttcgagaccagcctggccaatatggggaaaccccatctctactaaaaatacaaaagttagccaggcgtggtggtgggtgcctgtggtcccagctattcgggaggctgaggcaggagaatggtgtgaacccgggagacagaggttccagtgagccgagattgcgccactgcactccagcctggctgacagagcgagattccatctcaaaaacaaaaacaaaaaagatggatgggcagggagtggaggctgtgggtagtgattgctgtccatgacccctgtctgtgagcacctgctctctaagctgagggaatccctggtgtcatcccagcagtggcgtgttccatgctgctgtaggccaggaacatggtgcagccgaagtggacggccatccagtgatgacttggccccagtggacagctgcccagtgatgggacatctggagtagatggccgtccaacaacagttcattattgttgtgctacgtctggtgtttccagtggctggaaccactagagctccgctccattgggttggagccattccagggtgggaatggccaccaggagacgatgcctacccttctcttcttgcaccaagtcagcacccatactcaggcgaggccctgtgtctcctcctcctccccagcatagtcttgctggagtcatgtagaaaagtcatggaaaggggcttgtgaagggatacgctgccttcttcctgggctctcctggtatcccactggtactcagtcattctccttccaaactgaggtgtgtgcatacatataatttgctggcccttaaaaaccacgtgtaggcctggctcctgtaatcccagcaatttgggaggccaaggcaggaggatcacctgaggtcaggagttcgagaccagcctgaccaacgtggagagaccccatctctactaaaaaaaaacaaaattagctgggtgtggtggtgcatgcctgtagtcccacctactcagggggctgaggcaggagaatcgcttgaacccgggaggcggagattgaggtgagccgagatcgcgccattgcactccagcctgggcaacaagagtgaaactccatctcaaaaaaaaaaaaaaaatgcaatcagctataatccttccctaaactactggtgtgactgtcttctgactccttcaactattacccaaaagatgaatgacttcttagtgaccctttgtcctaggaattatttcataggcttctgtagcaaatggaaccttgggtctcactaggataataagcatgttctgaattcctggacgcttttttctttttttcctgcacaacttcatttcggggtaaatgaggacagcacctgagttccccactcccctttggattctctagggggttgaaggtttcttctactgacatacacatggcttcaggaagatggtgttggacgctttttctttttttgagacagggtctggctctgtcgcccaggctgaagtgtaatagtgcagtcttggctcactgcaatttctgcctccgggctcaagcaatcttcccacctcagtctctcgagtagctacgactgtaggcacgtgctaccatgccctgctaatatttgtatttttttttgtaaagatgaggttttgccatttgtcccaggctggtctcaaactcccgagctcaagccatcttgcctgccatggcttcccaaagttctgggactacaggcaggagccactgcgtccagcctggttttggactcttggtcttgggtttggccaaaactttggtggttcagatggactcttgtagattttaaggagaattgaagttttgtggcttaagctgaactgctgttctcaatgcccgtgctggtccgaatgcccatgctggtccctatagcccttcatctactgtggctggtcttgtaggtctgttttatttgctgtaggagcctttgcctgtgcttgtagctatcaccgtagcattcaacacacctctgctgtatcccctgaagacgccgaaacgtggtattctcaccccaaagagtttccaccctgataagttccagcaaggcagcccagcagctacgcctgcagacacttgttggtaggaagaagtgtcagatgatctgtaacactgtgcgttgatcctgcatgtctgaagaacttcacagaattgtcgcatggtgagcagtgatactaagcaaagctgagtcacccgtaagctcccaggccctcagcccggcaagtaggacggtattttcacacctctgttgatgaagcacctcagatagctcaagtttttggagacagcctcgtaggagttttagtttaaccataatctgcttgcggatcactgatgtttccatgagtcattccctgagattgtagtgaagaaaacagatactatcccattcgcttctttgcaaaatacccacaaagccacatgcattttcatactgaacatcttgggataccatttattttcctgcaggattatatcatagtttagggttgagtgtgcctccaggagtcatcagctaagcttcctgttttgtggatagagaatacgggaggacatctgatcccctatgactgccagcatcaggcctgggattgtggttgtccaatggtgcttttagggggcaaaaatgcacagctgtttattgaaacaacaaatgttccaggctgggcacggtgactcacgcctgtaaccccagcactttgggaggccgaggcgggtggatcacctgaggtcaggagtttgagaccagcctggctgttatggtggaaccctgtctctactaaaaatacaaaaattagccgggtgtagtgttgggcatctgtaattccagctactcaggaggctgaggctggagaatcgcttgaatcgaggaggtggaggttgcagtgagttgggattgcgccactgcactccagcctgggcgacagagtaagggcagggagggctctcagtctggtagtctcacccaggtggtccagggttccagcactgagagccaggatgccaactcccaatgcatcatcagcctcctcttcagccatgcaggaagtcagggctggtcccagtggttaatccagacaccagagtgcatagcatggccctccccatgtccagcacactggcctttcactgtaccatgtcctctttctcccattgggtggcctgtgttgctttctcaatctccaagtctgtgtcagcaaggaagtgttccatcctttactgagtcatgacctgtctgaggctgacaagtgccagagctcatgttattcaggcatatttataagcaggtgtttttatttaaagacttagtccacatattacaagtattctgatggactcatcaaagcagatagggaaagttggccagtctcattttgaatgttacgatgtagccgaacatttacaaaactgtctttgactttctttctttttaattttactctaagttctgggatacatgtgcagaacgtgcaggttcgttacataggtgtgcgtgtgccatggtggtttgctgcgcctatcaaccaatcttctacgttttaagccctgcatgcattaagtatttgccctgatgccctccctccccttgcccccagctccctgacaggccccggtgtgtgatgttcccttccctgtgtccatgtgttctcattgttcaactcccacttatgagtgaaaacaggcagtgtttggttttctgttcctctgttagtttgctgagaataacagtttccagcttcatccatgtccctgcagaggagatgaactcatccttttttatggctgcatagtattccatagtgtctacataccacattttctttatccagtcttatcattgatggacatttgggttggttccaagtctttgctgttataaatagtattgcaataaacatacgtgttgaaatttttattttatcacggtcaaacgcttaccatgagagccaccctcttgacaaagtgttacatgtataatacggtcttgttaactctaggcacaactgctgtggtgtgcacagttgtacccagactgcagaactgattcatgttatataccaaaaccttatacttgtggaacagcatctccctacgtccctctctcctcatcttctgaaaaccatcattctactgtctgcttctgtgaatttgactattttagattctacatgtcagtgacatcatgcggtatttgtctctctgtgtctggtgtatttcacgttaacatcccccaggttcatccatgttgtggcaaatgacagaattcccttctttttaaggctgcgtggtattccattgtctgtatgtactgcattttctttctttttttgagatggagtcttgctctgtcacccaggctgcagtgcagtggcgtgatctcggctcactgcaacctccgcctcccaagttcaaatgattctcctgcctcagcctctggagtagctgagactacaggcacccgccaccatgcccggctaatttttgtacttcttagtagagacggtgtttccccatgttggccaggctggtctcaaactcctaactaactgcaagtgatctgcctgcctcagcctcccaaagtgctgggataccaggcgtgggccactgcacctggccaattacgttctttttttattttttttcttgagacagagtctctgtcgcccaggctggagtgcagtggcgcgatctcggcttactgcaagctccacctcccaggttcacgccattctcctgcttcagcctcctgagtagctgggactgcaggcgcctgccaccacgcctggctaatttttttgtatttttagtggaaacggggtttcaccctgttagccaggatggtctcgatctgacctcgtgatccgcccgcctcggcctcccaaagtgctggaattacaggcgtgagccaccttgctcagcccaattaccttccgtttaaggctgtaaagtatcccattgtgtgtatttacagcattttctttatttctttctttgagactgagtgtcactctgtcgcccagtctggagtgcagtggcgtgatctcagctcactgcaacctccgcctcccaagttcaagtgattctcttgcctcagcctcccaagtagctgagattacaggtgcctgccaccatgcccggctaatttttgtacttcttagtggacacggggtttcaccatgttggctgggctggtctcaaactcctaactaactgcaagtgatccacccgcctcagtctcccaaggtgctgggattccaggcaccgcgcctggcccaactaccttcttttgaaggctgcatagtatcccattgtgtgcgtgtaccgcattttcttttttttttgtttgagacggagtgtcagtctgtcgccaggcctgagccaccgcacccagctgtaccgcattttcttcatccattcatctattgaacgcttgggttcattccatatcttggtgattgtgaatactgctgccataaacatgggggtgcaaatgtctctcatagaccgatttatcttttggataaatacctagaagcatgcttgctggatcatcgagtagttctatttttaatttttttgaggaacgtccgtaccatttactgtattcacccatttctgcaggaaacagtggcagaggaacacaagttttcttcttccctgtcccagctgtgcaaaaagagacccacagccgggcgcggtggctcatgcttgtaatcccagcactttgggaggctgaggcaagcggagcacctgaggtcaggagtttgagaccagcttggccaacgtggtgaaatgtcgtctctactaaaaatacaaaaattagctgagtgtggtcgtgggtgcctgaaatcccagttacgtgggaggctgaggagggagaataccttgaacctgggaggcggaggttgccgtgagccgagatcgtgccactgcactccagcctgggcaacaggctctctcaacaaaacaaaataaaaaaaaaaaaaataaaaataagagacccacaagggctttggacctcctttctttgcaaaacaagaaaataatatagcagacattgggcagtttttcattctgactttccagtttcatttttgcttcttcctgtatggttgctgcctggacctctttcttattgctgggaggtctttcccctgcccccatccttttgagcctttctatctacttttcttttgaaagaaagtaaataaaaccccacacatccagacaataggagcgcacgcctcagaattctggctgcgagggactgaccccatccagagagaacgaacaaatgcatcaaaaccctggctgcaagcgactgaccccagcttgatccacttaagccagaagagcctttgcttctatgtttaatctgcaccaagcttagtgatcactttcttctcagaggccagaacacagagtccaacctttccaggatgccagcttcctatctctggggtctcctcttcctgcagagaagctttagtctcttacccgagctgcttctctattctcttttgccttgctttgcctataatactaacacactgtctttttcttatgttacgttggactatcccaaggcagggacccaattggcctggcttgggttccctgcctgactgtgggtttggctgaggagtgggcagcaatttccagccgttggcactgccagaacgcatgggtgtatggggtttctggaggcagcagctctatagtgaagcagatatgtagggggtgttcattaccaagacagcagtgattgtccacgagcagggtggttccaacagggagcctacagtctaactgcagatggatgctaccattttacatgtcccatgtatgacatccatgtaccgtatgttgctggacaccgcattatggcaactgaaaaacaaaaaggcattaaatgcctgggaaaatgtacagctcattacatctcatatggtttggctctgtccccactcaaatcttatttatttatttagagacagagtctcgctcactcaggctggagtgccgtggcatgatctcggctcactacagcctccacctcctgggttccagcgattctcctgcctcagccttttaattagctgggattacaggtgcccgccaccatgcacggctaatttttgtgtttttactagagacgggcttttgccaaattggccaagctggtcttgaactcctgagctcaggtgatccacctgtgttggcctcccaaagtgctgggattacaggcgtgagccaccgcgcccggccccaaatctcatcttgtattcccacctgttgtgggagggacccagtgggaggtaaccgaatcatgggggcaggtctttgccctgctgttctcatgatagtgagtaagttttatgagatctgatggttattataaaggggagtttcctgcacatgctctcttctcttgtctgtcacaatgtgagacgtgcctttcaccttttgctttccaccatgattgtgaggcttccccagccacgtggaactgtaagtccagttaaacctttcttttctaaattgcccattctcagatatgtctttatctacagcatgaaaacatacttatactttatttatccatccttatctatatcaaatactatttgaccatagattgtgtaaagacaatatggcacagagacaccatggaatactatgcagccataaaaaagaatgagttcatgtcctttgcagggacatggatgaagctggaaaccatcattctcagcaaactatcacaaggacagaaaaccaaacacctcatgttctcactcataagtgggagttgaacaatgagaacacatggacacagggaggggaacatcacacactggggcctgtcggggagtaggggactgggggagggatagcattaggagaaatacctaatgtagatgacgggttgataggtgcagcaaaccaccatggcacatggatacctatgtaacctgcatgttctgcacatgtaccccaggacttaaagtattaaacaacaacaacaaaaaaaaaaccagactcatacaacatccctacaaacaggaaaaatggggaggggaacatgggagtcaccttgtagtttacttagatttgctgtgagaagaagctatgggaggctttccaaaggctgcgggaaggatttgggctatcttcaggagattgagcttgacagcagcttcaaggcgccttgtgggaggggaggctgggggcaggaaaatcaggtgggtgaaaaatacactgatttgcagagaaatggtgccagcctggactgtgaaaacagagacgagaaaaaccacactcggcaatatttgagcacgtattaaatcctggatggcacattgcatttttatggatgtcattcctaagagattcacagtcaggggaagatggtacataacaactcgggcatgtcagatgcacctctgtagctgcgtgtccagatgccatggagtgagatgcctggttttgctcatagagttagaaacattatcagaaaatacatgtatttgagttaaattttagagagtgagtagaaattcatcgggtctacaaggaggcaaagagctttcctggatgaaattcctccttggcgttcacctaaaacttactaatttcttacagaacaaggataccacgggaggtgggtgccgcagaaccagggaactgtgtgtctgagtcaagatactgcagagaaatagaaccaatatgatgtgtgtactgatagaaagcacatttattttaaggaattttgctcatatggtgatggaggctggcaagtctcaagatgtatggggtagaccagccagctggagacccagggaggagctgatgatgtagttggagtccaaagtccatctgttggcagaatcccttctggctcaggtaacattagtcttctgttctagtcagaccttcaactgattggaccaggcccacccaccataggaaggacaaattgctttactcaaagtgtactgatttagatttttttttttttttttttgagacagagtttcactcttgttgcccaggctggggtacgatgcgatctcggtgcgatcttggctcaatgcaacttctatctcccaggtttgagcaattcttctgcctcatcctcccgagtagttgtgattataggcacacaccaccacgcccagctaatttatttttatttttttggtagagacaaggtttcaccatgttggccaggctgatctcaaactcctgacctcagatgatccacctgcctcagctgcccaaagtgctgggattataggtgtgagccactgcacccagcccagtcttttgttctattatgaccttcaactgattagaccaggcctacccaccaattcctttactcaaagtctcctgatttcgatatttatctcatttaaagcaacctcaaagaaacacccagaagaacatttaatcacatatgtgggcaccatggctcagccaagtggacttataaaatcaaggatcaagggtgcctcagaacaagagtacccagacagaacacaagttgggcagtatttcaagaggcaggggaagccatggaagctgctctgaggggacttgtgatcaggtgtgtatgttagggaggtcactgtggcagcagggtatagggtagactgcaggggtcttgtggcctctgtctctgtcacaggccaagtcatattcaaatttataaaattcaaaatttttacatcattaatttgaaattttattaaataaatacagtatatatatatatatatatatatatatatatatatatatatatgcttctttttatatactttaagttctggggtacatgtgcagaacgtgcaggtttgttacataggtatacatgtgccatggtgggttgctgcacccatcaacccatcatctacattaggtatttctcctaatgctatacctccactagcccctgaccccctgacagaccctggtgtgtgatgttccccaccctgtgtccatgtgttctcattgttcaactctcacttatgagtgagaacatgtggtgtttgcttttctgttcttgtgttagtttgctgagaatgatggtttccagcttcatccatgtccctgcaaaggacatgaacccatcctttttatggctgcatagtattccatggtgtgtctgtgtaccacattttctttatccagtctgtggtcgtatagtatttctggttctggattcttgaggaatcgccacactgtcttccacaatggttgaactaatttacactctcaataacagtgtaaaagcgttcctatttctccacatcctctccagcatctctcgtttcctgacttttttagtgatcgccattctaactggcataagttggtatttcattgtggttttgatttgcatttctctaatgacccgtgatgatgggctaaaaattcagagaaaatgtaataaaatgtttaatctagctcaagtatccttcctttgttgaatcagttttcaccttttctgtctttcctgctggctggcttgctggagcccgctctcatgagtggtgcaaggtcagagatagaaaaccaggcccatgtatggttgtgtcttttcacaagttcagccttttattgatgctatttcagtttacagaagccccaagatgcacggagttttcaaggaggcaattctccttaggacttcccatttagtactgaaatggcttgagcccttggagtactggagcctgtgtgccggcagcatttagtcagagctacaggcgcacaggctcctgctgtgacccaagtcagtcagtattgcaacctatacatactaatacacttcaccaatatatgcatgttatagattaaacattctacatcaaacaacgtaacatttatcatcaagagaaaaggggtaggaaaaagcttaacaaaggagcacagggatattgatgtggacaaaaaaaagtctcctggcctggccctggagggccatcagtggtcgccatcttgcaaggaagagcctttgatatcagtggggcagagccttttgcggtggatgctgcgtaatgattacaagtgacagcaagatggcatctgttaaggtagccatttggagctgctgaagccctgttctttcatgaccacagagtcctctggtgaggattgacaatggaagagggtgtttggttgtgtccttaactgtttggatgtggtctttattgatcaggtgaacatctggctcctgtaggcatgatgccttttgaatgaaatgtaacatggaatctttttctaaggtggagtcacttatgtcaagcgtgctctacacactcactgtaagaattaaagaggaaagaagcatgaaatgtcacttgacagttaaacacaggtttattttagagaaacctgagaggggcttctggctgagttaggtcagagctcttctctcttatagactaagcacatttaagggttttggaagggggtgcttatcataggttcagaatgtttgtatgtgagggagagtttattgcagggttgaatatctctggtcagaggggaggctgtctcagggttggtatgtttttggtcggagacgggtttatcttagggttggaatgtttctggttatgctgacatgagtcatgaggctgatgttttcgggctggatttaggcggtttttaatcaaggggagcctagaatggtggtgtttgttcaagatggccatgctcccgctctgtcacccacaacctgaagaccgttatcatattgattttgtatctcctgtgcgtacctgatggagaatgactgaatgtttgaattaaaagactcagggagaaggcaaagttgtgtttaagttgcaagttgaaaaaaacaatccattggctctgttagcagctattagagaggttggggcgggagcagagtctgtagcttaactttgcttttgttatgtcgatgctatgagcgtgggaatcatggaaactgtgaataaatggaagagagtctgtcagtgacctactgctgcatcttgggccagcccaggcatccgtgagtgttcagggagacctcgggagagttctcaggcagaaactagccactcacatgcttgtcatctgcggggttgacatggtgggctatttttatgctcagacacttgggagaaagggcaggctgtacccaaaggcagataagtgctggccagatgggcttgctgggcaccgtcgaactcatggtcaccgtcctgcccaggagctagaaatagaactagccccgggacaatccgtgaggtatcaggtgagtatggcccgatacatgtgactcagagacacaaggagtgagggtgtgtgctctgtctcaatgagagaagagagaagtcagggcttgctttggcaacaccaaatgcagatatcagactcctattcagaaaccagaattctcatctcagcatttattttctggatatgtggccgacagataggcatctctgtttataatgcctttaattttgatcttgacaaggactagaggaagctcttactgaaccttcacgcccacaaacaaaagcttctaaatcggccgggcgaggtggctcacgcctgtaatcccagcacattgggaggccgaggcggacagatcacctgaggtcaggggtttgaaaccagcctggccaacatggtgaaaccccatgtctactaaaaatacaaaaaattagccgggagtggtagcgggcatctgtagtcccagatacttgggaggctaaggcaggagagttacttgaacccaggaggtagaggttgcggtgagctgacatcacgccattgcgctccagcctgggcagtaagagtgaaactccatttaaaaacaaaacaaaacaaacaaaaaaacttctaaatcacattcaggaagcattttgtaatattttatttcttatcagggagcattttgtaatattttatttcttctcaacccctgtagtggattgaatggtgcctctattttacccccacccccaccaaaaaaaaaaaaaagacaagttcaccttgaatctgtacatgtgattttttatttggaaataaggtctttgcagatgtaaaaaaggatctggagatgagatcatcctggattgcagtggatcctaaatctaatgacaggtgtccttgtaagagacggaagaggagacacagacacagaggagaaggccacgtggagacggaggcagagactggagtgatgcggccataagcccagggatgcctggagcccccaggagctgggagaggcaggaagaattcttccctagagcagggagcatgtccctgtaggcacctcgatttcacagatgtagtctccaggactgggagaggttaaatggctgcttttgtaagctccctagtttggggtcatgggttacagtggtcccatcccaacctgtaagctctggagaacatgagtctggaatgcaagcgtgtgcggtgattcagcttgatgcctgtggtgggaaaagagccccttgtattatggcttcctgctgtgtgtaagtaaaaccagtcctctgaggaaatcaaagcccagtaaacccgtgcaccctaacttcccaggatcgcaaactggagagagagcggcagccattttctccccctgccttgatttgctgaacctgccacccgtgcagcatttcccaggaggctaacctggtgatattgtccattcttggtcctccgcaatgcaggcaatattcgttgctcagctcaaatgcttgcgtctcctctttcttctctccacctgcaaaacatcttttcataggtcccattgggaacaccagctcgttggctggtatttccacactctttttccttccttttgttgcttcatctacctctgatttgccagttgtctgatgtctcctctcacgagcctatctttctcccaagcctagtagacacgaaccattgaaagcatccttgaatgacaaaagtccaaatatcaatttgcaaggtgaagactgtggcttttattatttgttctcaatggcgggtgtctggcggggagtccagtcgcctgacgttgaatgcagtcatttcctaggtgtgggtcaagattctgatgtccacaggcaataatgtccgtgaacgtgtgtatgtaccttgatggacattactgactgtggactccagaacattggacattgtatatattgatggacatcatatatatatatacacacacacacacagacagacgcacacacacaccatggaatactacacagccacaaaaaagaatgaattaacagcatttgcagtgacctggatgagactggagactattactttttttattattatactttaagttctggggtacatgtgcaggacgtgcagtttttgttacataggtatacatgtgccatggtggtttgctgcacccctcaacccgtcatctacattagatacttgtcctaatactatcactcccctagccccccacccctcgacaggccccagtgtgtgatgttcccctccccgtgtccatgtgttcttattgttcagctcccacttatgagtgagaacatgtggtgtttggttttctgttcttgtgttagtttgctgagaagaatggtttccagctttattaaaagtcaggaaacaacagatgctagagaggatgtggagaaataggaatggttttacactgttggtgggagtgtaaattagttcaaccattgtggaagacagtgtggggattcctcaaggatctagaaccagaaataccatttgacccagtaatcacatgactgagtatatacccaaaggattataaatcattctactataaagacacatgcacacgtatgtttattgtggcactattcacatagcaaagacttggaaccaacccaaatgcccatcaatgatagaatgtataaagaaaatgtggcacatagacaccatggaatactatgcagccataaaaaaggacaagttcatgtcctttggagactattactctaagtgaagtaactcaggaatggaaaaccaaacatcgtctgttgtcactgatacgtggaagctaagctatgaggacacaaaggcatgagaatgatacaatggactttggggacttggggagagcttgggagggggcagcgagggataaaagactacaaatagtgtggaatgtgtactgcttgggtaatgggtgcaccaaaatctcacaaatcaccactaaagaacttactcgtgatcggatgtggtggctcacacctgtaatcccaacagtttgggaggctgaggcgagcggattaccttaagtcaggagttcaagaccagcctggccaacatggtgaaaccctgtctatactaaaaatacaaaaggaattagccaggcctggtggcacacacctgtaatcccagctgcttgggaggctgaggtaggagaattgcttgagcgtgggaggtggaggttgcagtgagccgagatcatgccactgcgctccagcctggctgacagagcgagactctgtctcagaaaaaaataaaaagaacttacttatataaccagatactgcctgtaacccaataagttatggaaaattaaagaaaaacacacaaaaagagtatattcaggatcacttaagtaagcatgatactacatcacatctcgttgcggaaattatatggattatcattccatgagtgtaccagcttccggaagtttctgagctcatatggggagtgggaagtaggtggtctcgtgggaactgcagggctggccccttgtcaggacggtcatcactagtgacataaataccccatggtagagagagctggggtgtcttcgtcggttttgtgtcactagaaaggaacactggaggctggataatttatagaggaaagaggtttatttgggttatgattctgcaggctgtacaagaagcacagggccagcatctgtctctgctgaggacctcaggaggcttccactcatggtggaacgggaaggggagctggtatgtgtacagagaccacacgaagagacaggagggaagacagacgggagacgccaggctctatttaacaaccagcctgtggagaactcatagagtaaaaactcactcatgcttcaagaaaggacattgatctcttcaggaagaatccatcgtccgttgctcaaacccctcccattcgacctcccatccagcactgaggcttacattttaacctgagtttgggagaggaggaattttaaagcagagcctgtagattctaaagcaaaatattctgggtctcctgcttgtagaatggttgtgagtgtgacttcctttttctatttttattttatttttttgaaacagagtctcgctctgttgcacaggctggagtgcaatggcactgtctcggctcgccgcaaccttcatctcccaggttcaagcgattctcctgcctcagcctcccaagtagctgggattacaggcgcgcaccaccatgcctggctaatttttgcatttttagtagagacggggtttcaccatgttgaccaggctggtcttgaactcctgacctcgggtgatctgctggcctcggcctcccaaaatgttgggattacaggcatgagccaccatgcctggcctgggattgttatttctaaatgattccagctttttttttttttttgtctcagctgaggcacagcggtggaacttgtcgtcttatcattgacttgttatgttcatgaaggacttggaaaaccaacgctgatcctcagagtaacagcatagatcctcacaagacagtctatgaagctggagccccctgggttgtaaaatgcctccgcaccccgtctctgttt

SEQ ID NO: 2890 - DNA, 235951 bp, human
caaacacagcgggtgttaggatctgtgtggagtcccggatgccaggtctggggtcccctgggggaccaggtgtgggactgggagggttgtggtggggtgaaggtctgagtgtctgggtggggggttccatgaagaattccagtaggagtctgctggggggtccatgtgggatttcagccttggccctggtaagggtctgggtgggggttctgtgctggtctggggttccctgagggagcccaggtaactctgtggttgtctggggttcccaaccaaggtctgagtaggggtctgctgtcccagtagggatcagggtggggagggggctcgtggtccctgaagtagtctggagttctctgcaggggccgggaagggggtctgtgatccctgcagggttgttgggggcagggaagtggaggggtaggtttggtgggtggtgtctgtggcctggcaggaattggggtggggtctgtggtctcagtaggaactggggtgtggggtccgtgcttggggcaggttctgtggtgtcagcaggaactggggtgtggggtccgtgcttggggcaggttctgtggtgtcagtacgaattagggtgtggggtccatggtccttacagctgttcagagtcctctgtgggagtcctggtccataatcctggcatggctctgggtggttgtctggggttccctatggggtccaagtccttgtggtccctgctgaggtctgcgtggggttacatgattctggctaagatggggagggtggttcccgtggtggtcctggtcccctgcagggtctgggtaggggatctgtgatcccatggtgggggtcctggctggggcttgaatggggttccatggtcttggctggagtgtggggtcttggagaggcagtccagctggggtctgtagtcctggggggcgtcctggcaggggtctgtggtcttgtggggtgctggctggggcctgtggtccggggggtggttgtgatggaggtggaggtcctagaagggggccccagtaggggtctgtgatcctggagaggggtcctggtggtgggggtcccagtggaggtctgtggtcctggggggccctgggaggatctgtggtactggggagtcctggtggaggtctgtagtcctggtggggttcttggtggggtgtctgggcgtgccccagtgggggggcctgtggtcttgggggtcccagcaggggtctggggtcctggggggtgttcttgggaggagtctatggatctgacttgggtgctggctggggtctgtagtcctgggggcgtcctggctggggctgttggtcttgtggtggtggggatccctgctggggtctgcagtcctgccgggagggggaagggtccctgctggggtctgtggtcctggaggaggtgtggagggtccctgctggggtctgtggtcctgggggggattcctggctggggtctgtggtcctggctgggggtgtgtgtggggggtccctgctggggtctgtggtcctgaagggggggtcctgactggggtcagtggtcctgggggcgtcctggctggggtctgtggtcctgggggggggggtcctggctgaagtctatggtccttgcaggggggggttcctggctggagtctgtggtcctggggggggtgtcctggctggggtcggttgtccgctcggggtccccagtcctgcaggcggtgcgggatcccagagggcccgggcggggtctggggttgggggttccccgcaggccggggcggttcggggcgggcagggggcggtccggggcgcgcgcgtttccgccgtccgtccgggcgggcgggcgcagagtcccgcgggcggcgcggaagcggcggcggcgcggccggggcagccatgtcgccattgtctgcggcgcgggcggccctgcgggtctacgcggtaggcgccgcggtgatcctggcgcagctgctgcggcgctgccgcgggggcttcctggagccaggtcagcggggcggggcaggggtcagggctccggggacccgggtgggcgcgggctggctcgggggcgggggcgcgggggctccgcgtgaccttggcgaggcggtggcgctcccggaagtggggctgggcgggggtcgaggtgtggccgggggtggggggggggcggcgtgcgcgctgggacctccccgccccgcgctttccgtccccgccggctcttctgcgcgcctggcccggcccgacccggcccgacccttccctccccgcgcgtgtggcctccccgcctgtcccgggtcgggctccaaccaagcagcccccgtgcagccgcccccccgcgcaccctgacacctccgggccatggccggggacccgggggctcgcacgccccgcgcccaagacatcaggcggctctgcctgccgcctgcggtcggccagtgaccgcgcgcccccgccaggccccggaggggaggagcgggcgtcccagggacctcgacccctacccaccccagggtaagtgaggatgggcccttctccggaggacgtctccagagggggcccagaggcggcttctcgggcactggggagccacggaggtctggtggggagggcaggcccgttaagtggcaactttgtttccttggcctttgtaaacatctctgagtcacagatctccaactttgcaggactcgttcactgtctgaactcatcagtgatgaccgccactgtgttttgtgtatgcagataacttctgttcctagatttgcaggttcagaatttattattattattattttttgtaataggaagtagagatgaagtcttgctctgttgccgaggctactctcgaactcctgggctcaagcagtcctcctgcctcagcctcccaaagtgctggcattacaggcaccagctactgcatccgactaatgttttaaagttttgtagacggggtcttgctatgttgctcaggctggtctcgaactcctgggctcaagcgatcttccttcctttgcctcccaaactgttgggattacaggtgtgagccaccacacctgtctaatgttttaatttttttgtgtagcaatagggtcttgctacgttgcccaggctggtctgaaactcatgggccgaagcaatcctcctacctgggtcccccaaagtgctgggtttacaggcgtgagccaccacgcctggctaatgttttaaattttttgtagagatggcatctcaccatgttgcccaggctggtcttgaacccctggcctgcagcaatcctccagtctgggcctcccaaactgctgggattacagacagagcgccactgtgcccagcccatattctcaatttaaacctagaaacctgtaaacaattatttgtgaactggaataaagggaatgttaattccatgttaggttaaatgatactttgtttcaaaaataacagttttccaaaacagagcgttcagagggtcagtgtggtgggggtgggggtgtacgttgccctgaatgtcttaaatgtccagcctaagaagagagctgttatttctgcctctgtagacagtttcatggcatgtcaggaggcctctggaagacactactgcacgcctctgggagactgggagtcagccaggcgaagcgcttgggtgccttattgtgaaatgacttttgacttccactctgcacccactgaaggaatcccaggggtcccagcgccaccctttgagaagcgtgcctggagtggatgttttaaaatgagcctctctctcccgcctctagccagagaaaaagagctttgagttttctgtgagctaagcttttctttttctgccaaactggccttcagtatttttttttaaacccacttagcataattacaaatgcatagaagaaggagagtaaagggaactgtagtcaggctttcggagggcaggagagcatgtttgtttgaagtaagtaatcagttgcaaggtgaacggtttacagctgctgaacaattgtgtggagtctcgcagaagattatgtttatccgggcagttttgcttacagaaaggtccccttaaacctccttaagggcctgtgtgggccctggcagaagaggccggggttcctgcagcagctcaccaaaatgctggcctttgaaaaacttgctctttgtgcattagaaaaagggctggaatcttttttttttttttttttcccatttactgattaaacaacaacagaaggttgttaaagaggacgagcttctggtgaagtcacgtgtctgccaagggaatctgtacccgggtgtgtatcgaaacagaatggccttctctaaagattaacttaagtggcttgccctcatcgagccccttcctatgtatggattaaaaataattttcgataccagtggaggaatgctgttgtccttggtctgctggtggccagcttcctaaacggcattttttatttgcttctctctggtaggccttcgctgttggtgaggaaacattgaactttgtccagggcatttgagctaagctgtttgaataaccaagagggccaatttccccactgcagattggaagcaagggcagttttttcttagaacttccaaatggagcgtgttcttcttaggtatcgtacaaaggaaatgcctgggttacaccttccacatgagttgacttacatggtatgagaaggaagaaattgtggctggaatccactcctaaatggtgtcttcttacagttcatcatggaaaaacaagataattacaaattaatcatagatgttggtcatgcctttacagagggggtttagaagcaaattgagaattcccataagagggtctgtctctgtgttcttaagactatatccatgcggcccattcagtaagttgtatctgttggttggattttaaaatagatgatttaatcagtgcatttaatatcctaatatggcatcaaaacttgaacattgatatggcctgaaatctgttgaaaatgatcatattgagtaaagaaagtctctacccaccggtattaataacagggtgatctgtttagaaattacattttctctgatacatcaatgagttttgcaaaggagagaaaattgatggtacctgtagtcaagtccagttccaatactgccacagaatttttcttaaaagttctattgtaaataataggccacagaatattccttcactttctgggatgcaaaatggattcgtaaatgctgtaccacaggagtgagtatttacaaaaaatatgccaactggcccacttacaaagctatttatagaagtcctacttttcaaactattttttttttaacctgtaaagggaaagttaattcttgttggttttatgagtagtgaacagtggctattagaaatcaggtagaagtaaaaacagcagttttccaacttcttcttctttttcttgagaccaagtttcgcttttgtttcccaggctggagtgcaatggcgtgatctcagctcaccacaacctctgcctcccgggttcaagcgattctcctgcctcagcctcccgagtagctgggattacaggcatgtgccaccatgcctggctcattttgtatttttagtgagatggggtttctccatgttggtcaggctggtctcaaactcctgacctcaggtgatagtccaccttggcatcccaaattgctgggattacaggggtgagcccctgcccccggcctccaattccttgatcatagaatctctttcaaaaaaaatgaggaccccagacagtttttgtttttgtggattataacagtcaataagtcatcctgttagacattaaaacagaaatttaaaacatatttaacaatctatttaaaagtaatggtaacaggccaattacatgttacatacaaaaatgtatgtaatatatttattgtttttatattttatttttattaaatatatatatttttagaataatttatacttttctataaatataaaatacaaataagttatatttatataatttagatgtaaataaaaacaattgatatttttatataaatatataaatgtgtacacttatggggcacagtgtgatgctttgctgtatgtttgcattgtggaataattaaactaatatctatcacccgctatttttcctttgcggtgggaacatttaaaatctcttttagctatttttgttttttatttccataggttattggggaacaggtggtgtttgattccatgagtaagttttttagtggtgatttgtgagattctggtgcacccatcacccaagcagtatacactgcacgcaagacatttaaaatctctattggcgggccgggtgcggtggctcatgcctataatcccagcactttgggaggctgaggcgggtggattgcctgagctcaggagtttgagaccagtctgggcaatacagtggaaccccatctctactaaaatacaaaaaattagctgggtgtggcagtgtgcgcctgtagtcccagctacttgggaggctgaggcaggagaatggtgtgaacctgggaggtggaggttgcagtcagccaagattgcgccactgcactcaagcctgggcaacagggcgagactccgtctcaaaaaaaccaaaaaaacaaaaaaacaaaaacaaaaataaaaacctcttttagctattttgaaatatgtaatacactattaactatcgccaccacgctgtgcagtaggtcactgaaacggattcctcctgtcgaacagaaacttggtaccctttggccatgtgctgtatgttttttaaaagaaaaatgattgtcatttccaaaataacaaaaacctagggagaagagtggctgagttttagggttttgtcagtctcatccataaagggacggatggcggctggctccttcctctgcttcttcacactggtctcttgcgacgtgtcgttctggtaagagtcatgtgaggcacatccactggcctctcatggatgtgcaattggaaacgtgaaatcgccggccccctgagagcgttttggggagtgtcccccccaaacccccctccccccgcactggggatgctgcaccagtcttgaagaatgaggcagtgagaggctggtttacagcaacctttattcgtggccttgtgtgctcggaagcgctgcaagggaggaggaaggaggaaggagggtactcactgcagaaggtcagctctgctgtggctgttacgtgggttcaggtggaacccacctactgtgtggacggttctttacctgggaatcccatggaattctgacagcaggagacgtgggagggagcttcttgtttctccttccaggagtcacttggttaggggtttgggaattttggctcttagtacaaaacttcactccaggtactagacctgtttcagccaaatgatgatcatcataatagaatagaaacctttgttcacctaaataataacaataatattaataataatagaatataaacctttgttcatggtactggggcgtctttcagcccaataataataacaacaataggaataatgataataatgataaaatataaacctttgcttcacgtcctggaacgtctttcagccaaataataataataatattaatgataatagaatataaacctttgttcagggtactgtgacttctttcagcccagtaataataataataatagtaataatgataataatgatagaatataaacctttgcttcatctcctggaacgtctttcagccaaataataacaataataataataatgacaatagaatataaacctttgttcagggtactgtgacctctttcagcccagtaataataataacagtagtaataatgataataatgatagaatataaacctttgctccaggtcctgggagctctttcagccaaataagaataataatagaatataaacctttgttcacagtaccaggacctctttcagaccaacaataatgacagtaataataattataatgataatagaatataaacttttcttctaggtactgggacctctttcaaccaaataataatagtggaatataaaacttggctctaggtaccagaaccttttttcagccaaatagtaataataagaatagtattaatagaaaacagacctttggtccaggtactgggacacctgtgagccaaataataataataatgataataatagaacataaacctttgactgaagtgccagaacctttttcagctaaataataataataaaatataaacttttgttccaggtacccggacttctttcagcctaataataatcatagaatataaacctttactacaggtcctggcacctttctcagccaaatagtaataaaatagaatataaacttttgttctgttactgggacctctttcagcctaataacaaaagtaataataatagaataaaaacctttgctccaggttctagaacctctttcagcctaataataataataatgatagaatgaaaatttttgttccaggtgtcgagacctcttccagcctaataataataataatgtaataatataagcctttgctacaggtaccaggacctgtttcagccaaataataataacagcaatgataatagaatataaaccttggccccaggcactgggacttctttcagtcaaacaatcacaataataataataataatagaatatggatgtttgctccagctttcaggacctctttcagacagataataataaccgagtacaaacttttcttccaggtatcgggacctcttccagcctaaaaacaatagtaataatagcatatatatctttttttttgttttcttctttctttgagacggagttttgcgcttgttgcccaggctacagtgcaatggcgccatctcggctcactgcaacctctgcttcccgggttcaaacgattctcgtgcctcagcctcccgagtagctgggactacaggcatgtgccactaccacgcccggctaattttgtatttttagtagaggaggggtttcaccatgttgtccagggtggtctcaaactcctgacctcagatgatccacccaccttggcctcccaaagtgctgagagtacaggcgtgagccgctgtgcctggtgccagcataaaaatctttgctacaggtactgagacctttttcagcctaataataataacaaccgtaacaataataattagaatataaacctttgttactggtactgggacctcttccagcctaatcttcataataataaaaataataataataatggaattgaaacctttccttcaggttccagaaccgctttcagccacataataataataataatgataataataataataaatagaatttaaacttttgtttgaggactgggacctctttcagcccaatagcacaaataataataatggaatgtaaaccttttcctcccaattaccaaaacctgtttcagccaaataataatatgatgatgatgatgatggaggatctgatacagctgtgtcctgtcactcaggtcggacttaggaggcctcttgagattcttttccccctccgttgactgtgtaatccaggggccccaccctaactcggctgcagaagatgcagtttgggggttcctcgttttgtggaagtcccggtcatgttattcattctctcagcaccttagaacaaaccagggtgctggcattggccacaggacccccctccttgcaccccagtcttgggaagtggcactgctgggctctggcaatgcccagctcacctggcacgtggcggcgtctccctaaaaagcactgggcgggcaccgttgacggaaagccagcaacgcaggccgcgactgcccgtgaagacggggggcctttctaagacctccactcattatttcgggcaaaattaaccttcagaataccttgctttaataaagtaccagaaaccggagggcttaaaaccatagcttattctctcccagttctggaggccagaagtctgtaatcaaagtgtctcagggctgcgctccctccggaggcttacgcggagggtgcttcctgcctctcccagctcctgggggctcctggcgtccctgggcttcaggccagccacatcatcactctagtctctgcctctgtctccatgtggccttctctgtgtctgtgtctcctcttctgtcttttataaggacatctgtcactgcatttagggctcactcaaatcccggatgatctcatctccagatccttaactcatgagatctacaaaatttctaataaccaagtaagatctcattccacatcctgggctttaggctgtggacagatctttctgcgggccactgttcaatccaccatgattttatccagttcattgtggaggctctagaggaggatccttcctgcctctcccagctcctgggggctccaggcgttctgggtttgtggccgcatcactccagtctcggcctctgtctccatgtggtcttctcctgtgtgtccgtgtctcctcatctgtcttctattaaggacactggtcactgcatttaggaccacctcaattgagaataatctcatctaaagatccttaccttcattattaatacatctgcaaagaccctttttccaaacaaggtcccatacacaagtaccaggtggatacagattttctttggtaggggaggacgcttttcaacccactatagtcatcattgaaatatgcctccttgcactgactgtatcccaacactctgaacgtgcctgggtggtgcattttgatatttaccctcctgagcactgtactggacacttggagacacaattacaccttttaacaaagcccagctgtcattttgggcaacccagtcacagaggtggcctcctgagtggcagctggaagggcctgtatgtgtgagcattcaacctcaacaggaaccctggggactggcttctgggtcatctaagcctccacaccgactgcctgatgtttgcacaggtgtgtgatatttgcccagttgggcctttctgcccacaggtgtgactggacacaatgggcattttgagaagttccagggattgagaaatccatgcttcttcagacgtgcttacagatcacggatgcacctgtgacgttccacatggcttcattttaaaccataaagtttgagaagagtgtgcagtgcctcttagccataggaaagctggctttagtcagatggaggtcctgtttggcttctttaatgcagtgaatgaagctcaggtggcattcagagagtcctgctgtgatggttggcagtggggggtctgcctggccacttgtggattcttctatgtaggcttcatccccagaaaagatctacgcagctttcccacgtggcaggtgcttgggaaactcttaggacaggaacaacaagcccctgcgatgacagaggcattgtcaggctgggcgcggtgactcacgcctgtcatcccagcactttgggaggccaaggcgggtggatcacctgaagtcaggagttcgagaccagcctgaccaacatggtgaaaccctgtctctactaaaaatacaaaaattagccaggcgtgatggcaggtgcctgtgatcccagctactgaggaagctgaggcaggaagatcgcttgaacccgggaggcggaggttgcagtgagctgagatcacgccattgcactgcagcctgggtgacagagcgaaactctgtctcaaaaaaaaaaaaaaaaaaaaactaaaggcacttgtcaggtacagccctgcaaaaatgccgtgctcactcgcaaacctgtatgttgacacgtgcggcatcgctgcagtcggattaacgtggaagaaagagcgtattcctgcgctaggttccctcctccactctgcaaaagtgacccgcaaggaaggtccagccgtccggccccagtgccctttggttgaaagcggagctgccccggcaccctgtctgtctccccggcagggctcccgtgcgtgcctgggtcccttctcatgctgtgtttgtcttggcccttctcagcaggtccccacgcatgagcagccgtccagcaggcaggctccggtggagaagcaatggagaataaaagcctggagagctcccagacagacctgaagctggtggcccacccccgcgccaagagcaaggtgtggaagtatttcggcttcgacaccaacgccgagggatgcatcctgcagtggaagaaaatctactgccgcatctgcatggcccagatcgcctactccggaaacacctccaacctgtcctaccacctggagaagaaccaccccgaggaattctgcgagttcgtcaagagcaacacggagcagatgcgtgaagccttcgccaccgccttctccaagctgaagcccgagtcgtcccagcagcccgggcaggacgcgctggccgtcaaggccggccacggctacgacagcaagaagcagcaggagctgacggccgccgtgctgggcctcatctgcgaggggctgtacccagcctccatcgtggacgagcccaccttcaaggtgctgctgaagacggccgacccccggtatgagctgcccagccggaagtacatctctaccaaggccatccctgagaagtacggggccgtccgggaggtgatcctgaaggagctggccgaggccacctggtgtggcatctccaccgacatgtggaggagtgagaatcagaaccgcgcctacgtcacgctggccgcccacttcctgggcctgggcgcccccaactgcctgtccatgggctcccgctgcctgaagaccttcgaggtgcccgaagagaacacggcggagaccatcacgcgagtgctctatgaggtcttcatcgagtggggcatcagcgccaaggtcttcggggccaccaccaactatggcaaggacatcgtgaaggcgtgctccctgctggacgtcgcagtgcacatgccctgcctgggccacaccttcaatgccggcatccagcaggccttccagctcccgaagctgggggcgctgctgtcgcgctgccgcaaactggtggagtacttccagcagtctgccgtggccatgtacatgctctatgagaagcagaagcagcagaacgtggcccactgcatgctggtgagcaaccgcgtctcctggtgggggagcacgctggccatgctgcagcgcctcaaggagcagcagttcgtcatcgccggggtcttggtggaggacagcaacaaccaccacctcatgctggaggccagcgagtgggccaccatcgaggggctggtggagctcctgcagcccttcaagcaggtggccgagatgctgtcggcctccaggtaccccaccatcagcatggtgaagccgctgctgcacatgctcctgaacaccacgctcaacatcaaggagaccgactccaaggagctcagcatggccaaggaggtcatcgccaaggagctttccaagacctaccaggagacgcccgagatcgacatgtttctcaacgtggccaccttcctggacccccgctacaagaggctgcccttcctctccgccttcgagcggcagcaggtggagaatcgcgtggtggaagaggccaagggcctgctggacaaggtcaaagacggcggctaccggccggctgaggacaagatcttcccggtgcccgaggagcctcccgtcaagaagctcatgcggacatccacgccgccgcccgccagcgtcatcaacaacatgctggccgagatcttctgccagacaggcggcgtggaggaccaggaagagtggcatgcccaggtggtggaggagctgagcaacttcaagtcccagaaggtgcttggcctcaacgaagaccccctcaagtggtggtcagaccgcctggccctcttccccctgctgcccaaggtgctgcagaagtactggtgcgtgacggccacgcgcgtcgcccctgagcgtctcttcggatccgccgccaacgtggtcagcgccaagaggaaccggctggctcccgcgcacgtggacgagcaggtgtttctgtatgagaacgcccggagtggggcagaggcggaacccgaggaccaggacgagggggagtggggcctggaccaggagcaggtgttctccttgggggatggcgtcagcggcggtttctttggcattagggacagcagcttcctgtagcgaggaagcgtgttgtcttacaagtcatccccgcagcagcccattggatgctttgctgtaaatacttacccggtcagcttggttttgaacctcagagaccatccactgtctttgacacctagaaggtggaaaaaggaaagagatttgagaagtgagagagggtcgggggcggtggctcctgtctataatcgcagcactttgggaggccgaggtgggcagatcagctgaggtcaggagatcgagaccagcctggccaacatggcgaaaccccgtctctactaaaaatacaaaaattagccaggactgatggcatgtgcctgtaatcccagcttctggaggctgaggccagagaatcgcttgaacctgggaggtggaggttgcagtaagctgagatcgctgcactccagcctgggcgacaagagcgagactctctcaaaaagaaaaaagaagacacaagagaggtggctttgagtgggtttcctttcctcccctattcccggggcccggacgacttctgcttgggaactgccaacgcttctgcttgggaattgcgtgcagcagagcctagaggagctgttccttccttcacagatacttaagacctccaccatgtctgattcgagttctccctgggagggtttagaagaaacgcaggaacattctgggtggcgtcgaaggagcctttcccgatcatcatgtgtgacttctgcgaggtccagatcactgaattcatgtttacattctcgtgcaagcagggacctcttgcttctgagaaatggggaagagaccttttagccaaaatgcccttcttaaaaagagagacctttttttttaatgttcggttaaaaatgtgacagatgagtacaaaaatgcagacacttaacaaaaagcaaacagaaaaaaaagtgtggaatgtgttgtattttcgacaggttgctgccagagagcctgcttcctgctgcctgccgaaatttcactttgcggagttggtccttaaaactgggcggtggccgggcgtggtggctcacgctgaggtcaggagttcgagaccagcctggccaaccaacatggtgaaacctcgtgtctactaaaaatacaagaaactagccagatgcggtggcacccgcctgtaatcccagctactcgggaggctgaggcggaagattcgcttgagcccaggaggtggaggttgcagtgagccaagactacgccactgcactccagcctggaggccagagtgagactccgtctcaaaacaaaacaaaagtgggtggctcacgggtccggaggttatgtcttcggtgtctcagccctaaaagtccagttcccccgtgcggccagcttttccacataaggtgtttttgatttgattaccggaaaggactcttgattcttctcttttaaactgaataccataggggaaatgaattttaaaatattgcccccggaggggttttccgtggctggattcctgcgagttgctttcagtcattcagggaaacagaaagacgttttccaacatgtagaactgctttttaactggaggaaaaatacttcaggaggcttagcatattgcttggattctacgtgcagcgggttctctgcctccgtgaagacaagctgggctggggagaacggtgtctaggagggatgaccccactcagctccaggcagtgttctgccgagaccccaagaactcggggtgtcagagggcaaaggaactacctgcctttcacggctgctgacttctcagggctgcaagcagcacagaatgttatccttacgtcctgagccggtttaagtctgtggaaaaggaagcacgggagaaatccacgtaacctttgctttctttttaagggaagcggttccgccgtgaacttggaaccctcagctccgggtgttctcggcagaagggcagctggaagggacacagtggggcaggctttggggttgctccctgttctgccccgaggccggggacgcagggcagcccacgcctccgtgggctccattctgtagcattgccagcgttctcttcacgtctctaacaatccttcgcttttcctcactcacgtggaaatgtgaactgtcccggctctgtcttcatttttatttttaagccatcgttcccctcctgaacggttgccccttatttaatgctgtaaagttggactgttgttcaataaaccagagcaatgcattagctcctcattcatttgtctgccgcgtgtccgtctggactgcagtttgtctgaaccccttgatcctgggagtggagggaggtttatcattattattatttttatttttgttgtggtccttgttgaaagcaactttttccagggcacccacggtcagttctgtgctcctctttcttgtctgtaaatcctcaagttatgatgtactttcgggtgttttggcatcaaaatttctgagtgaataaagccggcagctggtgaaagtgttccccgggagcagagatttttgccggttccttcacttagtggatagttgtataaacggaggccccatggacgaggcagcctggatggatccggatggcatcagcgccttccctctccccccagcctccttatcacccctctcttcctgtcttcctcacctcctctcacatggtctcttccttccctcctccttccgtccaaccctccctctcttcttcagccaacaaatccttcctttcttccttctttccttccttccttccctcccatccttgtctcttcttctctcccttccttccctcccttcccttctttctttctctcccttccttccttctctcccttccttccttctctcccttccttccttctctcccttctctcccttttctcccttccttccttctctcccttccttccctcccttctctcccttttctcccttccttctctccgttccctccctcccctccctctctgcctccctttcctcccctccctccttcccccatccctccctccctccttccctctcctccctccctccttccttccctctgtccctccctgtctccctcccttcctccttccttcctttcctccctccctctgtccctccctcccttttctccctccctcccttcctctttcgttttccttccatccctttttccttcctccctccctcttttcctccctcctgagaaaacaatggcccccaagaaacacaggaaggccgggatgtgcacctctgcccagacttgccctttccaagtgctgttggttgactgcctgtccttgggcatcattaaaatgccgaaatttctctttcttgcacgttttgggttgaaaggggttcattttcagtcctcataactaagcatttgcatcgtgatgttcatttaagtgggacatgtttacacgtttttcccattaggagtaattctagtccttgagggtttcttacagagacatttccctaaccccgacggttctcatcccagcctgtgtggcactccttccgcacagtggtgggatttttcggttcggttttgttttcacgcttgcatctggctgcacagccctaactctgagctggttgtttttgtttcccccccactttgcagaattgcctgcttcgaactgttttcccagcaggcctctgaagggtgaggaaaacagcttggggaaagtgagaaaaaggtttcggatgttttagtaaagaggcagctggtgggaaggagccggttgggctgtttctggggtgccgaaatctcggtggtgacgttcatttgctcgtgagtgcagaggaggcccagagaccgggttcctggcgcagccagctcctgcttttgttccgaccatcttcctgcgccttctgcgagtctcagatgtgcttgggcagcagttctactgttttcccctctgtgatctcaggcccgccgccccgtcctttcccagtgatttctgctccgtcaaatcgtggggctcacctgagagttttataaaatgaactcgccatgcccctgcctggtgaacagagaatgcaaactctcacaggaccgtctgcagcaaaacggcagtgttttgctcatttcttcagacgacgaaaacagcagggtttggctcgtttcttccagattttctcaaactgcatgagttcctttctgagcaacttctgggaagctttcgggtttcagggctttgcagccaggctccttcctagctgcggctgcctgtccttttgtgttgcagtcagatgcgggaggtccttggcatgagtaccctgatggtgtcaactttaaggggtcagagaggaaatatttttggctccgcggaccatgcattctctgtctctcaacaacttagttttgccgttgtgtctaaaagcatccattgctgggtgtggtggctcacatctgtcatcccagcactttgggaggccgaggcgggtggatcgcctgaggtcaggagttcaagaccagcctggccaacatggtgaaaccccatctctactaaaaatacaaacattagctgggcatggtggtgggcacctgtaatcccaggtactgaggctgaggcaggagaatcgcgtgaaccagggaggcggaggttgtagtgagctaagatcgtgccactgcgctccatcctgggcgacaagagcgagactccgtgtattccactcccacttcgtgggcactaaattttatataaatgttgtgtcaagaaatattattgctctgttgacttctttttttcccccaaccattaagaaattcagaaaaaaaatgtacgaatgtaaacactgttcttggtgagtgggccttccaaaaataaccgctggactttgttgaaactacttttttttttttttttttttgccactttttcccttttttttctcgaggcaccaattggaatccacttatttgtcctggtttgagaaacagctcagatcgcacactctgggctctgtgtttctttaggtaacacacgtgaggtttttgtcactggaattcagtaatctgtgttaatattatcacaaaagaaccggggggcatttgtgtcttctcagaattgctgattaaaacagctgcatggccaggtgcagtggctctcatgcctgtgatcccagcactttgggaggccgaggcaggcggatcgcttgagcccaggagtttgagaccagcctgggcaacatggccaaacctcatccctactaaaaatacaaaaaattagccaggcatggaggcgcatgtctgtagtcagtcccagctactcaggaggcgaaggtgggaggatcacttgagcttgggagttggaggctgcagtgagctgtgaacataccactgcactccagcctggaaaataaagcaagagatgctgcctctaaaaataataataataataataaaaattagccaaacatggtggcacgcatgtgtgatcacagctacttgggagactgaggtgggaggatcgctggagcccggaaagtcgaggctgcagtgagctgagattgcatcactgtcgtgcagcctgggcaaaagagtgagaccctgtctctaaataaataaataaatgagttcacgattaagcagaagttgtgcttgttctgccaggatttcagttgggttctttgtgccctaatttacgtgagctagtaggttgtgcgttatcttagagggcttgcatgaaagaaagagggtagcctttcttttccctgttttggtagcattgctgaggtggcttttggctgacgggtggacccgtgggtgcagatgttttgatgcagaaggaatgattgccttttcacattcaggctccaactggcttttagcttgtgcgttcttaccctggggtgttcgaggtcaccggactcctattttatttgtgtttaactggaaaggcaggaactctgagaacgtatcaaataggcagttactgcaggatttctagaatttaaattgcttccaaaactgtatccacaagctaagaattatgtttaggttttaaaaggtgttggtttgcttcttacatgtttaaattcttgagggaaagaaatgcaaagaataataaagtttcatgatacaaaaatggtatgagaccgggcacaatggctcacacctgtcatcccagcactttgggaggctgaggcaggaggatgatttttgagcctgagtttgagatcagcctgggcaaacagcgagatcctgtgcctacaaaaataaaataaaaataggctgggtgtggtggctcatgcttgtaatacctgcactttgggaggctaagtcagtaggatcacttgaactcaggggtttgagaccagcctggtcaacatactgagaccttgtctctagtaacaataaaaaaattagctggacataaggtgtgcatttgtagtcccagttacacaggaggctgaggtgggaggatcacttgagccagggagttggaggctgcagtgaaatgtgatcgcaccactgcactccagcctgtgcaacaaggagagagatgctgtctctaaaaaaaaaaaaaaagccagacgtggtggcacacgtgtgtggtcacagctacttgggaggctgaggctgaaggatcgcttgagcccaaggaggctgaggctgccataaactacgatcatgccactgcactccaggctgggcaatagcctgggcgactgtctcaaccaaaataaatttaaaaagataggaaatttcaatgtgaaaatcagtgtcccccagaacgttccatttcttcccagctgggctatttttggagttccatggggagccggctcagtgcagtttgcatgtactcgggaggatgagccctgccatggtgtgtgttaggggacagcctgatctcaccaaccctcctgagcaggcccagccctccgagtaataactgggaacactcgccgctttgtgagacgacctcgtgtgctcactggaaggtcatctcttctggtccatgctgcagtgtggataccattttttttttttaagacagtttcactcttgttgcccaggctggagtgcaatggcacgatctcggctcacagaaacctccgcctcctgggttcaagccattctcctgtctcagcctcctgagtagctgggattacaggtgtctgccaccacagccagctaatttttatatttttcgtagagacggggtttcagtacattggtaaagctggtctggaactcctgacctcaggtgatccacccgcctcagcctcccaaagtgctgggatgacaggcgtgagccaccgcgaccagcccagtgtggatacaccttgagcacataactggaatcctttccttggaaacttggagccccttgtgtcatggtcatataaactgttgaattaagaggagacaccattaaatatgtcacagctgtcctcgaaactgggacttgttttgctttctgcctggaaatgcgagctatctttatagaattattttatagaaaataattgtatacatatataggaggtacgacgtgatgttttaatccgagtacacattgtgcaatgattaaatcaagctggttaccatattattaacctaattaacatatcaataatcaagctaattaacacattaacattcaagctaattaacatattaacaagctaattaacatattcacataatcctaactctgacctatatcacctcacctacttttttttgtggtgagaatgtgtaaaatctacttttagtcattttgaaaaacgcaatgtattattattaatgataatcactgtgtggtgtggtagaactttgaatttatttcttctatctaactggaaaaatttaattttaatgtaatttattttttttgagacagtctcaccctatcacccaggctggagtgcagcatcatgttcatagctcatggcagcctccaactcctggctcaggtgaccctcccaccacagcctcccaggtagctgggactacaggtgcacaccaccacacctggttaattttttaagttttttgcagagatggggtcttgctatgttgctcaggctggtcttgaattcctgggctgaagcgatcctcctgcctcagcctcccaagtagctgggactgcaggtgcatgctaccatacccagctaatttttttttttttttttaaagatgcggtttcattatgttgcccaggcttgtctcaaactcttggcctccagtgatcctccttcctcagccttccatagcattgtgattccagacatgagccaccgctcctggcctccaactgaaattttatgttctttgacaaacacttcatgaagcattcttccctggcaaccaccattgcactctctgcgtttatgcgttcagcttttttagattctacatacgagatgatacagtatttgtctctctgtgcctggttcatttcacttcacattgtatcttccagtcccatccatgttgctgcaaatggcaggatttcctttttcatggctgcatactattccattgtgtgtctatgccacatttgcttgatacgctcatctgttgattgacacatgggttgattctatatcttggaaactgttagtagtgttggcagtgcacagggggtgcaggtatcccattgatgggctgatttcctttcctttgggcacacaccaagcggtgggatgactggatcctgcacaacattctttcctttggtgtttcgcaggcccgtttctggactttagtgaacgtcttcccagtgtccatggcgtccgtcccttggccacatgcttagggaacatcttcagtgtgtacatggcgacagtcccatagccacattcttagggaatgtcttcagtgtgtacacggtggcagtccctttgctgcatgcttagggaacgtctacagtgtggtccattggccacattcttagagaacgtcttcagtgtgtacactgtggcggtcccttggccacattcttagggaatgtcttcagtgtgtacatggcggcagtcccttagccacatgcttagcgaacatcttcagtgtgcacagggcagtggtcccttgggccacatgcttagggaacgtcttaagtgccgtcccttggccgttttcttagggaatgtcttcagtgtgcacatgtggcggtcccctggtcgcattcttacggaatgtcttcagtgcgtacacggtggtcccgtagccacatgcttagggaatgtcttcagtgtgcacagggccatattcttacggaatgtcgtcagtgtgcacatggtggtggtcccttggccacattcttagggaatgtcttcagtgtgtacgtggcggaggtcccttagccacaagcttagggatcatcttcagtgtgcacagtgcgggagtcccttgggccacatgcttagggaatgtcttcagtgtgtacatggtggtggtcccttagccacatgcttagggatcatcttcagtgtgcacagggtgggagtcccttgggccacatgcttagggaacgtcttcagtgtgtacagggcagcagtcctttggctgcattgttagcgaacatcttcagtatgtacatggctgtggtcccttagccacaagcttagggaacatcttcagtgtgcacacggtggtggtcccttgggctacatgcttagggaatgacttcagtgtgtacatggtggccatcccttggccccatgcctagggaatgtcttcagtgccttgccttggctgcattcttagggaacgtcttcagtgcgtacatggcggtggtcccttagccacatacttagggaacgtcttcagtgtgtacaccgtggtggtcccttggccacattcttagggagcgtcttcacttcttacatggtggtggtccccgggccacattctaagggaacgtcgtcagtgcctacacaatggtggtcccttggccgcacgcttggggaacgtcttcagtcacagccctggttggtcccttggccacattcttagggaatatcttcagtgcatacacggtggcagtcccctggtgtcattcttagggaacgtcttcagtgcggtccctcaaccacatgcttagggaatgtcttcagtgctgtttcttagccatattcttagggaacctcttcaatgtgtacacactggtggtcccttggccgcatgcttagagaacatctttagtgcagtcccttggccacattcttagggaacgtcttcagtgtgatcccttggccacattcttagaaaacgtcttcagtttgtacaaggtgacagtccattggccagaatgtgtccctgccacattcttctgagtgtctgtgtctgtgttctttccaccctgtaagctgcttttgcttcttcactgggtgtctgtgactctcatgtggaatccctttcctctgtcaccgcccatcccaggcacagtgagagacgcagccagcctgctcctctctgcacctcgccatcccagacatcctccagccaccgtgctgaccgcattcattccttctcctgccctgtccgcatccttcttcccctacacgtttgataccaagaaatggtctgaatcacagccaaggcttcatttgctttctggaactgcagctccccagccccacccagatcagagattcagaacctgaatcttcggatttctggagatgcccccatcctatcagagacttctagtgtgtttctttatatccgtgtagacttgggaggatgacaggagagaaaccttagaaggtggtctgtgcatttcccgggcccggggtggaaggggcttgtgtcctggctgcctctgtgcacctttcattcttttttttttttttgagacggagtcttgctctgtcaccctgtcacccaggctggagtgcagtggagggatctcggctcactgtaacccctgcctcccaggttcgagcaattctcctgcctcagtctcctgagtagctgggaatacaggcatgtgccaccacgctcggctaattttatatttttagtagagatgggtgttcttcatgttggtcatgttggtctcgaactcctgacctcaggtgatccatccgcctcggcctcccaaagtgttgagatgacaggtgtgagcccccgcgcctggccgcacctttctttcttgatccacctggttttaaactcacagataaactgtttccacctgtgacaaatgagtcatccaccttccatgtggtctggactttgtccctgttacaatattcctgtctcttgtttctggttttttgcatcccacatgttgtccctgtaacagtcctgtctgttgtttctggggtcacccgtgtggcgagctgactgtgccacgttcctgaggctggtgaggatgctgtgggcaccttaatcacggctgtgaacaaactggctagagctaggtgccatggagctttgcagtggacactaagtcgtggtacccattctttgatcagtgacggagccaggtgtcttattaggtcttggggatttgtggaagcccagagcagggaaacagcttctacattgaaaggaatccttctcacactcatgttggcatcgtgaagtccctgatttcctaagacactaccctaatattttaaaagacttacaaaaaatttagtaaaatattcctaatagcagcacatgtggtgtttttttgtttgtttgtttgttttcgagatggagttttgctactgttgccaaggctggagtgcagtggtatgatctcggctcactgcagcctccgtctcccaggttcaagggattctcctgcctcagcctctcaagtagctgggattacaggcatgcactaccacacccggctaattttgtatttttagtagagacgggtttttccatgttggccaggctggtcttgaactcccgacctcaggtaatccgcctgctttggcctcccaaaatgctgggattacaggtgtgagtctccacacctggtcaatcccattctttttcaagaatgcatagtattctgtggtgtatgtacaccaccttttctttatccagtctacgtggcgttgttttgaggaatggatgaaatgatttgcataaaaacagtgaatgctttctattggaatggtgtttgcctcctgggaaactgtggagtcattgcaattgcaatttcctagtagatttgattaattaagagcattgggaatttttggggtgcctgatgcactattacagatatttttttcacagtgtagatatctcagcatgaatatgtctgttttcttttcttttctttcttttttttttttttgagatggagtttctctcttgttgccaaggctggagtgcaatggctcaatcttggctcactgcagccaacatctcctgggcttaagcagttctcctgcgttagcctctggagtagctgggattacaggcatctgccaccatgcctggctaatttttttttgtgtgtgtgtttttagtagagacagggtttcaccatgttggcctggccggtctcaaactcctggcctcaagtgatccacctgccttggactccgaaagtgctgggatgacaggcctgagccatggcggccagctgtctgttttctttccataagaggtgctggtctcaccgtggctctgtgctgtgatgaaatggcattgtccaagttttactcctcacagcctgattttgtatgttaaagacgtcttccttggtgtgaatcaagtgggctgggcagagttaagggagccatttatttagaaggcgattagatcgaattatgtcttggtaattactgcagttacaccaccccattctttccgtggctctcctagctgggtttgtggctagtcatggaggtgccctgaagagcctcattttcccacagctgtaggaagtgtgtggtacacccacaatgtcttagcttttgtattagggaaggtcttcagtgcattcccttggccacattcttagggaacatcttcagtgtgtacatggcggcggtcccttaaccacattcttagggaacgtgttcagtgtgtacacggtggcagtcccttggctgtatgcttagggaacgtcttcagtgagtgtgatcccttggccacatgcctagggaacatcttcattgtgtacctggcggcggtcccttagccacatgcttagggaatgtcttcagtgtgtacacggtggcagtctgttggccccatggttagggaacatcttcagtgtgcacagggcggcggtcccttgtgccacatgcttagggactgtcttcagtgtgtacatggtggcggtcccttggtcgcattcttagggaacctcttcagtgtgtacatgtcggcattcccttagccgcatgcttagggaacgtcttcattgtgttcttggtggcagtcccttagccacatgcttagggaacgtcttcagttgtatacagtggggtcccttggtcattatgcctaggggaacgtcttcagtgccagctgcattcttagggaatgtcttcagtgtgcacatggcggaggtcccttagccacatacttagggagtgtcttcactgcacacagcagtggtcccttggttgcattcttagggaacatcttcagtgtgcacatggtagcagtccctcacccacattcctagggaatgtcttcagtgtatacatggtggcagttctttggctgcatgcttagggaacatcttcagtgcattcccttggccacatgcctagggaacatctttagtgctgtcccttccctgcatttttagggaacgtcttcagtgtgtacatggtggcggtcccttggccgcattcttagggaacgtcttaagtgtgtacatggcggcggtcccttagccacaagcttagggaacgtcttcagtgtgtatatggtggcagtctcttggccacatgcttagggaacgtcttcagtgccatcttttagctgcattcttagggaacgtcttcagtgtgtacatggcagaggtcccttagccacacacttagggaacatcttcagtgtgtgcacagcagtggtcccttggcctcattgttagggaacgtctttggtgtgtagatggccgccgtcccttagccacaagcttagggatcgtcttcagtatgcacagcgtggcagtcccttgggccacatgcttaaggaatggcttcagtgtgtacaccgttgtggtcccttggccacattcttagggagcgtcttcagtgccgtcttttggctgcattcttagggaatgtcttcagtgcgtacatgggggcggtcccttagccacatacttagggaacgtcttcagtgtgtacatggcagtggtcccttggccccattcttagggaacatcttcagtgtgtacatggtggcagtcccttaatcacatgcttagggattgtcttgattgtgtacatggcgatggtcccttggccacatgctttgggaacctcttcagtgcatacggagtggcagtcccttgtccacattcttagaaaacgtcttcagttcgtacacggtggcgatcccttggccacattcttctgagtgtctgtgtctgtgtcctttccaccctgtaagctgcttttgtttcttcattgggtgtctctgactctcatgtggaatccctttcctctgtcaccgcccatcccaggcacagtgagagacgcagccagcctgctcctctctgcacctcgccatcccagacatcctccagccaccgtgctgaccgcattcattccttctcctgccctgtccgcatccttcttcccctacacgcttgataccaagaaatggtctgaatcacagccaaggcttcattatctttctggcactgcagctccccagccccacccagatcagagattcagaacctgaatctttggatttctggagatgcccccatcctatcagagacttctagtgtgtttctctatattcgtgtagacttgggaggatgacaggagagaaaccttagaaggtggtctgtgcatttccggggcccggggtggaaggggcttgtgtcctggctgcctctgtgcacctttcattcttttttttttttttgagacggagtcttgctctgtcaccctgtcacccaggctggagtgcagtggagggatctcggctcactgtaacccctgcctcccaggttcgagcaattctcctgcctcagtctcctgagtagctgggaatacaggcatgtgccaccacgcccggctaattttatatttttagtagagatgggttttcttcatgttggtcatgctggtctcgaactcctgacttcaggtgatccatccgcctcggcctcccaaaatgttaggatgacaggcgtgagcccccgcgcctggcggcgcctttcattcttgatccacctggtttcaaactcgcagataaactgtttccacctgtgacaaatgagtcatccaccttccgtgtggtctggactttgtccctgttacaatattcctgtctcttgtttctggtttttggcgtcccacgtgttgtccctgtaacagtcctgtctcttgtttctggggtcacccctgtggcgagctgactgtgccacgttcctgaggctggtgaggatgctgtgggcaccttaatcacggctgtgaacaaactggctagagctaggtgccatggagctttgcagtggacagtaagttgtggtacccattctttgatcagtgacggagccaggtgccttattaagtctcggggatttctggaagcacagagcaggcaagcaccttctacactgaaaggaatccttctcacactcatgttggcaacgtgaagtcctgcctttggaaatccctgatttcctaagacactaccctaacattttaaaggacttaaaaaaaattcagtaaaatattcccaatagcagcacatgtagtgttttatttatttatttatttttgagatgatttgcactcttgtcgcccaggctggagtgcaatggtatgatctgggttcactgcaacctccgtctcccgggttccaaggattctcccatctcagcctgtaaggtagctgagattataggcatgcgccaccatgctcggctgattttgtatttttagtagtgacagggtttcaccatattggtcagggtggtctcgaactcctggcctcaagtgatccacccatcttggcctcccaaagtgctgggattatgaatcactgctcctggcctactttttaaactttcaggttcaggggcacgtgtgcaggttcattacacgggtaaattgcatgtcctgggggtttagtgtacagattaattcatcaaccaggtagtaagcctactaccatctgataggtagttttttgatcctctcatttgtcccaccctccaccctccagcaggcccctgcagctgttcccttctttatatccaccagtgcccaatgtttagctgtcacttatcagtgggaacaggtggtatttggttttctgttcctgtgtaagtttgctaaggataatggcctccacctccgtgcatgttcctgcaaaggacatcatcccattttttttttttttttgagacagtttcctttttgttgcccaggctggagtgcaatggtgtgatctcggctcaccgctaccaccagctcccgggttcaagcagttgtcctgcctcagccttctgagtaactgagattacagacacatgccaccacgcccggctaattttgtatttttagtagagacggggtttctccatgttgcccaggctggttttgaactcctgacctcagttaatctgccctccacggcctcccaaagtgctgagattataggtgtgagccaccacacccaaccaatcccattctttttcatgggtatgtagtattccatagtgtatatgcaccaccctttgtttatccagtttacatggcgttgttttgagaaatggatgaagcgatgtgcatgaaaacactgaatgcttcctactggaggggtgttcacctttccgggaaactgtggagtgattgcaattgcaatttcctagtagatttgattggttaatagcattgggaatctttggggtgcctgatgccctattgcagatcttttttcacagtgtagaaatctcaacgtaaatgtctttttttttttttgagatggagttttgctcttgttgcccaggctgcagtgcaatggctcaatctcggctcactgcagccaacatctcccgggtttgagcaattctgcctcagtctcctgagtagctgggattgcaggtgcctgccaccacacccggctaatttttgaatttttagtagagaaggggtttcagcctattgttcaggctgctctcgaactcgtgacctcaggtgatccacccacctcggcctcccaaagcgctgggatgacaggcgtgaccgcgcccagcccagtgtggatacaccttgagcacataactggaatcctttccttggcaacttggagccccttgggtcatggtcatataaagggtgttgaattaagaggaaacactgttaaatatgtcacagctgtccttgaaactgggacttgttttgttttctgcctggaaatgcgagtcatttttctggaaaattcatttttcgttaaaaaaagtaattgtatacacgtatatgaggtacaacgtgatgttttaatccacgtacacatcatgcaatgattaaatcaagctagttaccatattaacaatcacattaactaacatattaataatcaggctaattaacatattaacattgaagctaattaacatattaacaatcaagctaatttacatattcacataattctaactctaacctatatcacctcacctacttttttttgtagtgagaatatgtaaaatctacttttagtcattttgaaagacgtgatgtattattaactatcatcactgtgtggtgtgatagaacttggaattcatttgttttatctaactgaaaaaaattaattttaatgtaatttatatgttttttgagacagtctcatcctatagccaggctggagtacagcatcatgttcatagctctcagcagcctccaactcatggctcaggtgaccctcccacctcagcctcccaggtagctgggactacaggtgcacaccaccacacctggttaatttttaaattttttgtagagatggggtcttgctatgttgctcaggctggtcttgaattcctgggctaaagcgatcctcctgcctcagcctcccaagtagctgggactacaggtgcatgccaccatatccagttaattttttcagttttttttttatttgtttagagatagggtttcattacgttacccaggcttgtctcaaactcctggcctccagtgatcctccttcctcagccttccatagcacagtgattccagacatgagccacagcgctcctggcctccaactgaaatgttatgttctttgacaaacacttcagcattcttccctggcaaccaccattgcactctctgcgtttatgcgttcagcttttttagattctacatacgagatgatacagtatttgtctctctgtgcctggttcatttcacttcacattgtatcttccagtcccatccatgttgcgcaaatggcaggatttcctttttcatggctgcatactattccactgtgtgtctatgccacatttgcttgatgtactcatctgttgattgacacatgggttgattgtatatcttggaacctgagtagtgctgcagggcacaggggatgcaggtatcccattgatgggctgatttcctttcctttgggtacacacccagtggtgggatgtctggatcctgcacaccattctttcctctgatgttttgcaggcctatggctggacctttggaacgtcttcactatgtacaaggtggcggtcccttggccacattcttagggaacgttttcagtgtgtacatggtgtcggtcccttggctatatgcttagggaacatcttcagtgggtacatggtggcggtcccttagtcatattcttagtgaatgtcttccgtgtgtacacggtggcagtcccttggctgcatccttaggcaacgtcatcagtgcagtcccttggccacatgcttagggaacgtcttcagtgcatacacggtggcggtcccttggccacattcttagggaatgtcttcagtgtgtacatggtcgcagtctgttagccacatgcttagggagcgtcttcagtgtgtatagggtggcggtcccttggccacatgcctagggagtgtcttcagtgccgtcgcttggctgcattctttgggaacgtcttcaatgtatacatggcggcggtcccttggctgcatttttagggaacgtcttcagtgtgtacatggcggcggtcccttatccacattcttagggaatgtcttcagcgtgtacacggtggcagtcccttggccgcatgcttaggggacttcttcagtgcggtcccttggccacatgcctagggaacgagtcttcagtgccgtcccttggctgcattcttagggaacgtcttcggtgtgtacatggtggtggtcccttgggcgcattgttagggaacgtcttcagtgtgtacatggcagtggtcccttagccacatgcttcggaatgccttcagtgtgtacatggcggaggcccctcagccacgtgcctagggaatgtcttcagtgctgtcttttagcggcattcttagggaacgtcttcagtgtgtacatggtggtggtccctgagccacatacttagggaacgtcttcagtgtgcaacggcagcggtcacttggccttattgctagggaacttcttcagtgtgtacatggcggtggtcccttagccacaagcttagggaacgtcttcagtgtgtacatggcagcagtcctttggaccacatgcttagggaatgtcttcagtgtgtacacggtggtggtcccttggccccatccctagggaaagtcttcagtgccgtcctttggctgcattctttgggagcgtcttcagtgtgtacatggtggaggtcccttggccacattcttagggaatgtcttcagtgtgtacatggcggcggtcccttggccgcatacttagggaacgtcttcagtgtgtacatggcagtagtcccgtggccgcattcttagggaacctcttcagtgcatacacagtggcggtcccttggccacattcttctgagtgtccgtgtctgtgtacttttcatcctgtaaactgcttttgtttcttcattgggtgtctctgactcttatgtggtatccgtttcctctgtcagcgaccatcccaggcacagtgagagacgcagccagcctgctcctctctgcaagtggccatctcagacattctccagccagcgtcctgaccgcattcattccttcccctgcccggtccacatccttcttcccctacacccttgctaccaagaaatggtctgaatcacatcacaggcttcctttgctttctggaactgcagctccccagcccacccagatcagaggttcagaacctgaatcttcggatttctggagatgcccccatcgcatcagagacttctagtgtgattctttatattcgtgtagacttgggaggatgacaggagagaaaccttagaaggtggcctgtgcagttccagggcccagggtggaaggggcttccatccctggctgcatttgtgcacctttcattcttggtccaacattttttttttttttttttgagacggagttttactgtgtcgcccaggctggagtgcagtggtgtgatctcagctccctgcaacctccccgcctcctgggttcaagcgattctcctgagtggctgggagtacgggcatgcaccaccatgcctggctaattttatatttttagtagagatgaggtttctccatgttggtcaggctggtctcaaacccctgacctcaggtgatccatccaccttggcctcccaaagtgctgggattacaggtgtgagccaccacgtccggctgcactttttattcttgatccacctggtttgcaactcacagataaactgtttccacctatgacacatgagtcttccaccttccatgtcctctggactttgtccctgttataatattcctgtctcttgttctggtttttggcatctcacacattgtccctgtttcagtccggtctcctgtttctggtgtttggtgtgccgcacgttgtccctgttacagtcctgtctcttgtttctggggtcacccgtgtggagagctgactgtgccgcgttcctgaggctggtgaggatgctgtgggcaccttaatcacggctgtgaacaaactgactagagctaactgccacggagctttgcagtggacgctaagctgttgtactcattgtttgatcagtgacggagccagatgtcttattaggtctcggggatttgtggaagcctagagcaggcatgcaccttctacgtagaaaggaatccttctcacactcaagttggcgtcgtgaagtcctgcctttggaaatccctgatttcctaagacactaccctaacattttaaagggcttaaaaaatttcaataaaatgttcccagtagctgttacatgtagtcatgtagcgtttttttttttttttttgagatggacttttgctcttgtctcccaggctggagtgcaatggcgcgatctcggctcactgcaatctctgtctcccgcattcaagggattctcccacctcagcctgtcaggtagctaggattataggtgtgcgctaccatgccctgctacttttgtatttttagtagtgacagggtttcagcatgttgatcagggtagtctggaactccttgcctcaggtgatccacccgccttggcctcccaaagggctgggattatgaatcaccgcccccagcctacttttttcactttgatttcaggttgagggggacgtgcgcaggtaaattgcatgtcttgggggcttagtgaacagattatttcatcatgcaggtaataagtccagtaccacctgataggtagtttttcgatcctctcatttctcccaccctccaccctccagcatgcccctgcagctgttcccttctttgtatccatgagtacccaatgtttagctgccgtttatgagtgagaacaggtgatatttggttttcttttcctacgtgagtttgctaaggataatggcctccacctccatgcatgttcctgcaaagggcatcatcccatgttttctttttttctttttcttttgagactgggtttccttcttgttgcccaggctggagtgcagtggtgtgatctcagctcaccacaacctcctgttcctgggttcaagtgattctcctgcctcaggctactgagtcgttgagattacaggcgcataccaccacgctgggctaattttgtatttttagtagagacggggcttctccatgttggccagtctggtcttgagctaccgacctcaggtaatctgcctgcctcggcctcccaaagtgctgggattacaggcatgcgccgccacgcccaaccaatcccattctttttcatgggtccatagtattccatagtgtatatgctccaccctttctttatccagtctacatggcgtcctgttgaggaatggatgtaacaggcgtcgtgttcaggaatggatgtaacaatgtgcataaaagcagtgaatgttttctattggaatggcgtttgcctttctgggaaactgtggagtcattcgaattgcaatttcctggtagatttgattagctaagagcattgggaatttttggggtgcgtgatgccctgttgcagatattttttcacagtgtagaaatctcagcatgaatatgtctgttttcttttctctttttttttttttttttgcgatggagttttgctcttgttgcccaggctagagtgcaatggctgaatctgggctcactgcagccatcatctcctgggttcaagcaattctcctgcctcagcctctggagtagctgggattgtaagtgcctgcccctacaccctgatttttctttttttttgtatttttagtagagacggggtttcacctgttgggcaggctggtttcgaactcctggcctcaagtgatccacctgcctcagcctcccaaagtgctcggatgacaggtgtcagccacggtgcctggccgtctgttttcttttcataagaggtgctggactcacagtggctctgtgctgtgatgaaatgacattgccaaagttttactcctcacagcttgattttgtatgctaaacaggtcttctttggcgtgattgaggagggatggggagacttaagggagccatgtatttagaaagcgattagatcctgttatgtcttggtaattactgcagttacaacacgccattctttccgtggctcacctagctgggttcgtggctagtcatggaggcgccctgaagagcctcattttcccacagctgtaggaagtgtgtggtacacccacaatgtcttagcttttgtattagggaacgtcttcagtttgttcccttggccacatgctttgggaatgtcttcagtgtgtacacggtggctgtccctgggccgcatgcttagggaacgtcttcagtgaggtcccttggccatatgcctagggaacgtcttcggtgccatcctgtgactgcattcttagggaacgtcttcagtgtgtacatggcgggggtcccttagccccattcttagggaatgtcttaagtatttacacagtggcagtctgttggcctatggttagggaacatcttcattgtgcacatggtatcagtcccttgcgccacatgcttagggaattcttcagtgtgtacatggtggccgttccttggctgcattgttacagaacgtcttcagtgtgtacatgtcagcggtcccttagccgtaagcttagggaacgtcttcagtgtgtataaggtggcggtcccttggccacatgcctagggaacgtcttcagtgccctcccttggctgcattcttagggaacgtcttcagtgtgtacatggctgccttcccttagccacatacttagggaacatcttcagtgtgcacacggcagctgtcccctggacgcattcttagggagcgtcttcagtgcgaacatggcgggggtcccttacccacattcttagggaacatcttcagtgtgcacacggcagcagtcccctggacgcattcttagggagcgtcttcagtgcgaacatggcggcggtcccttacccacattcttagggaacatcttcagtgtgtatatggtagcagtcccttagccacacacttagggaacgtcttcagtgtgtgcacatcagcggcccttggccggattgctagggaacctcttcagtgtgtacatggcagcggtcccttaacccaagcttagggatcgtcttcaatgtgcaaagggcaatggtcccttgggccacgtgcttagggaatgtcttaagtgtgtacacggcggtcccttagccacatgcctaggaaacgtctgccatctcttcgctgcattcttagggagcgtcttcagtgcgtacatggcggccgtcccttagccacgtacttagggaacatcttcagtgtgtacatggcggtggtcccttagccacatacttagggaacgtctccagtgtgtacaggtggccgtctcttagccatattcttagcgaatgtcttcagtgtgtacacagcagtggtcctttggccacatgctttccgaacgtcttcagtgcatacagtggcagtcccttggacccattcttagaaaacgtcttcagttcgtactcggtggcgatcccttggccacattcttctgcgtgtctgtgtctgtgtccttttcaccctgtaagctgcttttttttcttcattgggtgtctctgactctcatgtggaatccctttcctctgtcaccgcctgtcccaggcacagtgagagacgcagccagcctgctcctctctgcacgtcaccatcccagacattctccagccagcgtcctgaccgcattcattccttctctttcccttgtccacatccttcttcccctacacgcttgataccaagaaatggtctgaatcacagccaaggcttcctttgctttctggaattgcagctccccacccccacccagatcagaggttgagaacctgaatcttcggatttctggagatgcccccatcgcatcagagacctctagtgtgtttctttatatccgtgtagacttgggaggatgacaggagagcaaccttagaaggtggcctgtgcagttccagagcccagggtggaaggggcttccattcatcactgccttcgtgcacctttcattcttgatccaaccgttgttgttgttgttttgagacggagtcttgctgtgtcgcccaggccggagtgcagtggtgtgatctcaggtcactgcaacctccgcctcccatgttcaagcgattctcctgccacagcctctctgagtagggagctgctaaaataaaataccttcagttgggtaatttataaactagagacatttatcactcacagttctgaaggctggaggttcaagatcatggcagattcagtgtgtggtggggatgcactccctggttcatagacgacgcattttctctgcctgctcacatggtggaaagggcgagggagctctctggggctccttttataaggacagtgatcctattcatgaggcttgatccccatgaagtcatcacctcccaagtctcccacctcctgacaccattgtcttaggggtgaggatttcaatgcaggaatttgggggaggaacacaaactttcagattgtagcaaataccattctttaaaaaaatgcagtaatagttaagctttttttttttaatttgataaattttccaagaaggaggagacacagaaaccctccgtgttttgaaggttaatattagtgctgtaaaatacacgtgggacttgggcttataaaaaattcctggtcatggcaaaatataggtggtttgcagtacctggggaagcccacctttcctgtttctgacatgtaacttttgtggaaattgcctgaaagttgtttctagttacccttcagtcctgtgtccaacccagcatgtccgatactatctaacattgttttttttttgagatggagttttgctcttgttgcccaggctgcagtacagtggcacgatcttggctcgctgcaacctccacctcccaggttcaagcgattctcctgtctcagcctcctgagtagctgggattactaaattttatataaatgttgtgtcaagaaatattattgctcttttgcctttttttcccttaaccgttgagaaattcagaaaaaaacatttatgaacgtcaacactgtttttgacaagtaaacattgttcttggcaagtgggccttccaaaaataagggctggcgtttgtggaaactgctctactgttctttttttttcttgctacttttttctttttttttttttttgaggcactaattggaatccacttattcgtcctgggtggagaaagagttcagatctaacactgggggctctgtgtttccttaggtaatacatatgaagtttttgtcactgtaattcagtaatctgtgttaatattatcacaaaagagcagagtggcatttgtgtcttctcagaattgcttattaaaacagctgcatggccagccgcggtggctctcatgcctgtgatcccagcactttgggaggccgaggccggtggatcgcttgagcccaggagtttgagaccagcctgggtaacatggccaaacctcatctctactaaaaatacaaaaagtgagagcgtgcctgtagtcccagctactgaggaggcagaggtgggaggatcacttgagcgtgggagttggaggctgcagtgagctgtgatcacagcctgggaaaccaagcgagagatgctgtgtctaaaattataaaaataaaaattagccaaacatggtgccacgcgtgtgtggtcacagctacctgggtggctgaggtgggaggatcactggagcccacaaagtcgaggctgcagtgagctgagattgcatcactgtcgtgcagcctgggcaccagagtgagagacaccctgtctctaaataaataaataagttcatgattaagcagaagttgtgcttgttctgccgggatttcagttgggttctttgtgccctaatttacgtgagctagtaggttgtgcgttatcttagagggcttgcatgaaagaaagagggtagcctttcttttccctgttttggtagcattgctgaggtggcttttggctgacgggtggacccgtgggtgcagatgttttgatgcagaaggaacgattgccttttcacattcaggctccaactggcttttagcttgtgcgttcttaccctggggtgttcgaggtcaccggactcctattttatttgtgtttaactggaaaggcaggaactctgagaacgtatcaaatagccagtttactgcaggctttctagaatttaaatcgcttccaaaactggatccacaagctaggaattatgtttaagttttaaaaggtgttggtttgcttcttacatgtctaaattcttgggggaaaaactgcaaagaataataaagtttcatgattcaaaaatggtatgaggccgggcacaatggctcacacctgtcatcccagcactttgggaggctgaggcaggaggatgatttttgagaccaggagtttgagatcagcctgggcaaacagcgagatcctgtgcctacaaaaataaaataaaaataggctgggtgtggtggctcatgcttgtaatacctgcactttgggaggctaagtcagtaggatcacttgaactcaggggtttgagaccagcctggtcaacataatgagaccttgtctctagtaacaataaaaaaattagctggacataaggtgtgcatttgtagtcccagttacacaggaggctgaggtgggaggatcacttgagcctgggagttggaggctgctgtgaaacgtgatcgcaccactgcactccagcctgtgcaacaaggagagagatgctgtctctaaaaaaaaaaaaaaaagccagacgtggtggcacacgtgtgtggtcacagctacttgggaggctgaggctgaaggatcgcttgagcccaaggaggctgaggctgccataagctacgatcatgccactgcactccaggctgggcaatagcctgggcgactgtctcaaccaaaataaatttaaaaagataggaaatttcaatgtgaaaatcagtgtcccccagaacgttccatttcttcccagctgggctatttttggagttccatggggagccggctcagtgcaccttgcatgtactcaggaggatgagccctgccatggtgtgtgttaggggacagcctgatctcaccaaccctcctgagcaggcccggccctccgagtaataactgggaacactcgccgctttgtgagaggacctcgtgtgctcactggaaggtcatctcttctggtccacgctgcagtgtggatactttttttgtttgtttgtttgtttgagaaggattattgctctttttgcccaggctggagtgcaatggcatgatctcggctcactgcaacctccacctcctgggttcaagccattcttctgtctcaacctcctgagtagctgggattacagtcgcccgccaccacacccggctaatttttgtatttttagtagagacagggtttcagcatattggccttgctgttctcaaactcctgacctcaggtgatccacctgcctcagcctcccaaagtgctgggatgacaggcgtgagccaccgcgcccggcccagtgtagatacaccttgagcacataactggaatcctttccttgacaacttggagccccttggaacatagtcatataaactgtattgaattaagaggagacaccgttaaatatgtcatagctgtcctcaaaactgggtcttgttttgctttctgcctggaaatgggagtcacttttatagaaaatttattgttcgttaacaaaaaataattgtgtgtgtgtgtatatatatattgtatgtgtgtgtatatatatatatatatatatatatatatacacacagacacacattctctctctctctctctctatggtacaatatgatgttttaatccaagtacacattgtgcagtgattaaaccaagctagttaccatattagcaatgaagctaattaacattaataattaagtgaattaacatattaaccattgacctaattaacatattaacaatcaagctaattaacatattaacaagctaatttacatattcagataaccctaactctaacctatatcacctcacttcgtttttttggtgatgagaatatgtaaaatctagttttagtcattttgaaagatgcaatgtattattattaactataatcactgtgtggtatgatagaactttgaatttatttcttttatgtaactgaaaaaatttaattttaatgtaatttatgtttttgagacagtctcaccctctatcacccaggctggagtgcagcgtcatgttcatagctcatggcagcctccaactcctggcacaggtgaccctcccacctgagcctcccaggtagctgggactacaggtgcacaccaccacacctggttaatttttaaagttttgtagagatggggtcttgctatgttgctcaggctggtcttgaattcctgggcagaagtgatccttctgcctcagcctcccaagtagctgggactgcaggtgcatgccaccatatctagctaattttttcatttttttttatttttagagatggggtttcattatgttgcccaggcttctctcaaactcctggccttctgtgatcctccttcctcagccttccatagcattgtgattccagacatgagccaccgctcctggcctccaactgaaatgttatgttctttgccaaacacttcatgaagcattcttccctggcaaccaccattgcactctctgcgtttatgcgttcagcttttttagattctacctatgagatgatacgatatttgtctctctgtgcctggttcatttcacttcacattgtatctttcagtcccacccatgttgctgcaaatggtaggatttcctttttcatggctgcataccattccattgtgtgtctatgccacattcgcttgatgcacttatctgttgattgaacatgggttgattctatatcttggaaactattagtagtgctgcagtgcacagggggtgcaggtatgccattgatgggcagatttcctttcctttgggtacacaccgagcggtgggatgactggatcctgcacaacattctttgctctgatgttttgcaggccaatggctggaccttagggaacgtcttcactttgtacaaggtgggggtcccttggccacattcttagggaacgtctgcagtgtgtacacgatgttggtctcttgaccacatgcttaggaaacatcttcagtgtgtagctggcagcagtcccttagccacattcttcccgaatgtcttcagtgtgtacacggtggcagtccctagtcctaattcttcgggaatgtctttagtgtgtacatggcggcagtcccttggccgcattcttagggaacgtcttcagtgtgcacactgcggtggtcccttagccacaagcttagggaatgtcttcagtttgtacttggtggcggtcccttggctacatgcttacggaacatattccctgccgtctcttggctgctttcttagggaacgtcttcagtgtgtacatggtggtggtcccttagccacaagcttagggaacgtcttcagtgtgcacaccgtggctgtcccttgggccacatgcttagggaacgtcttcagtgtgtacatggtggcagtcccttggccacattcttagggaacgtcttcagtgtgtacagggcggcagtcctttaaccacatgcttaggggaaccatcttcagcatgtccacggtggcggttcttttgcggcattcttaggggatgtcttcagtgtgtacatggcggctgtcccttagccacaggcttagggaacgtcttcagtgtttacatggtggcggtcccttggccacatgcctagggaatgtcttgagtgctgtcccttggctgcatcttagggaatgtcttcagtgtgtaaatggtagcagtcccttagccacatgcttagggaacgtcttcagtgtgcacacagcagaggtcccttgcgccacatacttagggaacgtcttcagtgtgtacatggtggtggtcccttggccacatccttagggaacatcttcagtttctacacagtggccatcccgctgccacattcttagggaacgtcttcagtgcctacatggtggtggtcccttggccacattcttagggatcatcttcagtgtggacccttggccacattcttagaaaacgtcttcagttcatacatggggacgatcccttggccactttcttctgagtgtctgtgtcatttgctccctgtaagctgcttttatttcttcattgggtgtctctatcatgtggaatcccactcatctgtcaccacccatcccaggcacagtgagagacacagccagcctgctcctctctgcacgtggccatctcagacattctccagccactgtcctgaccccattcattccttctcctgcacggtccacatccttctttccctacacccttgctaccaagaaatggtctgaatcacagccaaagtttcatttgctttctggaacagcagctccccagccgcactcagatcagagattcagaacctgaatcttcggatttctggagatgcccccatcccatcagagacttctagtgtgtttctttatattcgtgtagacttgggaggatgacaggagagaaaccttagaaggtggcctgtgcagttccagggcccagggtggaaggggcttgcatccctggctgcctttgtgcacctttcattcttcatccagctgttttttttttttttttttgaagaggagtcttgctgtgtcccccaggctggagtgcagtgctgtgatgtcagctcactgcaacctccgcctcctgtgttcaagccattctcctgccacagcctcccgagtagctgggattacaggcacctgccaccacacatggctaatctttgtatttttagtagagatggggtttcatcatgttggccaggctggtcttgaactcctgacctcaggtgatccacctgcctcagcctcccaaagttctgggataacaggcatgagccactgcgcccggccgcacccttcattcttgattcacctggttacaaactcgcagataaactgtttctacctgtgacaaatgagtcatccatcttccatgtggtgtcgactttgtccctgttataatattcctgtctcttgttctggtttttggcgtcccgcacattgtccctgttacagtcgtgtctcttgtttctggggtcacccctgtggtgagttgactgtgccctgttcctgaggctggtgaggatgctgtggacaccttaatcacggctgtgaacaaactggctaaagctaggcaccatggagctttgcagtggatgctaagtcgtggtacccattctttgatcagtgacggagccaggtgtcttattaagtctcggggatttgtggaagcccagagcaggcatgcaccttctacattgaaaggaatccttttgacactcaacgttggtgtcgtgaagtcctgcctctggaaatccctgatttcctaagacactaatctaacattttaaaagagttaaaaaaaaatcagtaaaatgttccccatagaagcatgcagtgttttgtgtgtgctttttattgttttttttttttttttttttgagacgaagttttgttcttgtcgccaaggctggagtgcagtagcacaatctcggctcactgcaacctccgtctccagggttcacgggattctcccgcatcagcctgtcacgtagctgggattataggtgtgtgccaccatgcccgactaattttgtatttttagtagtgacagggtttcatcatgttggtcagggtggtctcgaactcctggcctcaagtgatccacccgccttgccctcccaaagtgctgggattaggaatcactgctcccggcctacttgtttttacttttatttcaggttgaggggcacatgcgcaggttcgttacacgggtaaattgcatgtcctgggggtttagtgtagagattatttcatcaaccaggtaataagcctactaccacctgataggtaatttttcaatcctctcgtttgtcccaccctccaccttccagcaggccccggagtctgatcccttctttatatccacgggtacccaatgcttacctaccacttatcagtgagaacaggaggtattttgtcttctgttgctgtgtaagtttgctaaggataatggcctccacctccatgcaggttcctgcaaaggacatcatcccgtttttttttttttgagatggggtttccctcttgttgcccaggctggagttcaattgtgtgatcttgactcaccgcaacctctggctcccgggttccagtgattctcctgccttagccttctgagtagctgagattacaggtgcatgccaccacgcccagctaattttgtgtttttagtagagacagggtttctccatgttggacaggctggtcttgaactccggacctcaggtaatccacccgcctcggcctcccaaatttctgagattacaggcgtgagccaccacgcccaaccaatcccattctttttcatgggtgcatagtattccatagtgtatatgctcccacctttctttatccagtctacatgacgtcgttttgaggtatggatgaaatgatttgcataaaaacagtgaatgctttctattagaatggtgttggcctttctgggaaaccgtggagtcattccaattgcaatttcctagtagatttgattggttaatagaattgggaatttttggggtgcctgatgcacactattggagatcttttttcacagtgtagaaatctcaacatgaatatgtctttttttttttttgagacggagtttctctcttgttgcccaggccggagtgcaatagctcaatctcggctcactgcagccaacatctcccgggttgaagcaattctcctgcctcagcctcctgagtagctgggattacaggtgcctgccaccacacctggctaatttttgtatttttagtagacacagcgtttcagcatattggtcaggctggtctggaactcctgacctcaggtgatccacccgcctcagcctcccaaagtgctgggatgacaggcgtgagtcacagcgcccggcccagtgtggatacaccttgagcacataactggaatcctttccttggaaacttggaaccccttgtgtcatggtcatataaactgtgttgaattaagaggagacactgttaaatatatcacagctgtcctcgaaactgggacttgttttgctttctgcctggaaatgcaagtcatttttatagaaaatttatttttcgttaacaaaaaataattgtatacatatatatggtacaatgtaatgttttaatccaagtacacattgtgcaatgattaaatcaagctagttaccatattaacaataaagttaattaacatattaaaataaagctaataacgtattaaccaagctaattaacatattaacaatcaagctaattaacatattcacataatcctaactctgacctatatcacctcacctagttttttttgtggggagaatatgtcaaatctacttttagtcattgtgaaagacgcgatgtattattaactatcatcactgtggtgtgatagatcttggaatttatttgttttatctaactgaaaaaaattaattttaatgtaatttatgtattttttgagacagtctcaccctatagccaggctggagtacagcatcatgttcatagctctcggcagcctccaagtcatggctcaggtgaccctcccacctcagcctcccaggtagctgggagtacaggtgcacaccaccacacctggttaatttttaaattttttgtagagatggtgtcttgctatgttgctcaggctggtcttgaattcctgggctgaagcgatcctcctgcctcagcctcccatgtagctgggagtacaggtgcatgccaccatacccagctaattttttgttttttttttttagagatggggtttcattctgttgcccaggcttatctcaaactcctggcctcaagtgatcctccttcctcagccttccatagcattgtgattccagacatgagccaccgcttttggccagcaactgaaattttgtgttctttgacaaacacttcagcattctttgctggcaacaaccattgtaccctctgcatttatgtgttcagcttttttatattctacatatgcgatgatatggtatttgtctctctgtgcctgtttcatttcacttcaccttgtatcttccagtcccatccatgttgctgcaaatgacaggatttcctttttcatggctccatactattccagtgtgtgtctatgccacatttgtttgatgcactcatctgttgattgacacatgggtttattccgtctcttggaaactgagtagtgctgcagtgcacagtggggcaggtatcccattgatgggtacacacccagtggtgggatgactagatcctgtacaccattctttcctctgatgtttcgcaggcccatgactggacctttggaacgtcttcactgtgtacaaggtggtggtcccttggccacattcttagggaacgtcttcaatgtgtacatgacggccgtcccttggccacatgctcagggaacatattcagtgtgtacttggcagtggtcccttagccacattattagggaatgtcttccgcgcgtacacagtggcagtccgttggccgcatgcgtagggaacgtcatcagtgcggtccattggccacatgcttagggaacatcttcagtgtgtacatggtggtctcttggccacattcttcgggaacgtcttcactgtgtacatggcggaggtcccttgggcgcatggttagggaacgtcttcagtgtgtacatggcggaggtcccttatccacattcgtagggaatgtcttcaatgtgtacacggtggcagtcccttggctacatgcttagggaacatcttcagtgcggtcccttgaccacatgcctagggaacgtcttcagtgccgtcccttggctgcattcttagggaacgtcttcagtgtgtacatggtggtggtcccttagccacctgcttagggaacgtcttcaatgtgcacatggcagcagtcccttggccacattttttgggaacatcttcagtgtgtacatggcggcggtcccttagccacattcttagggaatgtcttcagtgtgtacacggcggcagtcccttggccgtatgcttagtgaacgtcttcagtgagtacatggcggcgatcccttagtcacctgcttagtgaacatcttcagtgtgtatatggcggcagtcccttaaccacatacttagggaacgtcttcagtgtgtacatggcagtggtgccttagccacatacttagggaatgtcttcaatgtgtacatggcagtggtttcttagccacatgcctagggaacgtcttcagtgttgtcttttagttgcattcttagggagcgtcttcagtgtgtacacggcagcagtcccttggccgcattcttagggaaccttttcagttcatacacagtggcggtcccttggcaacattcttctgagtgtcagtgtctgtctgtgtccttttcaccctgtaagctgcttttgtttcttcactgggtgtctctgactctcatgtggaatcccatttctctgtcaccgcctgtcccaggcacagtgagagacgcagccagcctgctcctctctgcacgtggccgtctcagacattctccagccaccgtcctgaccgaattcattccttcccctgccccgtccacattcttcttcccctacacgcttgctaccaagaaatggtctgaatcacagccaaggcttcatttgctttctggaactgcagctcccagccccacccagatcagaggttcagaacctgaatcttcggatttctggagatgcccccatcctatcagaggcttctagtgtgtttctttatattcgtgtagacttgggaggatgacaggaaagaaacctttgaaggtggcctgtgcagttccagggcccagggtggaaggggcttgcatccctggctgcctttgtgcacctttcattcttgatgcaacttttttttttttttttttaaagatggagtcttgctgtattgcccaggctggagtgcagtgctgtgatctcagctcactgcaccctccgcctcccgggttcaagcgattctcctgccacagcctcctgagtagggagctgctaaaataaaataccttcagttgggtaatttataaactacagacatttgtcactcacagttctaaaggttggaggtttaagatcgtggcggattcagtgtctggtggggacccacttcctggttcatagatgatgcattttctctgcgtggaaggggcgagggagctctctggggtcccttttataaggacactgatcccattcatgaggctcgatccccatgatctcatcacctcccaagtctcccacctcctgactccattgtcttaggggtgaggatttcaatgcaggaatttgggggaggaatacaaactttcagactatatatagcaaataccattctttaaaaacatacagtaatagttaagctttttttttttttaatttgataaattttccaagaaggaggagacacagaaaccctccttgctttgaaggtgaatgttagtgctgtaaaatatacgtgggacttgggcttataaaatcttggtcacggtaaaatataggtggtacgcagaacctgggaaagcccacctttcctttttctgacatgtaacttttgtggaaattgcctaaaattgtttatagttagctcttcagtcctgtgtccaacccagcatgtccgatactatctaacattctttttttttgagacagagttttgctcttgttgccaagcctggagtacagtgacgcgatcttggctcgctgcaaccttcacctcccgggttcgagcgattctcctgtctcagcctcctgagtagtttggattactaaattttatataaatgttgtgtcaagaaataatattgctcttttgactttttttccctaagcattgagaaattcagaaaaaacatttataaacataaacactgttcttgacaagtgggccttccaaaaataagggctggagtttgttgaaactgctctactgtgttttatttatttatttatttattggtacttttttccttttttttttgaggcactaattggaatgcacttatttgtcctgggtggagaaacaattcagatctaacactgggggctctgtgtttccttaggtaacgcatgtgaggttttcgtcagtgtaattcggtaatctgtgttagtattattacaaaagagcaggggggcatttgtgtcttctcagaattgcttattaaaacagctgcatggccaggcgtggtggctcacgcccgtaatcccagcactttaggccggtggatcgcttgagtacaggagattgagaccagcctgggcaacatggccaaactccatctctactaaaaatagaaaaaattagtatgtgcttatattcccagctactcaggaggcagaggtgggaggatcacttgagtgtgggagttggaggctgcagtgagctgtgaccacagcctgggcaaccaagcgagaggtgctgtgtctaaaaatacaaacataaaaattagccaaatgtggtggcacgcgtgtgtggtcacagctacttgggaggctgaggctgaaggatcgcctgagcccaaggaggttgaggctgcagtgagctagcatcatgccactgcactccaggttgggcaatcgcctgggtgtgaccctgtctcaaccacaataaatttaaaaagataggaaatttcaatatgaaaatcagtgtcccccagaatgttccatttcttcccagctgggctatttttggagttctatggggagctgtctcagtgcaccttgcatgtactcaggaggatgagccctgccatggtgtgtgttaggggacagcctgatctcaccaaccctcctgagcaggcccggccctccgagtaataactgggaacactcgccgctttgtgagatgacctcgtgtgatcatttgaaggtcgtctcttctggtcagggtgcagagtggacacatttttttttttttttgagacagagttttactcttgttgcccaggctggagtgcagtggtgcgatcttagctcactgcaacctccacctcctgggttcaagccattctcctgtctcagcctcctgagtagctggcattacaggcgcccgccaccacacccagctaatttttgtatttttagtagagatggggtttcagcatattggtcaggccagtctggaactcctgacctcaggtgatccacccgcctcagcctcccaaagtgctgggatgacaggcgtgagccaccgcgcccggcccagtgtggatacaccttgagcacataactggaatcctttccttggaaacttggaaccccttgtgtcatggtcgtgtaaactgtgttgaattaagaagagacaccattaaatatgtcacagctgtcctcaaaactgggacttgttttgctttctgcctggaaatgcgagtcatttttatagaaaatgtattgttcattaacaaaaaataatcgtatacatatatatgaggtacgtgatgttttaatccaagtacacattgtgcggtgattaaatcaagctagatactatattaacaatcaagtcaattaacatattaataatcaagctaataaacacattaacaatcaagctaattaacatattaacaagctaattaacatattcacataaccttaactctaacctatatcacctcacctacttttttttgtggtcagaatatgtaaaatctacttttagtcattttgaaagatgcgatgtattattaactatgatcactgtggtgtgatagatctttgaatttatttcttttatgtaactgaaaaaatttaattttaatgtaatttatatttttttgagacagtctcaccctatcacccacggtggagtgcagcgtcatgttcatagctcactgcagcctccaactcctggctcaggtgaccctcctgagcctcccaggtagctgggactacaggtgcacaccaccacacctggttaatttttaaattttttatgtagatgggatcttgctatgttgctcaggctggtcttgaattcctgggctgaagtgatcctcctgcctcagcctcccaagtagctgggactacaggtgcatgccaccatacccagctaatttttttgtttttgttttttttttagagatggggtttcattacgttgcccaggcttgtctcaaacttctggccttcagtggtcctccttcctcagccttccatagcattgtgattccggacataagccaccgctcctggcctccaactgaaatgttatgttctttgacaaacacttcatgaagcattcttccctggcaaccaccattgcactctctgcttttatgcattcagcttttttagattctacatacgagatgatatggtattctctctgtgcctggtttatttcacttcacattgtattttccagtcccatccatgttgttgcaaatggcaggatttcctttttcatggctgcatactattccactgtgtgtctatgccacatttgcttgaggcactcatgtgttgattgacacatgggttgattctatatcttggaaactgtgagtagtgctgcagtgcacagggggtgcaggtatcccgttgatgggctgatttcctttcctttgggtacacaccttatggtggaataactggatcctgcacatcattctttcctgtgatgtttcacaggcccatgactgaaccttggggaatgtctttactgtgtacaaggtggcggtcccttggtcatattctttggaaacatcttcagtgtgtatacggcgttggtcccttggtcacatgcttgggaacatcttcagtgtgtacatggcagcagtcccttagccacattcttagtgaatgtcttcagtgtgtacacggtggcagtcccttggctgcatgcttagggaacgtcttcagtggtgttccttggccacattcttagggaatatcttcagtgtgtacacggtttgtgtacagggcggtggtcccttagccacaagcttagggaacgtcttcagtgctgttccttggccacattcttagggaatatcttcagtgtgtacacggtttgtgtacagggcggtggtcccttagccacatgcttagggaatgtcttcagtgtgtacccgtggcggtcccttggcctcatgcctagggaatgtcttcagtgccgtcccttggctgcattcttagggaatgtctttagtgcgtacatggcttcagtgcgtacatggcggcggcccctcagccacatacatagctaacatgttcagtgtgtacactgcaacggtcccttggccccattctttgggaacatcttccttgcggtcccttggctgctttcttagggaatgtcttcagtgcctacacagtggcagtcccttgtccacattcttagggaacgtcttcttctgtacatggtgtcgatcccttggccacattcttagggaacatcttcagtgagtacatggcggtggtcccttggccacatttttagggaacttcttcagtgtgtacatggctaccgtcccttagcccatgcttagggaatgtcttcagtgtgtacatggaggtggtcccttggccgcattcttagggaccgtcttcagtgtgtacatggcggtggtctcttggccgcattgttagggaccatcttcagtgtgtacatggcggtggtcccttagccacaagcctcgagaccgtcttcagtgtgtacacagctgtcgtcccttgggccacatgcttagggaacgtctgcagtgtgtacacggtggcggtcccttggccacattcttagggaacgtcttcagtgaggtcccttggccacatgcttagggaatgtcttcagtgcctacacagcggcagtcccctgtccacattcttagggaacgtcttcagtttgtacatggtgtgggtcccttggccacattcttagggaacatttttagtgtgtacatggcggcagtcccttagccacattcttagggaatgtctttagtgtgtacatggtggtagtcccttggccgcacacttctggaacgtcttcagtgcggtccctttgccacgttcttcgggaacatcttcagtgtgtacatgatggcggtcccttagccacaaacttagggaatgtctttagtgaatacacagcagcggtcccttggctgcattcttagggaacgtcttcagtgcggtcccttgaccacattcttaggaaatgtgttcagtgtgtacatggcgtcggtcccttggccacattcttagggaacatcttcagtgtgtacatggcggagtcccttagccacatgcttagggaacgtcctcagtgtgtacacggtggcagtcccttggccacatgcctagagaacatcttcagtgctgttcctttgctgcattcttagggaatgttttcagtgtgtacacggtggcagtcccttggctgcatgcttagggaacgtcttcagggtggtcccttggccacattgttagggaacatcttcagtgtgtacatggcggtggtcccttggccgcattcttagggaacctcttccttgtgtacagggcagcggtcccttggccgcattcttagggaaagtcttcagtgtgcccacggcagcggtcccttgggggtgaggatttcaacgcaggaatttgggggaggaacacaaactttcagatagtagcaaataccattctttaaaaaaatacagtaatggttaagcttttttttttcttgattgataaattttccaagaaggaggagtcaaagaaacgctccttgttttgaaggtgaaggttagtgctgtgaaatacacataggacgtgggcttatataaaaatcctggtcacggcaaaatataggtggtacgcagttcctgggaaagcccacctttcctttttctgacatgcaactttttcggaaattgcctaaaagttgtttatagttagcccttttcggccctgtgtccaacccagcgtgtccggtactatctaatgttctttgtttttgagacggaattccactcttgttgcccaggctggagtgcagtggtgcgatcttggctcactgtaacctctacctcctgggttcaagcaattcccccgcctcagcctcctgagtagctgggattaccggtgtccgccaccaggcccagctaatttttgtatttttagtagagacggggtttctccatgttggccaggctggtctcgaactcctgacctcaggtgatctgcccgcctcggcctcccaaagtgctgggattacaggtgtgagctactccgcccagcctaattttttattatttttaatttttaacattttttttttggagactgggtcttgctgtgtcccacaggctagagtgcagtggcatgatcatggctcactgcagctttgacctcctggactcaagccatgctcccacctcagcctcatgatagctgggactccaggtgtgtgccatcatgcccaggcaagtttttaaaaaaattatttgtagagatggcgtctcactatgtttcccaggttcgtctggaactctgggcctcaatggatcttcccacctgggcctcccagagtgctgggattacaggcatggggcacagtgcccagtccctcatgtgtgtaattgttcaacagctagagaaacccaaacacataccctcagacactgtcccgtctgccgcccaggtctcctcacctgcatggtttgctgttgccacttgatttaatggagggcataatgaatgacccttaaacacggcctctaagagtcctcgtaagtgccttcctcattaaaattcaagaggaatcaaatacctgttactgaatataaatgtttagaggagaaagcctgtgagctgagagtcatatcttaaggggtgtgtgcttgcagaattatcacattttcaatttcatgtgtgaataaattgttgtatttgggatcaccaagaaggcagaaacatgtatcaatgaaatttagtagacggctaaaaacaaacagtagcagcctactgaggggctgtggaataagcagattttagatttttagagggaaaacggtgatggtaggttatttccccaatggcttccaggcctccaactcaggcttggaattggccatggtcattggccctttttttttttttttttctttttgagacggagtctcgctctgtcgcccaggctggagtgcagggtgtgatctcagctcactgcaagctccacctcccgggttcacgccattctcctgcctcagcctcccgagtagctgggactacaggcttccgccaccacacccggctaattttttgtatttttagtagagatggggtttcactgtgttggccaggatggtctcgatatcctgacctcgtgatctgcccgcctcggcctcccaaagtgctgggattacaggcgtgagctaccgtgcccggcccattggctcttttttttaccatctcatcttctctcacacgagttattctcactgttggaaagaacttgtccttaaagcattgcttccaggtgagtgtaacggtgcccagcatgtgatacaagttaaaaataagagcagagcccaaatgctgtcattgcttgatccatcatttcccctgtcatgcagctcatttgagtaacagggtctcgtttcggggtgctgtgtccggagaggcagaactccccttggagaatgggtagagaatgtacatcacttgccaagtatggtggttttgcatgctgccttgactggacttgtttgcctttggttttctgtaagaatcttaggatatctgcccaggagttagacccctgggctaaagtaaggttgagggccagccacggtggctggtgcctgtaatccctggactttcggaggctgatgtgggaaaatcacttgagtccaggagtttaagaggagcatgggcaacgcagtgagacccccgtctatataaaatttaaaaaaaattagctggacatggtggtgtgcatctgctcccagctactttggaggctgaggtgggaggatcactggagcccaggaggtggaggctgcagtgagccatgatcacaccactgcactacagcttgggtgacagagccagaccctgtctctacgaaacacaaataaaaagtaaaatgaggttgagaaactccgcctccctcttgatttcaaggtaatactcagcttctagattgacacacacacaagtcattgtcttatcatagtgacatgtgacggaacacgcacgtgtctggtgacagatggtgcattgaggggaacattccttaagctgtgtttccttggggaaagaggcaatagcattctctgttagtacagaacccttcagtttgtacaaatgtcttcggaaagggaatattcctgagagcttctacgtggcagttaacaagtcacacttttcatctcagatgtctcaatttccagaagatggtacttgattacatttcctggggttcttgtttctaggaaatcgcggctgggtttttctagaaataatgcagtgatttggggacctgtggcactgggaagggtatgatctcaggcacaggactgcaaagacacgttgtttaccggccagcatgataactaggcgtgacgctgatggccagtgtgttgcatacgtactgggctttattatccatacctggatggaactgaatatatatatatacacacacacatagacacccataatatattatacaatgtaattatatatcatcatatatcatatatattataatatatacagttgacctttgaacaacacaggtgtaaactccataggtccatttatatgtggattttctgccacctctgccacccccgagacagcaagaacaaccctttttgttcctcctcctcctcctcagcttcttcagcatggagacgatgaggatggagacctttaggatgatccacttccactcgatgagtagtacatatgttttctcttccttaagattttcttaatagcattttcttttctctagcttactttactgtaagaatgcagtatataatacatagaaacacaaaataaatacaaacatgtgttgagaatgtagtatataatatatataaatacaaaatacatgttgattgacagtggcatgatctcagctcactgcaacctctgccttctgggttcaagcaattcttctgcctcagcctcccaaatagctgggcctacaggcgcacgccaccacacccagctaattttttttgtatttttagtaaagacggagtttcaccatgttggccaggctggtcttgaactcctgacctcgtgatccacctgcctcagcctcccaaagtgctgagattacaggcgtcaaccactgtgcccagccgtgtgagtctttatggtagaacaatttatattcctctgggtgtgtacccaataatgagattttcagtagactttgagtgaagccgatagctgttcataatgtgggtgggccttgcctaatcagtggaaggtcttaagaggtaaaaagagtccctcctccaaggaagagggaattctatctggaatccaccttcagacttgagctgcgacatcatgtctccatgggcatctggcctgctggtctaccctgcacattttggttttgcccctcccccacatcttgggagccagttctttaaaatctctttctctctatatatatatcctactggttgtttctctgcagaactgtcactcatgcagatctgtgtccacagatgacatcattgcaaagccactaagagagacatagcatccagggaatggaaggaccaggttcctttcagacttgaagacacgtcaaaacacattccaccgcgttgccttggagaacccagggaccaggcctcttcccctcctgtcaaatagtccttagcctttgttcttcttgctccttgtgaatttcacaggcttccttgactttgaattctgctccttggatgtctttgttggtgaacgtgatgagatagaattttggaaagctccgaggtgtgatcattgcaccctgggactgacacgtgctccgtcttcactgaagacagccggaagccgtggtgttccagaacttgaatgtggctgtggaaactagagtgtccatgcatcctgggcggtagctactggtgccgtctgcgtcgtctgtagctcctcattgctgattctcattcggctgcctcagtcaggacagggctggttacagcgttgctcttcatgctgttcaagtcagggtgatctacagggacagaacgaataggactgatgtgtatatgaaggggagtttactaggataattgactcacacgatcacaaggtgaagtcccacaataggccgtctgcaagctgaggagccaggaagccagtccaaggcccaaaacctcaaaagtaggcaagctgagagtgcggccttcagtctgtggtcgaaggtccaggagcccctggcaaatcactggtgtaggtccaacggtccaaaacccaaagaccctggggtcttgatgttcgagggcaggaagcatccagcatgggagaaagatgaaggctagagatcccgccactgcactccagcctgggtgacagagcgagactccgtttcaaaaaaaaaaagaaagaaagaaaaacatttaaaaagcagaaatgagctggatgcggcatcttctgcttgtaatcccagcattttgggaggccaaggtgggtggattgcttgagcctaggagctcgaaaccagcctgggcaacatacggagaccctgtctctacaaaaaaacacaaaaattatctggccatgctggtgcacacctgtagtcccagctactcaggaggctgagatgggaggtttggttgagcctgggaagttgaggctgcagtgagccatgattgccccactgcactccagcctgggtgaaagagtgagaccttgtctcaaaaaaaagaaaaagaaaaaagaacaaataagaagacagacacacctctcttctttgtgtgggtacagccgttggcaaactttgctgacagatgctactgaccttgttttcctttctgcattctgttcatttcaaaagtgggtaaatcagaagtgggactcactgtgaccttcagtgactcaatgctgaattcacaagattaattggagagtgtgaagaatgcagggcatccgtggacccattttaatgaattttagcatctcttgcatccttgtatccttgcatccagtaccggtccccagccttttagtaactgggctgtgcagcaggaggtgagtagcgtgtgagtgagcaaagcttcatctgtattgacagctgctccccatagctcatattacctcctgagctctgcctcctatgagatcagtggtggcattagagtctcataggagcatgaaccctactgtgaactgaacatgtgagggacctaggtggcgtgctccgtatgaaaatctaatgcctgatgatctgtcactggctctcatcacccgcacgcagatgggaccgtctagttgcaggaaaacaagctcagggcttccactgattctacacgatggtgagtttcataattacttcattctctattacagtgtaataataatagaaataaagtgcatgataaatagaatgcacttcaatcatccccaaaccatcccccaccccacatcagtggaaaaatggtcttccatgaaactggttcctggtgccaaaaagcttgaggaccactggacaaaggaacttgtcagagtatggattgaaggtctttattgatgctttgctgtcactcttactttaagatgaatgcgtatatatatgtatatacattctgtaatgtgtgaatatatgaagctccagctgctctctccctctctttcctctgcagtccaattctcgtagatcagtcttttcctgaaatgaatgacctcttaaattttattttatattttaagcttttatgttattttactttatttttaagctgtttttattttttaagcttttttttttttgagacaaaaaagtctcgctcttgtcacccaggctggagtgcaatggcatgatctgagctcactgcaacctccacctcctgggttcaaaaaattctcctgccccagcctcctgagtagctgggactacaggcgccagccaccacgctgggctaatttttgtgtttttagtagagacagggttttaccatgttggccaggctggtcttgaactcctgacctcatgatccacccacctcggcctctcaaagtgttgggattacaggtgtgagccaccacaactggccagtttgcaggtctttgttgatgctttgctgtcaatcttactttaagacgaatgcatatatatgtatgtgtatacattctgtaatgtgtgaatatatgaagctccacctgctctctccttccctctcctctgcagtccagtactctcctagatcattctgttcctgaaatgaacgaccattttttttttttttattttgagatggagtcttgctctgtcccccaggctggagtgcagtggcgtgatctcggctcaccgcaatgtccgcctcctgggttcaagcgattctcctgcctcaccctcctgaggcaggattacaggcgccagccatctcgcccggctaattttttaatttttagtagagatggggtttcaccatgttagtcaggctggtctcaaacttctgacctcaggtgatcagcccaccttagcctcccaaagtgctgggattacaggcgtgaagccactgcacgtggccggtttgcagtctttattgatgctttgctgtcaatcttactttaagatgaatgcatatatatgtgtgtgtgtgtgtgtgtgtatgcattctgtaatgtgtaactatatgaagctccagctgctctctccctccctctcctctgcagtccaatactcctagatcattctgttcctaaaatgaatgaccattcaggttttttttttttttttctgagatggagtctcgctctgtcacccaggctagagtgcagtggcatgatctcggctcactgcaatgcccacctcccgggttcaagcgattctcctgcctcggcctcccaaagtgctgggattacaggcatgagccaccgcgcccggccagaattcagttttttttttttccccatggttatccaatagcacacaggctcgtgaagccttcaaggtgcttcatctgaggttcgcttagaatggttgccacatattgttctgccggtgagttttcatgaattggactctgaaggttcttaattatggtggttgagtgacacggtctttcttctataagaacctaagttacactgcatatcaggaaaatgtgttcctgggaccagctttgttgggtttttggctgctggtcatcttcactttactctcccaaatttgaggactgtgacacacacacacacacacacacacacacacacacactctctctctctctctctctctctctctgtctctcttaggaaacaatggtatatcaacaatgaaatgatgcttttttttcttcttcttttttttttgagacagggtcttgctctgtcacctaggctggagtgcactgatatgaacatggctcactgcagccttgctctcccaggctcaagcaatcctcccacctcagcctcctgagtagctgggaccacatgggcacaccatcacacctggataatttttgtatttttagtagagacggggtttcactatgttggtcaggctggtcttgaacttctgacctagtgatttttctacctcggcctcccaaagtgctgggattacagacatgagccaccagactcggctgagcatcttttcaatatgaccttgtgtccgggcatggtggctcacacctgtaatcccagcactttgggaggctgaggtgggcggatcacgaggtcaggagatcgagaccatcctggctaacacggtgaaactccatctctactaaagatgcaaaaaaaattagtcaggtgtggtggcgggcacctgtaatcccagctactcgggaggctgaggcaagagaatggcatgaacccaggaggcagagcttgcagtgagccgagattgcaccactgcactccagcctgggcaacagagcgagactcggtctcaaaaaaagagaaaggattcaaggcagtgtataccaaacatgaaagtaaagttcaggaacctctttgatggaggagatgacggtggggtctgtagcctgttcatgcctataattgcaacacgtcgggaggccaaggtgggaggatcacttgaggccaggagtttgagatcagctcggccaacatagtgagaccccatctctacaaaaataaaaataaattagtggggcatggtggcacacacctgtagttccagctacttgggggactgaggcaggaggatcacttgaaaacaggagtttgagatcagcctgaacaatggagcaagaccctgtctctacaaaagattaaaaaaaaaactggcagatgtgctggcacgtgcctgtagtcccagctgcctaggaggctgaggcaggaggattgcttaagtctgggagtttgaggctgcagtgagctgtgttttcaccactgcactccagccggggtgacagagcaagaccctatcagtagtagtagtagtaataataataataataataataataataataataatatgttgctgcaaaagtaattgctgcttttgccattaacttttgcaccaacctcatgataaaacaacaaaaactcaacacctgtacctgccatgccctgaagctcatgacagtagacaaaactcactgtgtctccagccctcagtgttagatgaagggaccagggtgtgggaagatcagcagttcaaacgggaatcataaaacacatagtttttatttttttagttttgttttattatttatttatttatttttgttgttattatttttctgagatggagtctccctctgtcacccaggctggagtgcagtggtgtgatctcggctcactgctacctctgcctcccgggttcaagtgattctcctgcctcagcttcccgagtagctgggattacaggtgcgtgctaccatgcccggctaatttttgtacttttagtacagacggggtttcaccatgttgattgggctggtctcaaactcctgacctcgtgatccgcctgcctcggcctcccaaagtgctgggattacaggcgtgagccactgcgcccagcccccatgaaacatatagatattttcaaaacaactgtactaggatcaagaaggataggacttttgtttttcctgttttttaagaatgaaatatcatatggcgtaagcatagatttatttatttacttacttatctattcatttatttttagagacaggatcttgctctgttgcccaggctggagtgcagtaatgcaatcatagctcactgcagccttcaagtcctgggctcaaacaatcctcccatctcagcctcccacgtacctgggactacacatgcaagccaccatgcctggctaagttttaaatttctttgtagagatggggtcttgctatgttgcccaagctgatctcaaactcctggcctcaagtgattgtctcaccctgacctcctaaagtgttgggattacaggtgtgacccactgcttcctgcctagactttttttttttttttccaattaaggtttttactttgagatcattgtagatttataagcagttgtaagaaataataggaaagaatcttgtgtctacttcccccagtggtaacatcttggaaagcaataataccatgtcacaaggaggatattcacattcaggcaataatgcattgatcttatgttttactcgtatccgtgtgggtttttgtaccgagttctgtgcaatttcatagtgcgtgcaggtttgtgaagccagcattgtccgcaacacacagagcatttctttcaccaacaacccctcctgtttctctctctgcatcctacctcaacctcctctcccgtcctgaacccctgagaattactagtctgttctctatttctgtaccaacctgcatcctacctcaacctcctctcctgtcctgaacccctgagaattactagtctgttctctatttctgtaccttttctcatgtcaagaatgtcatataaatggagtcatacagagtgtaacccctttcaaatcacgtgtgtctttttttccttcactcaatagaattccctggagagccatccaagttgttgctaagaacaataagatgtttctttttaagtaacacctgcaaaaagtcttttataaaatggcgatgaaactaaatggtttttgattctaaacaaggcagccatgaatggttttctcgtatatcttagcatatgtgtgggagtgtatctgtgcaagtaattcttggaagtggaatagctgagccaaaaagaaaatgcatgtaaattttcttttctttattttaaagagacagcgtcttgctctgtcacccaggctggagtgcagtggtgcaatcatagcttgccgcagcctcgacctcctgggctccagtgatcctcccatttcagcctccagggtagctgggactacaggcgagcatcaccacgtctggctaatttatttttatttttgtagaggtagggtcttgctatgttgcccaggctgggcctcgtgctcctagcctccgctgatcctcccaccttggcctctcaaagtgttgggattacaggcataagctaccaggcctggctgcctgtcacctttcaggagtcattgtcaacttatctcctaagaaaatgcagtcttggtgggtacatttgaactgagtatgtaaacttctaacttctccaaggcatacgcattctggataacaaccctactttttaacctattccatgtgattgatgaaagctcacaattgctttattcattatttcattgtcagcgagactgaactttgtttcatatgcttatgttttatttcatatctccaaattgcatattcatttcctttacccatttgtggagggactggggtttggttagaagagctctttatagaccgggcgcggtggctcacgcctgtaatcccagcactttgggaggccgaggcgggcggatcacgagatcaggagatcgagaccatcctggctaacacagtgaaaccctgtctctactaaaaatacaaaaacaaaattagccgggcgtggtggcgggcgcctgtagtcccagctactcgggaggctgaggtgagagaacggcgtgaacccgggaggtggagcttgcattgagctgatattgcgccactgcattccagcctgggcgacagagcgagactccatctcaaaaaagaaaaggttagaaaaatacaccatggaatactacgcagccataaaaaggatgagttcatgtcctttgcagggacatggatgaagctggaaggcatcattctcagcctaataacgcaggaacagaaaaccaaacaccacatgttctcacttacaagtaggagctgaacagtgagaacacagggacgcagggagggggacatcacacaccagaacctgctgggggctggggaacaaggagagggagcgcattaggacaaatacctaatgcatgcagggcttaaaagctagatgatgggttgatgggtgcagcaaaccaccgtggcacatgtatacctatgtaacaaacctgcgcgttctacacatgtatcccagaactttaaaaaaaaaagaaatagtatttcaatatggtctgaattaggatgtctgttattagatataaaggagaacatatgtgttgagggccatttgagcctgttctgtatataaactcttatttttgcccttttctttgtagcatgtttggggtttttctggagttgaactttttagatatctgaaaaatagctgttaatatttctgatggaagttgcaaattttcttccagctcattatttattttttactttgcttatggagatttgttttgttttttaccatgtgattttttttttgagatagtgtcttgttcctcctggagtgcagtggcacgatcttggctcactgcaacctccatcccttgggctcaagtgatcctcccatctcagcctcccagcttgctggaactacaggcacgcaccgccacacccggttaattttttaaattttttgtagagatgaggcctctctctgtttcccaggctggtcctgagcttttggcctcaagcgatacccccacctcagccctcaaagtgctgggattacaggcatgagccactgcccggcctgttttttaaacaagtagttttttaaatagtgaaatctatctaaccatctttctgaattttcgtttaggaagcattttctttctgtggaggttaaactaatgattcctgctttcttgcaatcttctcatggtttaactttgtttttgccttggagttcactcatgcatgctatgaggtctggcactaattttatctgtttcctaatgtggcttcacgtgccccaacacggtttattaaaacgcccatcttttgccccttttgtcgtgtactcaatttccacatgcagttggcctatttttggaaattgtaccctgttccttcctccattaatgcctgtagtacctcccgtttaattatagaagcttctcaaatgttttaatctcctacagggccattgtgttctcaatctttgtacatatcagaattttcctctttgccgcctcatttggaattcttttccccacagcaattttcgaatcgattcgtccagtttgcctaaaagaaattctgtgaactatctttattggatcacatcaaatttgcatattgacttgggtcattctgacacctttaggattgtatcagtttagattttttttccccctccaacttctattttattttttaaattaaaaaaaattttttttttgagacggagtctggctctgtcgccctggctggagtgcactggcgtgatctcagctcactgcaagctccacctcccgggttcaagcgatcctcctgcctcagcctcccgagtcgctgggattacaggtggcacacaccaccacgcccagctaaattttgtatttttagtagagatgcggtttcaccatgttggccaggctggtcttgaactcctgacctcgtgatccacccgtctcggcctcccaaagtgctgggatgacaggtgtgagccaccgcatctggcctcaacttctattttaggttcgggggtacatgtgcaggtttgttccctgggtatattgtgtgatgttgaggtttggagcacaaggatcccgtcacccaggtagtcagcacagcactcaatagttttccaacccttgccccatcccttccttgccccattgaattgctcagtgtttattgttcccatctttatgtccatctgtacttgatgtttacctcccagtaagaagtgagaacgtctgatatttagtttcctggttctgtgttaattcacataggagaatggcctcctcttgcatctatattgctgcaaaggacatgatttcattctttttaatgggtgcatagtattccatggtatagatgcaccatgtcttcctaagaattgaattaacatttgagccagcaatcccattactgggtatctacccaagggaaagtaagtcattctaccaaaaagacacacgtactgtgtgttcatcgcagcactattcataaaagcaaagacatggaatcaaacttaggtgtctgtcaactccggattggacaaagtttgggggttttttttgtctttttttttttttttgtgagatggagtctagctctgtcgcccaggctggagtgcagtggcacaatctcggctcactgcaagctctacctcccaggttcacgccattctcctgcctcagccttccgagtagctgggactacaggcgcccgccaccacgccaggctaattttttgtatttttagtagagaccgggtttcaccgtgttagccaggatggtgtcgatctcctgacctcgtgatccacccgcctcggcctcccaaagtgctgggattacaggcatgagccaccgtgcccggccgtcttttttttgttttgttttgagacagtcttgctctgtcacccaggctggagtgcagtggtatgatcggagctcactacagcctcaacctcccagtcttgcgtgatcctctgaactcagcctcccgggtagctgagatgacagccgtgtgccaccatgcctggctaatttttttgtacctttttttttgttttgtagcaatggggcttcactatgttgcccaggctggtcttgaactcctgggctcaagcgatctgcctgccttggcttcccaaagtgctgggattacaggcatgagccactgcgcctgacccatttgggtctttggagaagcacacaccaagaaggaacatgatgggccagagatttactaggggaactgtgtgtgaagggtcaaacaggcgctggcagaagagtggaggaaggcttgcaggtgatggtgtaggtgcctcacacctgtgaagaaagagacggcgaggaattgggtagaaggagcgtccagccagttctctggtcatgccgagtcattggctgtgaaaacccaaaaccctgaggaagcccgatcttgcgaaacatgttccccatctgcagaggcaccgggtggctggtgtcaggcgattgttgcaacctgttgtgtgcgggggtgtctgtgtgggtacatacatacttctcagccccaatgccagcttcctggtccgtaaggaaaacactaaactcttctagctaaagttacaaatgcagcaagggtccattctgcaatctgtgatgcttttttttttttttttgagctggggtctcgctaccttgcccaggctgcggtgcagtggcacaatcacggctcactgtgcgttttcagggaagaccccacgggcacctccaaaaccatgtggcatgacatcctcaccgagacccgagggcatctttccatggcctcaactctacttttatgtctttaggtttcctgatataggttttgcacactctcgatgaccaagtctcatttcagtgttgctgttgtttctatattataagcaggactgtctcttcccctacctttttaacctgccaattgtttgtgtatgtatggaagctattgatatttgcttctgagttttctatctgactaccttcctgaattctcttcttggatttatttaatgttgattttgttagttttttcctggcataccatcatatcatctgcaaagtatattttgactctccctctgccgttcttgtgtctgttgtaattatttgtctgaccatgttggataagatctccagtagcatgttaaatgacagggtgcactcctggaatccagctctttgggaggccggggtgggaggatgacttgagccccggagatcaagaccggtctgggcaacacagcaagaccccatctttacaaaaaaaaaatagtaaaaaaaattagccaagtgtggtggctcacacctgtagtcccagctacttgggaggctgaggcaggaggatcatttgagtccaggaggtcgaggcttcagcgagccatgattgcaccactgcactgcagcctgggcaatgtagtaagaccccagctcaaaaaaaaaaaaaagcatcacagagaacaggatggatacttgctgcttttccaagtttagctggaagattttagagatttctttattgactaggaagttggcattggggctgagaaatatgtatgtacacacacagacacacccacacacagacacacatgtatacatacacagtatatatgcatactgtgtgtctgtaattacaatttaataatacattcctatttttaaaataaacttagtaaattaagaacatcaatacatctactgatactacatatagtatttgcaagtccctcagcttgggtcaggaacacgggaatgtcattgtacaggttctatcttcaggttacgagggatacaccagaaaacctaagcatatggaaaacttattcggcaattttctaagtgaacataccttttcatcgattcatgcgtgtatcaagaaaaacaaaatgaaagtcttacacaccaagaggattgttcgcacaatactgacaacgaaatgtacgggctgacaaataacagattatatgttgaagcctcctccacaggccccacctcctgataccatcaccctggcgattgtatgttctcaacataggaattattttggggggagaggagacacaacattttatacttggaaaggtgaaatggaaaagcagcataggctttattgttttattttattttattatactttaagttctggggtacatgtgcagaacgtgcaggtttgttacataggtatacacgtgccatggtggtttgctgcacccatcaacccatcatctacattaggtgtttgtcctaatgctctccctcccctagtccctcacctcctgacaggccctggtgtgtgatgttcccctccctgtttccatgtgttctcattgttcaactcccacttgtgagtgagaacatgtggtgtttggttttctgttcttgtgttagttcgctgagaaggatggtttccagcttcatccatgtccctgcaaaggacatgaacccatccttttttatggctgcatagtattccatggtgtccatgtgccacattttctttattcagtctatcgttgatgggcatttgggttggttccaagtctttactattgtgaacagtgctgcaataaacatacgtgtgtgtgtcgttatagtggaatgatttataaacctatttctatttaaattacctttgtatttttatagattttgtgggtatgagtacacttgtgttacatgaatatattgcatagtggtaatgtttgggctgttagtgaggccatcactcaaataacgtacatggtagccaataggtaatttctcatccctcatcccatcccaccctgtgagacttctgagtcctcgatgtctattttttatgctctatgtcgacgtgtacacattatttaattcccgcttataagggataacatgtggtacttgactttctgtttctgagccatttcacttaggataatggcctccagttcccttcgtgttgctgcaaaagacacaacatcattccttttcatggctgtgtagtattccatggtatatatgtgccatattttaaaaaatcaaattgtctgatggtggacacttaggctttatattttaataaagaacattccaaatatgttgaacaaaataatctcctaacttgaaaaagatcatatgtgcctataataattcacagaaagggactttcctgactacctgcctgcaaaatccacttttccctcagtctttctttctcaagggaattcatggaaattccctccttgaattttctcagcccccagtacaaggagtcattcttgcctcatcatgtccccctctctgtccttgtcttgtgatttctttttattttgaacgcgagaagtctgactcccaccagcacccctgtggccagtacctgtgagacatattctgaatccagcacctctcataccacctgtgctgaactgtggcggagctcccccgtcagtccctgcagctgcttcaggagacccttgatagccttgtcttcctccagctcaagtggattctccatgaatctattccttcctgtgaaacatatcacagattggctcagagccccgtgatgacgccctgtctgccagagagaagctcacgaactctggggtgcccctactccttcttccctcctctcttccctccttccatgtgcttggctccagctagccagccagccgccttcctcttcctggaatatcccaggcctgctagacttttgctctcaccgtcacaacatcagctcaggagcccctccttggaagattgttctctaaccctccgtccagaatcactgcttctccctttcctcttcttcctttgaagttcattcataactggaagatgtgagatctggaaagttctgcattattgccagacacatctgtgtatttagagtggttggtatctttcccaggggaaccaaatgtccttgaggcagacaacatgtttatctttgtctaattcatttccctgtatgctgggcacagagtgtgggctctacacatattttataaaagaaggagggaagggttagaagatggacagaaggaaggaggaagaaaggaaggaaagagggaggaaagaaaggaaagagggagggaaggaaagagggaaagaaggaaggaaagagtgagagaaggaagtaaagaggaaaggaagggaagggaaggaaggaaggaaaaagtgagagaaagaagtgaagaggaaaggatggaaggagaaaggaaggaaagggagggaaggaaaaaggaaaagaagaaagaaggagtgagacaaggaagtaaagaagaaaggagggaaagaggaaaggaaagaaggaaagagggagggaaggaaggaatgaagaaaagaaagagggaaggaaggaaggaaagaaggaaggaggaaggaaggaaaaagggagggaaggaaggaatgaagaaaggaaagagggagggaaggaaggaaggagggagggaaggaaagagggagggaaggaaagaatgaaggaaggaaggaatgaaggaagaaaggaaaaagagaaggaaggaggaaggaaggaaagagggaaggaaggaaggaaagatggagagaaggaagggaggacaagtggaaggaagaaaaagaaatacaaatctccctcaaaatgtggatcactcgtcttaaccagaaattcaagtgagatgctatctgcacgtgtgataccagcagctatgaagcaaactgtattaaccaagtcttttattttctgtgttctgatgcatgactttcatggccttgtcaaccctagagaccctgcccctcccatagctagcgaatccccagaggtggtgaagagcccacctatgaacctgtctttcatatgcaaacccatcaatccagaatccaccccccagccatctcctttattggggttgcatattccacgtcactctccacctgccctaaccaccccaaagccaggtaccagagagtcagggacagcccctatgccccagagcctgctgaaatcattcacactagccaactgtaagcctactcgcctgttccttcccttggaaaccacagtgagagctctggtctcctttgtcttcccacctgaccaaacttggtgcgcccctgtgtggtcctgagtggtgtcaacacgcccctcctcttgggacctgtgagtaacaaaccacttgcttaacggcagtctcctgatctgttggccccaccatacctacatcataataaagtctacattttacaacgcaaacgaacaaaaatgtcctgctcagtgctgccctgagagcagaggttattccaggattcttgctcgcctctgtaaagggtatccgttctgcagacctttctgccggtcacactgacggcatattgcagagcctgccagggactcacaggggatgacaggggatttatcaggtggttttttactgcactgtcattactgggggcgaatccactttaatacattcatgcctcctgagcctgtgggaattcaagaggaacagaaccagaaataaatgaaccataactccctttggcatcttgcctctctggaggcttaattcttacaaatatgtgctctgctttcaaatcttagtttgatgattttctcttcttctttttcagttttccccccacgacctgaccgtgtcgctatagtgacgggagggacagatggcattggctattctacagcgaagcatctggcgagacttggcatgcatgttatcataggtgatgacttttacagttacttgtgttttttgttttttcggtttttttttttttctgagacaggatcgcagtccgtcaacccgtgctggactgcagtggtgcaatcttggctcactgcagcctccacctcctgggttaaagtgattctcctacctcagcctcccgagtagctgggtttacagacatgcaccaccacgcctggataatttttgtatttttagtagagacagagtttccatatgctggccaggctggtcttgaactcctgagctcaagccatccgcctgccgtggcctcccaaagtgctaggattacaggtgtgagccactgcgcctggcagagttagttgtgtcttatacctaatgtgagctacttaggtgtcgattcagacatgtatgcaaatgttgatgtgcatatagaaaattcagtcagatccagaaagctcatgaaggtgatattcacaacctagaaaacacagaaaattgttgtacccttttggaagtagatatatattctgcttaaatattgatcctgtgtttctttcacatggtttactggaaaaaaataaccatatatctttatgactttactagggctgttataacaaagtatctcaaggagactggaggttgcttaaaaagccaaaatttatttttcacaattccagaggctggaagttcaatatcacagtgtaagtagggctggttcctcccaattccagaggctggaggttcaatatcacagtgtgagtaaggctggttcctcccgacacctcactccttggcttgtagacaccatcttctccctgtgtcctcacagggtcgtccctctgtgtgttttcatctcctcttctcctgagatgtcttagtccatttcaggcgctataacagaattaccatagaatgggcagcttatatacaacagacattgagtttcccacagtcctggaggctggatgtctgagatccaggtgtgggcagggctggttcctcctgaggcctctctccttggtttctctctgtgtcctcacagggtcatccctctgtgtgtgtccgtgtcctcatatgctctccttataaggacaccagttcaattagatcggggcccactctggtgacctcattttaccttaatcaccactttaaagaccttatttccaaacacagtcacattctgaggccctgggctttaggacttcaatttatgaattttgttcaaacacaagctcctaacagaatctgaacaatgttgcgggatacttgtttcttctgcaaccatgacctatagacactcacggtttgatttctgctcttctttttgaaaatttctctaaaagcttatcgtgatctctgactcctcttcctctgtgacctcttcaggtctcccttcaactgggaatatgaggacagttcaaattaacccattccactactgccaatggagacggagtggggggcggggaggaggggagagagtctattgcatacctggggaagtctaaatcagctagcttaaatgatgtgtggagacgagcttggaaaaataaaagccttaatgtgtattatgcccactcttgacactatctgcatttaattaattattttcagacaggatcctactctgtcagcccagactgcagtgcagtgacataatcatagctcactgcaacctcaaactcctgggctccagcaatcctcctgactcagcctcatgagtcgctgatatgacaggcgtgcaccaccatgccaagctcattttatttatttatttattattgttttttttgagacagaatcttgctctgtcacccaggtggaatgcagtgacacgacctcggctcacggcatcccctgcctcctgggttcaagcgactctcctgcctcagcctccagagtagctgggattacaggcgcccgccaccatgccctgctaatttttgtatttttagtagagatggggttttgctttgttggccaggctggtcttgaactcctgacctcacgtgatctgcccacctccgcctcccaaagcgctgggattacagtcatgaaccaccgtgcctggccctggctcatttaaaaaagttattttggcggctgggcgtggtggcttatgcctgtaatcccagcactttgggaggtcaaggtgggcagatcacttgaggttaagagttcaagaccagcctggccaacatggtgaagccctgactgtcctaaaaacacaaaaattagctgggcttgggggtgagtgcctgcgtggtggtgggcgcctgtagtcccagctactcgggaggctgaggcaggtgaattgcttgaacctgagaggcggaggttgcagtgagctgagatcacgccactgcactccagcctgggtgacagagcgagactcagtctcaaaaaaataaacaaaatgttttggagatactgggtcttgctatgttgcccaggctggtcttgaactcctgggttgaagtgatcctcccaccttggcctcccaaagtgctgggattacaagtgtgagccactaggcctgggcaccctttgcttttaataacttttatggtgtctgcttttataaacatcatactgtaggtctggtttgagatatgcaggatcgtattgacttaacactttccaggacgggagcagtggctcatgcctgtaatcccagcactttaggaagccgaggcgggcagatcacgaggtcaggagatcgagaccatcctggctaacatggtgaaaccccgtctctactaaaaatacaaaaagtagctcggcatggtggcgtatgcctgtaatcccagctgctcgggaggctgaggcgggagcatcgcttgagccagggagccggaggttgcagtgaaccgagatcgcgccactgcactccagcctgggtgacagagtgagactctgtctcaaaaaaagactttccaaaaccaatgcccattattgattgacttcttcctctccgccattctctgtccttctttcccttgttgtcattatggaaagatgatcatggatcataaacaatgcttagggctggagatttcaacatgaatttgtctcagttcttccttatctttgaggagctctgtccaggacagacacttttctgggccttgaatgcctttgcgatagcccaaaaggctcaagcataagagcatgagtctgatctggtgaccagggctcagcaaagagtctttccaggccttgaacctctggacatctgttggtgctcattggacaggctaaaagtcatcatgttacgaatcgatgaagttgacatgcagataaaaggtataaggaaaaaatgaactctccacatcattgtatgcattacatctatacgataaaaactgtgatatactcatgcgtttaaatagctgctctggtcctgggcctcatgcgtttcaatagctgctagcgttctgagcctcgatggccatccacttggctttgagttagctctctccaaaaatctccatggcagtttctgctggggcaaatgcacggctgctgcccacacctctgtgttttctcatcttcatttacaaaagaagaaaatgctaaccttgctgatgctaacctcctgaatttcatgcaggaatccccaggagtctttgactcagatggggaaaccccatgttcagcccatgtggccttctggtctccctggagatgcgtggtccatgtcagcgcacatggctccttgctccgtccttcacttaagtttgagcctttttggcttttgcaaaacatgaatgcaaaacttgaaatttttctatgtcatggctcttcccaactttcacatttttgagacagcgtctcactctgtcacccaggctggagtgcaatggcgtgatctcagcccactacaacctctgcctcctgggctcaagcgatcctcccacctcagcctcccaagtagctgggaccacaggcgtgcaccaccaggcttggataattttttgtagttttagtagagatggggcctcaccatgttgcttggacttgtctcaaacacctgagttcaagcgatctgcctgcctcggcttcccaaagtgctgggattacaggtgtgagccactgtgcccagagtcttttaaaataataattttgtacacgcagttccattcctcatataaccatctttctctgatgcacttcagggtttgtaaaatagtatacagagatgtgtactgtttcacatgatgaagcttagttgtattagataatgataacatcgtgtttggctatgtcataatgaggcaattgagtagaatataatgaaatcttgttggattagttaatgacttgttgagcttcggaagcaggtgagcactttttggtctatatcagtctctttctttccatcaagcagttattttcctcaaagttgtgcctaactcccacttgagcattttttttatccattctttttttttttactttgacatgaagtctcactctgttgcccaggctggagtgcagtggcgcgatctcagctcacttcaacctccgcctcccgggttcaagcgattctgctgcctcagcctcctgagtagctgggactacaggagcacaccaccacacccagctaatttttgtatttttagtagagacggggtttcaccatgttggccaagatggtctcgatctcttgaccttgtgatccacctgcctcagcctcccaaaatgctggtattacaggcgtgagccactgtgcccggccccattctctttattttattttattattttattattattattattattattttttgagatggagtttcgctgttattgcccaggctggagtgcagtggcgcgatctcagctcaccgcaaactctgcctcccgggttgaagcgattctcctgcctcagcctcccaagtagctgggattacaggcgcgtgccagcacaccaagctaattttttgtatttttagtagagggggggtttcaccatgtaggtcaggatggtcttgatctcttgacctcgtaatttgcctgcctcggcctcccaaagtgctgggattacaggcgtgagccactgcgcccggcctcattctcttaatagactgggacaagttaaaactttatgacaatttcttgaaattgtcaagttcatccatgtccctaactctcctgtcttggtgtgtttgggctgctgtagcctgagtgccttgcaaaccatagaaactttttttttaaaattttattattatactttaagttttagggtacatgtgcacaacgtgcaggtttgttacatatgtatacatgtgccatgctggtgtgctgcacctattaactcgtcatttagcattaggtatatctcctaatgctatccctcccccctccccccaccccacaacagtccccggtgtgtgatgttccccttcctgtgtccatgtgttctcattgttcagttcccacctatgagtgagaacatgcggtgtttggttttttgtccttgcgatagtttgctgagaatgatggtttccagcttcatccatgtccctacgaaggacatgaactcatcatttttgatggctgcatagtattctgtggtgtatatgtgccacattttcttaatccagtctatcgttgttggacatttaggttggttccaagtctttgctattgtgaatagtgctgctataaacatacgtgtgcgtgtgtctttatagcagcatgatttataatcctttgggtatatacccagtaatgggatggctgggtcaaatggtatttctagttctagatccctgaggaatcgccacactgacttccacaataaaccatagaaacttattgtcctacagttctcaaggctggaagtcccaagaccagggggtcagtgtggtcagattctggtgtagtctgtcttctaggttgtggatggccactttctcctgtgtcctcacatggtggaacctggatggggtctcttttataagggtactaattccattcattgtgctccaccctcgtgacctaatcatcccgcaaagcctccgcctcccaacagaatcactggggatgttagaatttcaacataggaactttggagggatacaaacattcagtttattgcgccccctctagatgcaaaaggattgggtttagatgaggagaccccaggggagagggtgcccatctgagagtgtatttctagaacttcttatgaacttgagcacctccatgatctgtttacatctccctgggacctgagtaaattagagacaagatgtagggcagggggggttctgagatttagcttggagactgtgaggtggtgatggatggcaacccttggttttgaccatccatgctaggtggatatctgctgtatcattaacaacatgacaaactttccaggactttctatatctcagacttctgccaatatttgagatgactgggtcaaaatgatgctgattttttgaacagggagagcaataggtattctctgaaggttggctggatgtgagcctagtggcttcaatgatggtggagtaggatgaagagagaccctcaaggttgaacaaagatgggagggctcacatccattactggttatatttgatcttttgtctcctccagtgcaatgatctttttcatcttcttaattcttaatttagctaggcaatgtttaattattagtttaattcttaatcaaactaggaaaggaagaaaacaccccatttctttgtgcttttttgcctcattgtggtggtttaggtcatgatgaggtctagttgggcaggtcatgatgaagtctagttgtattaggttctgatgatgtctggttgagttagatcatgctgaggtacagtttggtttggtcatgatgaagtctagttgtattagatcatgataacgtctcctttggttatgtcatgatgaagtagttgagtagaatgtaatgaagtcttgttcgattagatcatgatgactggttgagttaggtcattatgaggtatggtttgattaggtcttaatgaagtctagttcagtaacagcatgatgagatctagttggattagacttgatgatgtgtgacttatttaggtgatgatgaaatcttgttgggctaggtcactttgagatctaattgggtaggtcatgatgaggtcttgttgagttaggtcctgatgaaatgtagttgagttaggtcacattgaggtctagttgggtaggccatgatgaggtctatttgtattaagtcatgatgaggtttggttgtattagatcatggtaaggtacagtttggttaggtcatgatgaagtctagttgtattagttcatcataatgtttagtttggctatgtcatgatgaggtagttgagtagaatgtgatgaaatcttgttggattagattaggatgactggttgagttagatcattatgaggtgtgatttaattaggtcttaatgaagtctacttcagtaatagcatgatgagatctagctggatcagatcatggtgatgtgtggtttggctaggtcatgatgaagtctagttgggttaagactcaatgagttctagttgggtcaggtcacattgacgtctagttgggtaggtcatgatgacgtctaattgggttagatcatgaggagatctagttaggaaggtcatgatgaggcctagtggatagatcatgatgaggtctagttgggttaggtcatgataaggtctagttggattaggtcatgataaggtccagctgggttatgtcatcatgaggtagttgaatagaacacaataaagtcctcttggattagatcatgatgacaggttgagttagatcatgatgatgtgtggtttggttaggtcacagtgaggtctagttgactgaggactttgtaggcacaaagcaatgaagacatgtgagcaagcttcttgttcatgtgcatgggaatctcaagtgttaccacttcatttagatgatgtttactgagcatcaggagcagtatatgtcagcaccaatgtgccttttttcttgagataaacagaaagtaaacaccacatctgcaccccacctgtgtctcctatcccacagagctcctgatgtcagtgtttaattttcactgtgagttacagttttgacccttcaggtcaatccaatcaattatgcagtcttatttcccctgtgtgactttgaggataattggatatattctgagagaggcattttttcattttgtatggcagtttgattcaaagtcaattaatgaaaaaatatcattgaacacaatgaattttatattaaatacaaaataagagatgggaaatttaacttcaaaattttaattaaaaatttattaatatttaaagaataatcaattacttgtaaaataattcagattataacctgggtccaactgaagcacattaatattactagacacatatatcagttgttcaaattcccatctgtccacaagatcttagttctcattgtttcaaaatattattttggtgggggatcattttttttcataatgctcaatggactgtcatctaagatgaaagtggggtgggtaaactttttctgtaaagagacagataataaatgtgttcatatgtttctctcataactatgagctctgccctagtagtgagtaaccacccataggtaatacttaaaacaacaggaaagtctatgttgctgtaaaactttttgtacaatatccagctgcaggccaggtttagccgcagattggtgactctggtttgggctcaaaatctttttatttagtaagaggaaattatactgcttttttccaatataagaaatctcttgtacagtcctcaggaagggtagataatgatgaggtctagttgggttataatgaagtttagttgggttatgatgaagtctacttgggttggtcatgatgagatctagttgtattagatcctgatgagatccagttgggtaaggttctgatgaggtctagttgattggtcatgatgagacttagttaggctataatgaggactagttgtgttggtcaggatgagatcaagttgtattaggtcatgacgagatctagttgggtcaggttgtgatgagatctggttggttggtcatgacgagatctagttaggttatgaggaggtccggttgggttggtcatgaggagaactaattgtattaggtcttgatgagatctagttgggttaggttatgatgaggtctagttgggttggtcatgatgagaactagttgtattaggtcatgatgagatctagttaggttctgatgaggtctagttagattggtcatgaggagatctagttgtattaggttatgatgtgatctaattgggtgaagttattatgaggtctagttgggttggtcatgatgagatctggttgggttaggttatgatgcgatctagttggttggtcatgatgagatctaattaggttatgatgaggtctatttgggttggttgtgatgagatctagtcatattcagtcatgatgaggtctagttgggttagattatgatgaggtttagttgggttaggtcatgatgaggtctagttgggttagggtatgaggagatttaattgagttaggttatgatgaggtctagttgggctggtctttatgagatctagttgtattaggtcatgatgagatctaattgaattatattacgatgatatctagttggttggtcatgatgagatctagttgtattaggtcatgatgtgatgtagttggggtaagttatgatgaggtctcattgagtttgtcatgatgagagctagttgtactagatcatgatgagttatagttgggttaggttatgatgagatctagttggttggtcatgttgagatccagttaggttatgatgaggtccagatgcggtggtcataatgaaatctagttgtattaggtcatgatgagatctagttgtggtaggatatgatgaggtctagtgcattggtcatgatgagatctagttgtattaggttatgatgagatctagttggattaggtcatgatgagatctagttgtggtaggatatgatgaggtctagtgcattggtcatgatgagatctagttgtattaggttatgatgagatctagttggattaagttataatgggatctgtttggttggtcacgatgtgatctagttaggtcgtgatgagttctagttgggtaggtcgtgatgagatctagttgtctcatgtcatgatgaggtctagttgggttaggttatgatgaagtccagtttggttaggtcatgatgaggtctagtgggattggtcattatgagaattagttgtattaggtcataatgaaatctagttggcctaggctatgatgagctctggtaggttgttcatgatgagatctacttgtattgggtcatgatgagacccaggtgtgttaggttatgataagatctagttcgttgtcataatgagatgtaatttgtttatgatgcagtctagttgtgttgctcatgatgggatctagttgtattaggtcatgatgagacctagttgggttaggttatgatgaggtctagttggtttggttatgatgaaatcttgttggattatgtcatgaggagatctagttggatggtcatgatgagatataattaggtcatgataaggtctagttgggttggtcttgatgagatatagttgtattaggtcgtgatgaggtctagtttggttaggttatgatgaagtctagtttggttaggtcatgatgagttctagttgggttagggtatgaggagatttacttggataaggttgtgatgaggtctatttgggttggtcatgatgagattttgttaggtcatgatgaggactagttttgttggccttgatgagatgtagttgtattaggtcataatgaagtcttgttgagttaggttatgatgtagttaagttgggttaagttatgatgaggtatagttgggttggtcatgatgagagttagttaggtcacgatgaggtagttgggttggtcatgatgaaatctagtcatagtcagtcatgattagttcttgttgggcttgtttataatgagatttagctgtgtcaggtcatgatgaggtctagttgagttggtcatgatgtgatctagttgtattaggtcatgatgaggtctagtttggttaggttatgaggtctagtgtcgttggttgtgatgagattcagttaagttatgatgaggtgtatttgggttggtcataaagatacctgtttgtattaggtcatgttgaggtttatttgggctaggttataatgagatttagttgggttaggtcatgatgaggtctagttgggttagggtataatcagatctatttgggttaagttatgatgaggtgtattttggttagtcctaatgagatttagttgggttagagtatgatgaggtgtagttgcgttggtcatcataaaatctagttttgtaggtcacaggaagtctagttggttaggttatctaaattgcaactgtcttttaaaaatgacttgtgccacatatactttgtattgtccatgaatagtacatgtgaaacgtgtaaaatatttaaacttgtatttaattatctatttacttattttaatagacaaaaacaagttacatatttttatggtgtacaaaatgtggttttgatatatgtttccatctggaatggccaattcaagctaattcacatatccattaccttacatgtttctttttgtgtgtgtttttggaaacacttaaaatctactctctttgcaattttcaaatattaattatagtcactgtgactaattatagtcaggttcaagattatagtcactaatttagtcaccttaagtacaatagatctcttgaacttataccttctgtcaaactgacatttggtgtcatttgaacaaaatctcagcaacccacccccctagcacctggtaatcaccataattctttttcttttctttctttcttttttttgagatggagtctcactctgtcaccaggctggagtgcagtggcgcaatctcggctcactgcaacctccacctcctgggttcaagcgattctcctgcctcagcctcctgagtagctgggactacaggtgcatgccaccgtacccggctaatttttgtatttttagtagagacaggcttttgccaggttggccaggatggtctcgatctcttgaccttgtgatccacctgccttggcctcccaaagtgctgggattacaggcatgagataccacgcctggccaataatcatcataatactttttcttgtgagttcaacttctggagactctacatatgggtgagatcatgtgggatttggttttatgtggcttattttacttaacatgatgtactcctggttgatccatgttgtatcacaggatagggtcctctggttttcaaagactgaatggtattccatggtgtagctatcccacattttatttatctacccatccttagatggacacttaggttggtttcatatcttggctcttgtgaatcatgctgcaacgaacatgggggtgtagatatctctataaggggctgatttcatttcctttggatctatacagaggagtgagattgctagatcctatggtaggcataatgatcattttttgaggaactcttaaaaaaaaaaaggccacccctttagacacaccttaaaatccaacctttctggtcaaagacatttgaaaaaaatgacgacaacatcaaactatagtctcctgtccaagcacgttcacttcctaagatgtgaaaaaaaccaggccgggtgcagtggctcatgtctgtcatcccagcactttgggaggcaaaggcaaacgggtcacccgaggtcaggcgttcaagaccagcctggccaacatagtgaaaccccatctccactgttttccataatggctataccaatttccattgcacatataacatgtaacgccctcccctgcccccccaaatacaaaggatgaagcagaaggcagatgcactgtgtttgggacgtgtgcggtgtttctgcatatgcagtacttgctcagcaaatgtaggaaccactccagcaaatgcatatgaggccaaatgtcccacgtccagttccttaaagcagctccctccaggtctgaggagacaattgctgaaggtgacattggccaaagaagataccgcacgtgccacctcaccttctccattcctccagtgtggtgcttctgtcctatgccagcgttgacggtgccaccatggaaaatggcctgcccatgaaggtggtcttcccaaataatcacttcacctggctttttttgatgctcccagctttttctggtcacttttgtctttcttgagaaggtggaggctcccatcttacttcgtcccagcttccggcatgtttccctttgtttttttttgttttgttttgttttgttttctttttgagatggagtctcgctgtgttgcccaggctggagtgcagtggcgcaatctcatctcactgcaacctctgcctactgggttcaagcaattcttctgccttagcctccagagtagctgggattacaggtgcctgctaccatgtctggctaacttttttttttttttttttttttgggacagagttgggctctgtcgcccaggctggagtgcagtggtgtgatctcagttcatggcaacctctgcttcccgggtcctggttcaagcaattctcctgcctccgcttccctagtagctgggattacaggcacacatcaccatgcccatctaatttttgtgtttttagtagagatggggtttcctcatgttggccaggctggtcttgaactcctgacctcgtgatccgcttgcctcggcttcccaaatcccaaagggctgagattacaggcatgagccaccgcacccggccgcaccctttgatcttgagatggctgatacggcagagcagcccagcagtggatgagtgcttacatttaaaaagttcatgggatttcataaataagctcatgaatgtacaagtccccagtgtaaaggttaccttgactttgaatttttttatcctttctttttttgttttgtgtttgatgcataggacatttatagatggaatatacctttcaggctatttcttcctctccctcccgtcgaaacccacctccctgaaatgcctgctgcctcctcagtgccaaaggactgtcaaagcaaaaatgtaataatggtatcatgttctgtttctttaaggaagtcaaaggtgcaaattacctttgcagcttcagtcttctgatgtctgcaactttgaattccttcaaggaagtgacaatttagatattccatttactctgccccaaaggatggactttgcactatttatcttagccgtctcccactggagccaaaaacatttccaacttcataagtttcactgcttctcctcttttatatattttttcactctttgctgaaaacattttcattgttttttgaaaagtgcattctaatagttaatttgggagcccatggccttaacacagaagaaagaataccgaatacaatgataggatatcaaacagcatggtctcttccttgtgttagagtgtgtaaattcaatacgccgtgttgactcagtattcaggaatgccaaagagagggattatttggtaatgtattttcatggagacccggggacggtgctgtactacagaacacctcactggcccgggctgggtgcaggtaggatggagatagaccggccccacccccttggtaactgctccttgcagatcagctgtttgaagctctccgggcacccaagacgttcttgttcaagcctgtgcgcttcccctgctagttctcatctcccttctctcaacactttttccgtgaccctccctgaaagggagttttgggcttggctcaccctggaaagcagctaatcccacatgttgccaacaggttaatgaaggatgaggctgaaggaggaaaaatttgccaaactcctttcccctaaagagccgccccttcagaaacaccttaaaatccaacctcccgggtcaaagacatttgaaaaaatgacgaagacaacatcaaactatagtctcctgttcaacgcatgttcacttcctaagacattaaagaaaccaggccgggtgtggtggctcatacctgtcatcccagcactgtggaggccgaggcgggaggatcacctgagatcaggagttcaagaccagccttgccaacatggtgaaaccccctctctactaaagatacgaaaaaattagctgggcatagtggcagtcacctctaatcccagctactcaggaggctgaggcagcagaatcacttgaatcagagaggtggaggttgcagtgagctgagatcgcaccactgcactccagcctgggcaacagagcaagattctgtctcaaaaaaaaaacaaaacaaaaaaacaaaacaaaaaaacccaattaacattctttcaccccggatttcctagtctttattttagctataacaagcaaaacacctctttccatccttctaaaggcgtgttcctgaaacctcacttggagagttttacggaagtgcagtgagaggagtaagaaatcctgagcacacagccaactaacgcaggaacagaaaaccaaagaccccatgttctccttcataagtgggagttgaacaatgagaacgcatggacacagggaggggaacatcccacaccagggcctgtcgaggggttgagggggcagggcagggagagcattaggagaaatacctaatgtagatgatgggttgatgggtgcagcaaactgccatggcacgtgtatacctatgtaaccaacctgcacattccgcacatgtgccccagaacttaaagtagaattaaaaaaaagaaacagaaagaaatcctgagcacgtagtaggaaccacggtctgtgatcacgtgcatcgtgcagtctgtgtgtgcacactgggatgtttccagcataaaagctccttcgaaaattcgtttccatcctgacattttaatgcacattttttatgcttatgctattctcagctctcacgtgcaaattacaccagcaggtgccccgggtccctgtcactattgaaaagtagaatgtcaaatgcatttgtactttttgccaatgcaggctaaagaaaatgactcttaaatggatagctttagtctgccaaaatggctgtcaagttagacgctaggataaagggaaagtccatcaaaggcacatttcagatttgtgttatacttctcttaaaacctctttttttttttgcagttaatagtttctggataatcctacaagtcaccgtatcttttttttctttttccttttagctggaaataatgacagcaaagccaaacaagttgtaagcaaaataaaagaagaaaccttgaacgacaaaggtaccgagagatactccaatggcttttttttgtttttttttttccttgggacaggtcgtttgcgtggttcatggctgagcttcagtcacgtgccaggtggcatttgggagagatggctctgatttttgcactcttcttttggggatttctggccccatcctagagcaggagatggtcaaggcaaggcgaagatagcatcactcagctctgacatctgctaggaaaggcatgcagatgtgctggtagcttgcactcttactcaaatgtgtgttccccagggaacaggagccattgtcctttcctgttgacctccagggcacatgccaggaggtgcctctgctggttgggagttcttgacttaagataaatcaggccgggcgcagtggctcgcgcctgtaatcccagcactttgggaggctgaggcgggtggatcacgaggtcaggagttggagaccagcctggccaacatggtgaaacccaatctctactaaaaatacaaaaattagccaggcatggtggcatgtgcctgtaatcccaatgacccaggaggctgaggcaggagaatcgcttgaatctgggactgcctgggagagagagcaagactccgtctcaaaaaaaaaaaagaaagaaagaaaaaaagataaatcaaacaggaatatgcttgcccttaagattttcgaccaggtgctagaccaaattctggtgtgctctttctgtctgttcacactaaggaaggtgtgcacacaactttctaatatccatctagattctcaatgctctgtccttttatttatttattattttatttttcatttgtatacaggtagggagtgcaagtacagttttgttaacatggatgaatggcgtagtggtgaggtctgggcttttagtatagctaacacctgaatcacgtacattgtacccgagaggtaatttctcatcccttgctcctcttccacctcccacccttctgagtctccagtctctgttattccactctttccatgtggacacattatttagctcctgcttataagtaagaatgtaggaggtcggtcagggtggtaggaaaaattgtagaagatgcaaaccttcttgggaggccagaaggttttgcaaatgctcccgaataagatttggctgaaggcagccagattctcttatccagtgcctgaaagcttaggttagataacgaggggatgtaaagaaactgatctagataagttagtttgcttaggcctcagaacctggcctttaatcatccacgcacagaactactctctccctctctccgggttgcgggggacgaccatatgaattgcccacgaatgtgttgactcaaggcctttgtcattaaatgtatactaaataaaggcccacagcagcagcttgtcaaagccgtggctgctgactctttaaaacaccctcctcagtgtctgtgagtggccccatcccctagcccacgctttcactggaaatctgtgtctgagtgcatttgttcatccgtcgctcagccaaagtctgcgagtcggacccagcaaattggactcgacctaagaagaatggtatttgactttcggtttctgagttatgtcccttagggtaatggcctccagttccatctgtgttgctgcaggagataggatttcctcctttttcatggctgcatagtattccatcaggtatagatatatattttctttatgctttcgtgtgttgttggacacctaggttgtttccatatcttggctcctgtgaatagtgctgcaatgcacataggaatgcaggcatctctttgatacactgatttcatttgctttgagtctgtgcctagcagtggaattgctgaattatgtggtgcttttatttttaatgatttgaggaacttctgtactgtttttcatagtgactgtactaattgacattcccaccagtggtgtacaagggcccccttttctctacaccctccccaacacttgtaattaactgtagaaatcatcattctggccagcgtggtggctggcacctgtaatcccagcactttgggaggccgaggcgggtggatcacctgaggtcaggagttcgagaccagcctggctaacatggtgaaacctcgagtctactaaaaatacaaaaattagccgagcgtggtggcaggggcctgtaaccccagctactcaggaggctgaggcaggagaattgcttgaacctgggagttggaggttgcagtgagctgagatcacacctttgcactccagcctgggtgacagagcaagactctgtctcaaagaaaaaaaaaaacaaaaaacaaaaaaacacaaacaaaaacacccttctgacaatatccattttagctggtgtgagatagtagctcatggtggttttcatttgcatttccctgatgattagtgatgttgagtaccttttctttgtttatttttttgtttctttttgagacggagtctcactctgtcacctaggctggaatgcagtggtgcgatctcggctcactgcaacctccggctcccaggttcaagcgattcttctgcctcagcctcctgagtagctgagattacaggcattggcgaccatgcccagctaatttttgtatttttaatagagacggggtttcgccatgttggccaggctggtctcgaactcctgacctcgtgatccgttcgcctcagcctcccaaagtgttgggattacaggcgtgagccactgcacccggccgactaccttttcctataagcaccttttcatatacctgttggccatccaaatgctaagtgcttttctcggccatgtttatgtgtggtaccttattttttttttttttttaaatgcacatcccttccttggctgtttgaatttgagatggtgttttgagaattcccccaagtgggggatgggtgtattttgattctttatttgtttgtttgttttttgatacagggtctcactctgttgcccaggctggagtacagtggtgttatctcggctcactgcaacctccgcctcccaggcccaagtgtttctcctgcctcagcctccccagtagctgggaatacaggtgtgcagcaccacacccagctactctttgtagagttggggttttgccttgttgcccaggttcatcttgaactactgggttcaagcggtccattcacctcggcctcccaaagtgctgggattataggtgtgagccactgtgcctggcctattttgatgatgatgacgattattattaatattttgagacagagtctcactctatcacccaggctggagtgcagcaatgtgatctcggctcactgcaacctctgtggcccgggttcaagcgattctcctgcctcagcctcccgagtagctgggattacaggcgcccacccaccaagcccggctaatttttgtatttttagtagagacggggtttcaccatcttggccaggctggtcttgaactcctgacctcatgatccacccgcctcagcctcccaaagtgctgagatgaccggtgtgagccaccgcgcccggccttgattctttttaaagccatgagagtgaaatgaacgctacacagagctgagcctggtcactgcctatgcccctatctcctcctttctaccctaagctgctgtgaaacaccttgttattacctctgccaagggctggggtatgttgaaatttcatagccggcattgcaggatccctgtgattttcaggaacacactcccacaggggctcccgctcagccagagccaagcccagtgtacaatgtcacagagtggcagcagcctggccagatcttttctcctcattaggatctgccttggggcaaaaggattggtttctgtgtagagggataattaaggaattagagacaccgaggggttgaggaggaattatttaattatttatttgtaccgaccccgtcggattaacatttaaaggaccgagttttgaacaaagagtttggttattttttaagtattttctggggcggggggagctctgtgtagggggaagtatatcatagaagtgagaaacaaagacagttgtttaattgacacatgcattatattattttttattttttaaggaataatatgttttatgatttgagattatttgcctagtgactttgtagctgtatagctagagaagcagagtttttataatgcttgggaaaggaagagacaaggcttattagccgcagaaaaacaggcagttaatttttaatggacttcaactctttctcttcctcagggagaactgggttttcttacatacaactgagtttttgcttatacatttttaaattttttaaaattcctgtttcatctgtgacagggggtcctattccctgccaccttggcccttcctcatttgcagcaggttttcaaaggagtggcattttctaacacaatgaatccaaaagtgccttctccgggcctgtcacatcagcatttccggggagtaaacaagaaatgcaggtgcccagggcccatctgtgaatcggggcctctgggggtgggggcggggccctggaatctgcattcttatgaggccgttaaatgatccccacgcaccttcaaatggtacacttgctgctgtcctgaaggcattcaaccatcaatctggagcccaaagagaagtttctggaaactgacaagtgaggcattcttttctcatgactttttgcttttaatctgaacggcttaaaaactatatatagttccccaaaattcacatatgtgatccacctaaccaaaatgacagccaagaaacaatgatttataatcaccaacttaattttattagattctgaaaatgtttcagatttagacaacatgaattttgaccaataattttttttttttttttttgagacagagtttcactcttgttgcccacgttagaatgcagtggtgtgatctcggctcactgcaacctccgcctcccgggttcaagcgattctcctgcctcagcctcccgagtaactgggatcacagacacccaccaccaggcccggctaattttttgtatttttagtagagatggggtttcaccgtgttagccaggcttgtctcaaactcttgacctcagatatccacccacctcagcctcccaaattgctgggattacaggcgtgagccactgcatctgaccacaataacaaatcattgctgttttcttggaaaagtttgtgtaggatattcgatcatcagtttttaaagtgcagtgttttgtggacaagtagcatgacgaatacatgatttgtccccaccattaaaaaatgttagtttacttgtggcatataaataccgatggcctttaagccaatcttacagaaaagaagaaaagaatcgtttgcactttctgtggctgtttaaaagctttaccatcttgtaagagggtgggaagatggggtgtgccgtggagatggttaatgggcacaaaaatatactttagatagaatgagtaaggtctcgtatttgatagcacaaaagggtgactacagtcaacaatccttcatggtccatttaaaaataactaaaagttgctggacatggtggctcacccctgaatcccagcactttggaaagccgaggcaggtggatgacttgaggtcaggagttcgagaccagcctggccaacatggtgaaaccccgtctctactaaaaacacaaaaattagccgggcgtggtggtgcacacctgtagtcccagctacttgggaggctgaagcaggagaattgcttgaatctgggaggcggaggttgctgtgagctgagattgtgccaccgcactccaacctggactacagagactccatctcaaaaaaaaaaaaaaaaaaaaagaaaccaattaaaggtgtaattggaatgttagtgacacaaacaagtgatgaatgctcgaggggatggataccctatttgccctgatgtgagtattacacattgcatgcctgtatcaaaatacctcattatcccataaatatatacacctactatgtgtgcatgcaatttttttttttaaaagaaaaaagtttaaaatctgaacaggtttggacattcatcagtggtggccctggtatgtccactgctgggggactctccagtccttgatagatgatgctgaggcccagctgggtggggacatttcggctgtggccattgagcctttacctcgactgagtctgcctccaggctcaggagcccccagatccgtggtccagccacacggcagggtctgccctctgcctgtgagtggtatctgctgcccacaacatcttatggacgaccacagctcctacaggcatcccttccctcctcagctgagacctgggcacacctccaccaaacccgtacgaaccttgctctaaattgtgcttctctctggactggcctgcacctgctggaactctgattcttgtccccacaacctccagttgcccagcgagggacagagggagctgaatgtgctgtttcgttcttgctctgctgggatcccggcatcgggtaaccccggttcagccatgtggatttatttttaagcaagtcggctcacgtcctgactccaggagcacagattgctgtggagtgtcagtcacacaattatttcaacatgctgggcgcctgtctagcctgctttcccctcctgcctttcctgctctcaattctctctccttagttcttgggttaatactctggcctgcgtactttgttgtactttctgtctttgaagtcgtgctcctctgagatcccacgctgggcagggcatgggaagctacgtgcccacagaaggacggctaattgagctctcggaattataaatgcgcgattgttttcaggaatctgggcgagatggctcatttcccaagctagggattttccagggaagcgttttcactccttatcatcacttagccattgtgcccacacctttgtggctcctgggtaattatgtgctgatgaaagctgtcttacttagaacaaatagtctcattcacttaccgaaactcctccaaatataaataaatcaaaccccagcggctccatgaaagcaaacacagaaaggcatagccgtgttcaaatgaactcagatggggagagataaccagttaaacactcttaaaagcactgaaggcaggcccattctcttttgcagctcgtacatgccatggtggaacccctgtaatcctaaatcctaagagagatcagactagacacgtgctgtgtatcctctttggaaggtgcacggtgtcctcattttctataatgattgtgtaactttaatcacaaacagcatcttctgattcatttagcttcctggctaggcacgatggctcacgcctgtcatcccagctctttgggaggcctaggcgggcagatagcttgaggtcaggagtttgaaaccagcctggccaacacggtgaaaccccatctctactaaaaatataaatgttagtcaggtatggtggcgggtgcctgtaattccagctactcaggaggctgaggcaggagaatggcttggacccgggaggcggaggtttgcggtgagccgagatcatgccactgcactccggcctgggcgacagagaaaaacttcatctaaaaaaaaaaaaaaaaaaaagcttcccaaatattattcttccagtagcttgtgccgtcttcatcagaagagggactagctgtttggttcatgtgcttccacccagttattagaccaagtttgttttcaataaaagaaatcactggtcaatgccttctgtaattgatgggtgtcaagaaggtaaattttgcacgccgccttgggaggcacttctactttgaaaatagatctttgtgaaccatcattttggcctatccaatgacctataaaatacttgaatttatcatgaaaacagaatactgtgaaatcaggatgaaggttgataacaggtcatcaacgtaattgagtagattgaaaatacaagagtcagtgaagtgtaggatgaatgcttgttgtcagtaagagagctctttgtgacccgttccacgtgcaagagatgagggttgttgttttgggaatactcaccctcctcatcgcctgtccctgctaaaatcagagctttgtgagggcagagatggattctgtgcacaggtatcttctgagtctctgattcagtgcctgaaacacagtggctcccgagacaatctacctcagtgcctgttttacaggctcacctgtgacacatgactgggacatatgttattcatgatgacatgcaagagtctctgtgtaggtgtctactggtcttcatcatcaaacagagcgagaactccaagtcaggaggcagacatatcttggggcaagaagacacctagaatttttcttcaacctgtagactttcggattgggtagaaggattgttaaggaggttgcgaaacttggaaaaaggatgatgtgagtgttgatggcatggaattctccccacacccctgggtatccatttttaatgtacagaattcttgtgacatgattttagggcatagaatccttgagagatcatgtctgtgctgaagttggaatcacagcactttatgtgaatgtgttcgccaacgattaattatgtttattcccgagaagttttaaccagattgtggatgtgtattctggttcagcatatattcacaattacctttgttttttgttttgttgttttggagacaaggtcttgctctgtcacccaggttggagtgcagtggtgtgatcatagctcactgcagcctcaaactcctcagtaggaaacttcctaccccagcctcccgagtagctgggactagtagcatgcaccactacacatggctaattttgttttttaaattttttctagagacggggtctcattatgtcgcccaggctggtctcaaactcctggcctcaggcgatcctcccaccttccaaagtgctgggattacaggtgtaagacaccaagctcagcccctgtgtttttttgtttttttttttttttttgctttttgtttgtttgttttgagacggagtcttgctctgttgcccaggctggagtgcagtggtgcgatcttggctcactgcaacctctgactccctggttcaagccattctcctgcctcagcctcccaagatgctgggattacaggcgtgcaccatcacacccagctaattttttgtatttttagtagagacagggattcaccgtgttagccaggatggtcttgatctcctgactttgtgatctgcctgccttggcctcccgaagtgctgggattacaggcgtgagctatcacgcctggcctgtgttttttttttttttaaacataaaatggcccttattgactgttttccttttcatagtgagtccttttgtttctttcatgttttcgagaagtgtcccgagtcaggctgtagacaggcatatgcgtagataaacagatagactcatgcgttcctgttggtaatttttccttgaggtcaccgtatgtgttctcatgcgtgggcatagatgtcccacactctctgaaagtttaattggtcctcgcaggtctcattgtgttccttctcttcagggctcttcatatctcagggtggtaataaccttccaaatctctatggccgaggcgggcagatcacgagatcaggagatcgagaccatcctggctaacacagtgaaaccccgtctctactaaaagtacaaaaaaaattagctgggcttggtggcgggtgcctgtagtcccagctactcgggaggctgaggtgggagaatggcgtgaacccgggagggggagcttgcagtgagccgagatcgcgccactgcactccagcctgggcgacagagcgagacaccgtctccaaataaataaacaaataaatagaaatacaaaaattagccaggcatggtggcgcatgcctgtaatcccagctactcaggaggctgatgcaggagaattgcttgaacctgggaggcggagttttcagtgagccgagatcgcaccactgcacttcagcctaggtgacacagcgagagtccatctcaaaaaaaaaaaaaaaaaggaatatgcatttaacgtttctttgcgtcttttcgtggctcgatagagcccagtatatattttcactaaagagcaaaagcgcctttccatgggcctttaaatacttaagaataagcacatccacacatgggcctcccagatagtcggtgcgtttccagaaatgacggtgtgttgtggttcacagcctctttgggttttggtctccaactcccagcctcaggcgatcctcctacctgagcctcccaaagtgctgggatgacaggcacagtgagccaccatacccagctattttttgaaaactcatagtctcatatttccctaatatttagggttagggctagagttaggtagaggttagaggtgctctgacgagtgtttcccaagtcttggagcccacctctggccaaatcaccgcctgcagttggaagcaaggctgtttctgagatgagtcatactgacatattttgctattgaatgcacggttgccctgatccattcagagatacttctgcagcaccatgagctccttaatccctgcccctgttcacctacaagggtctgcaagcgagcccccttccgcaactcatctctttgtgtaatccttctccagaccctgaatatatcagcctgttggcatatgtatctatgtgtgtgagatcagcctgttggcatatgtatctatgtgtgtgagatcagcctgttggcatatgtatctatgtgtgtgtgtgtgtgtgtgtgtgcgcgctctgaggatattggcactttttaatcttcttccattagacgacaaggctgagggcttccacttgccgccgacttgccggcacacctggggcatgtttaataagtaattgtgtatggtctgctttgcaaatgcgctacttcacatttttccatcccgcccgtaacgaggactggggttgttttacaagttaattacccaaaagattatcgagtgggtttagaggcacaaattctacgcgctatttaacagataagaattaatgagtgttgttaaaatgggaaaaaaaaaatgtctctgtcagtggagggagttatctctaccctgcctggctgtgttactgttgtttttttttttgtctgtgaatgagaaccgaggtagagaaacaaggcgagtgttctcattgctcttctcccaccagagcacaggcggcacgtgtgaaaataactattcacagtttctttcccaccgtgtctcaagaggggtgaatgccagggtcgggcccggtggctcacgcttggaattccagcactttgggaggctgaggcaagaagattgcttgaggccaggagttcgacagcagtcagggtggcgtagagagactccgtctctacaaaatattaacaaatcagtctggcttggtggggtgcactgtggtcccagctactcgggaggcagaggcaggaggatcgcttgagcccaggacttcaagaccagcctgggcaacatggcaagaccttgtctctacaactaaataaaaaaattagtcaggcgtggtgtgcgtgcctggagtctcagctactcaggaggctgaggcaggaggatcgtttgagcctggaggtcaaggctgtggtgagccatgatcgcgaccctgtactttagcttgggcgacagagcaagacccttttctctaaataaaaatggaataatagtaaaaagaagctgaatttcagctgttttcagccattctctttattccttcaaatgcctctgtattctgcagtatcctttaaaatattaagagcaattttagctaatcaggaggctgagacaggagaatcgcttgaacccaggaggcggaggttgtggtgagccgagatcgtggtattgcgctccggcctgggcaacaagagtgaaactccatctcaaaaaaaaaaaaaaaagggagacacagataaggccatgtggagacagagactggagtgatgcggccatcaacttagggataccaggagctggaagaggcaggaaggatgccccctagagtcttcagaaagtatcagacacctttgggaggccaaggcgggtggattgcttgaggccaggagttcgagaccagcctggccaacatggtgaaacctcatctctactaaaaatacaaaaattagccaggcgtggtggcgggagcctgtcatcccagctcctcgggaggctgaggctggagaatggcttgaacccgggaggctgaggttgcagtgagctgagatattgccaatgcactccagcctgggagacagagcatgattctgtctcaaaaaaaaaaaaaaaaaaaagaaaaagaaagaaagcatcaaacacaattgcaaggggttgaatgctgatctccaaaagatatgtccatgtcctaatccccagaacctgtgaacaggaacttatttggaaatagggtctttgcagatgtaattagttaaggatctcaagatgagatcattctggattagggtgagtcttaaatccaatgatagctgtccttgtaggagacaggagaggagacacagacacagaggagaaggccttgtggagacagaggcagagactggagcgatgcggccacaaacccagggactcctggagcccccaggaactaggagaggcagggaggccccttcctgagagcccccggagggagcatggtcctgagacacctgatctcagacttttggtctccagagccagtagaggatgaattcctgttgaattaagttccccaggtgtggtcatttgtcacagcagcctcgggagacgagtagagacatagatcgggcaggaatagaatatctagttgcattgctgatagaggcatactacagctgtgtgacatggtgtgacatcagcacactgtgtcctgaccccaggtcatgggacaagaacttggggagacatagtcacccccctggctcatcagggaaatgcatggcttccggtaaggtgaccctgaacatgcgtgtgtcactctgaagtgttggcctcagactctgcctccaaattccaagtcccctgggggttccgctggaggtggacacgcccccatccatgccttccttgcagtcacgggaacatcccttactcagtcctctctggtcaccgatggggcatgacaggaggcgctacatgtttccaagcagccggggttccagatgcttggaaattctgcgtgcggcctctctatgggaaaaagggaggtctgccaggagtggaaccccagtgagaaagtaaactcaaaacagaaatgaaaggtttctagacacagtacaagccccctttgtggtgcgcgcagggacttacgtagctcggcccctccaccccctggctggccccagtggccgaggtgtgttgggtgctgatctgtgacaccctcctgcttcacacgggcagggaggggttctggagagagtgcaggtgggctggagagctgagctccctgcagcaggtgagtgtgagtcctgaacagactcgttccaaggaaacaggtgcaggaaagaacacaggtcttggaggaatcagggttgagccagccctgtgacctcgggctgtccttggccccagtgatggcttatctttacctggaacttcaacctcttatcatcacctataacgctgaccactgatcctcacctgggactcgaacctctccccatcacctgtaactcggaccacttgtcctcacctaggactccaacctccctccatcacctgtaatgctgaccactcattgtcacctggaagtccaacctctcatcactacctggaactccaactccaactcttttttttttttttcatgagacggagtctcactgtgttgcccaggctggagtgcagtggcacaatctcggctcacggcaacttccgcctcccaggttcacgccattctcccgcctcagcctactgagtagctgggactacaggcacgtgccaccacgcccatctaatttatgtatttttagtagagatggggtttcaccatgttggccaggacggtctcgatctcttgaccttgtgatctgcccgcctcagcctcccaaagtgctgggattacaggcgtgagccactgtgcccggccccaactccaactcttatcctcatctgtagctctaacctgttatcctcacgtgtaaatgtgatgtcatcctcacctgtagctgtaatctcatcttcacctggcattctgacctcttaccctcacctgtagctctaaccggctatcctcaccgatagctctgacatcatatcacctgtagctgtaacctcgtcctcacctggaactctgacctggctgacgtgcttgcagcatgtgggtggggccgatttccctcctgccccagctccctgctgctgccaagtccaggtctctcctgtggggcaggtatacccctccctgggtctcagctgggcccactggccttcacagggagcctgctgtctgcactcccattcttgtcctgccctctcctccggcgccctgtctgctcagatgtcctcatggcctaggcacctgcagccgccaggacagtgagcccggacacaagcagccttccatccggttccccctgcatctgccaacccatcttgcccacagccaagcttctgtgaaaaatcatagcagtcatgaaactcatgagtgctcgggcaaatcagaaaaattgccagggatcctaccatggacacgcgtccctgaaccccgaatggtccctgtgtgttgtgtgtgcgcaggagacgggcaggtcactgtgtgtcgtgtgtgcaggagacagggaggtccctgggtgttgtgtgcccaggagatggggaggtccctgtgtgtcgtgtgtgcaggagacggggaggtccctgtgtgtcgtgtgtgcaggagacagggaggtccctgggtgttgtgtgcccaggagatggggaggtccctgtgtgtcgtgtgtgcaggagacggggaggtccctgtgtgtcgtgtgtgcgcaggagacagggaggtccctgtgtgtcgtgtgtgcggaggagacggggaggtccctgtgtgtcgtgtgtgcaggagacggggaggtccctgtgtgtcgtgtgtgcagaggagatggggaggtccctgggtgtcctgtgtgcgccggagacagggaggtccctgtgtgtcgtgtgtgcggaggagacggggaggtccctgtgtgtcatgtgtgtgcaggagatggggaggtccctgtgtgtcatgtgtgtgcacaggagatggggaggtccctgtgtgtcatgtgtgcgcaggagatggggaggtcgctgtgtcttgtgtgtgcacaggagatgggaggcgtcaacacacatttcatgctcacatttccattcactgtccacactgcacacttgtacatggtcaatgtctagacatttatagtttgtttatgtgttatattcatctactttatatatattcatattttaggttcatatatttattgtatacacatttatatatttgatctatattaatattttaggtttatatacttactatatatttattattataaagcatatacattaaattataatgtattattatatatgatgtattatgttcaatgtatatattaaatacataatgacataatatgaatttatattataatgtatatacatatgaattcacattcatatgtatgttacattttgtaatgtatatatattttgtaacatatatttgtaatataaaattatatacaagatatactttgatatattttatttatatatttatatataaaacataatataatatgcacaatacattttgtgtatatataaaatatatattacataaatatataatgataactataaattatatttgtgtcattataaataatttatattaaatatttatgctattctataaatagtatatatatttagtatatatttttatatcatactttataataaacacgaatttataatatataagtataaactatagttattggatgtttaattttatgtatatattattttatatatatcatactatgtaacacataatatataataaatataatatataataagcatatatcataatatataatataaataaacattgtaacatataatatataatacatatatatcagtatacaaaatataaaattaatatatacataaaattatatacctacttattttattttattttttaagagacgtgagtcttgctgtgttgcccgggctggctttgcctctggaactcaagcgatcctcccacctcagcctctcgaggagctgggactacaggcgtgcaccatcatttcctcctaaaattgtatgtgctgcatatataaaatgataaatgctttacatatactttatgaaattatatatgctttagataaaagcagaggtttcataaaactgaactgtaacatgcatggcatttaaatcccattgaagtgaagggctgggcttgagggtagcgtcaccctccctgaccgtcatacccatttccatttccccaggaaggaccaggatgctttgtttaagcagcacgtttgaattgctggcattgcctgtggcctccctgtggcgagggatggtgaacgacagcgttttccctcctccttcctcaccttgcaaacctcacttcgttggatgcataattgctgactcatccccatggatcgccttggactgtgtagcaatcactgctcttttcacagtccctcttgaatttctttcctttttttttcttttagtcggaatttcgctctgtcacccaggctggagtgcagtggtgcaatcttggcccactgcaaccttcacctcctggattcaagcaattctcctgcctcagtctccccagtagctgggattacaggtgtgtcccaccacacccagctaatttttgtatttttagtagagatgggaatttcaccatgttggtcaggctggtctcgaactcctgacctcaggtgatctgcccacctcggcctcccaaagtgctgggattacaggagtcctcttgaatttcacttaagatgggctgggtgcttcgtggcaggcttttcacatcagcctttgcatttctgggtgtgacccctgtgtctgctgccttctatattcctctcttacttggcaggattccacccctaggtgggtttattttttcccccagtcccctgcctgcctgagaattcctacctatggctcctcctgggaaagggctcttggctgcgtcttaaatcttgggttatgccttggtgcatactggtgttgcaccagtggtgcaacgttgccggcatcccttttgcctgagggcaggtcacttgtattctgtcttgaaggaacctgacttttaaggagggacgacctggagagtttctttattattgaacttcactgactccctgaggatagactgatcctgccaaattcttgggtccccaataaaacagcattccatgaaataaaaagtaagaacagatggcaccaggaattccactgctgggtatatacctcaaagaattggaaacagggtctccaacagatatttgcacaaaccacgtttgcagcagcagtattacttacaataacccgaaggtggagagaaactgtgtccttccagaagcaaatggataagcagaatgtggtatatccaaacggtggaatattacgcagccataaaaaaggaagggtattcagatgcatgctgcgatgtgggctaaccttgaggacattaatgctaagtgaaataatccaatcctaaaaggtggagagaaactgtgtccctccacaggcagatggataagcaaaatgtggtgtatccaaatgatggaatattacacagccataaaaaaggaaggatattcagatgcatgctgcaatgtgggctaaccttgaggacattaatgctaagtgaaataaaccaatccccaaaggacaaatactgtaggattccactcctatgaggtacacagagtacctttaaatttttagagacagaaagtagaatggggtagttataggggttgggcgaggaaaaggtggggacttaatgtttaatgggaacagagtttccatttggcaagatgaaaatattttggagatgcatggcagtgatggctacataacaatatgaatgtatttaataccactttactgtgtacgtaaaaatggttaaaatgctaaactttatgtgatgtgtatttttccacaattcaaaattataaaaaaaaaaaatgcagctgggcatggtgactcatgcccgtaatcccagcactttgggaggccgaggcgggtggatcacctgaggtcaggagtttgagacgagcctgaccaacatggagaaacctcctactaaaaatacaaaattagccgagtgtggtggtgggcgcctataatcccagctatttgggaggctgagcaggagaatcgcttgaatccgggaggcagaggttgtggtgagctgagatcgcgctattacactccaggatgggcaacaagagcaaagctccattaaaaaaaaaaaaaaaaaaggttaaaatgctaaactttatgttatgtgtatttttccacaattaaaaattattttaaaaatgaggccgggcacggtggttcatgcctgtaatcccagcaatttgggaggctgaggcgggtggatcacttgaggtcgggagttcgagaccaccgtggccgacatggcgaaaccccttctctactaaaaatacaaaaactagcctggcatggtggctcaagcctgtaatcccagctcctcgggaggctgaggcagcagaatcacttgatccccggaggcggaggtcgcagtgagccgagctcatgccactgcactccagcctgggtgacacggcaagaatccatctaaaacaataaaaaaaaaataaaataagtaattgcccttaaattggaaatgctcaacaacccacgtgattctgaatctgaaaaggccagatcagggagatacagagaagaataaataaaacacaaggcaagagaagatttatctctggagcatccttgtgcagctgttggtgagtgactcgtgtgtgtcaattgatcatacactcatgagtggataaaagtacccatgttttaggtcaagaaagactgtgacacacgtgtccagcacgccaagcacacagcccgtggggtgtcatccatgtgctgtgccctccctgtctccctctcccaagctcctgcatggaaacagaggtggacacgaaacctacctacccaccccctcccaggttaccgccatcactttcatcacaaaacagagtctggattcagggattcagcccagggcaggagctcaggtcatcttcctctttcagaagggagatttctgctgcctctggcccagcctttccctctctttccccccatgagctgccattggagcacccacctgggtgcaggtgagagagaggaggaaggagaccaggtgaccccttcctggctggttaccctatgtcccggtaacagacggttagagctgattctcatggcagaagcgtgactgccagagaccacctgcggcgcttctaatgctctggtccgtgtattcgtcttgtagcgttgccgagtgttacagagatccacagaccaggtggtttaaacaaaagatacttattctctcacagctgtagaggctacatgtctgaggtcaccgtgtcggtaggcttgctttctctctggcttgtagacgccgtcttctccctgtgtcctcacagagtccttcctctgtgtgtgtctgtgtcctcatctcttcttatgaaatgtcttagtctatttcaggctgctgtcacagaataccataggctggatgacttacaaacaagacatttattctcccacagtcctggaggctggatgtctgagatcagggtatgggcaaggctgattcctcctgaggtctctctcctggacttggagatgctgtcttctccctgtgtcctcacagagtccttcctctgtctgtgtctgtgtcctcatctcctcttcttatgagatatcttagtccatttcaggctgctatcacagaataccataggctgggtggcttagaaacaatagacattgattctcccacagtactggaggctggacatctgagatcagggtatgggcagggctggttcctcctgaggtctctctgctggacttggagtcaccgtcttctccctgtgtcctcacagggttgtccctctgtgtgtgtctgtgtcctcatctcctcttcttataaggagccagtcccattggatcagcctccccccaaccccctgaaacctcattttaccttaattgcctctttaaagaccccatatccaaatatgatcacattctgaagtcctaggggtgaggatctcaatgtatgaatttgagggggacaaaattcagcccatgacaaccagtgtttctttccaaggggctacctgaaaacgtttctgcaacccccagcaagctggcatcgtctcagcatcttgccatggggttccctccatgcctcccaatggctcctttgagtaagaccaaggacaaacccataccactcccttctcctgttttctctgccctcattgtcccctcaagccctgaggctgatcagtccccacaggaccacagctaccctgtagctatgagcagtggcttcctcaggagtgagccaggctcctgtaccccatgcctccctggcacagaacaagatttaggttctgggggtacctgagggaatcccgttttttttttttttttttttgcaggggagggtggaggctcagagtagggaatttttttttttttccgcctgctgtgaggaaattcacccctgttatctgatccatgcacactctggagctggctgaggtcctaactatttcctctgtaaacttctgcccttggaatgggttctgcgatgattaatacttagagtaaacttgattggattgaaggatgcaaagtattgatcctgggtgtgtctgtgagggtgttgccaaaggacattaacatttgagtccgtgggctgggaaaggcagacccacccttaatcatctgggtggccaccatgtcatcagcaggccagcgaggctagactataagcaggcagaaaaacatgaaaagactagactggtctagcctcccagcctgcatctttctctgtgctggatacttcctgccctggaaaactggactccaagttcttcagctttgggacttgggctggcttccttgcccctcagcctgcagacagtctattgtgggaccttgtgatcgtgtgagttaataccgaataaatgcccctttctatatatctatcctgttagttctgtccctctagagaaccctgaccaatacagggtccgttccttaccccctacatctataaccctgctgcctcagttgatagggaagcagaaagagccgcttttttaatgtttaattttattaagtttgcagtttcccagtgcccaaactcatgttgatttcaaaaactgtccttttaaagcatgtgggcagggtgacaattcatagcaggtgacaaaaatgttttataaataatatccatggaaatggaagctgtcactgtctgcagaatgcagccaaaatattcagaagatttgtatcactctaagttctcgtgctagtaagaaataaaaaagcaaatgatgactgggcctctaagaaataaagtaaaattaggaagcaggagtatgaaaataatgacattgtgcagaaataaatacaaaaggaaagtagcagagaagcaaaaaaaaaaaaaaacaaaaccatcaatagtagtttccttaagaaaaatgaaagaataatatcccaccatttattcatccttcattccacacacaaaagaagcaaggacagattagcatgaattggaacaagaaagaggaaataacatgtaataaaaatatgatttaaacttatgcaaaaaaagtaatttattcttaactcaactaacatatttgattacctcctcctgggcaaaggatgaaaggctgtcttattgcaaaaaattagaattttgctaaattcatgcaaatggaattacagatcacagataaaacaacatgctgaaatttcaaccgtcagaactttccaccaagtgttcctaatgaattcttgaatatctggttgggtgcagtggctcacgcctgtaatcccagcactttgggaggctgagttgggcgggtcacctgaggtccagagttcgagaccagcctggccaacatggtaaaaccctgtctctactaaaaatacaaaaattagctgggtgtggtggcacaggcctgtaatcccagctacttgggaggctgaggcaggagaattgcttgaacctgggaggtggaggttgtagtgagctgaaatcatgccactgcactctagcctggtgacagagcaagactccgtctctctgtctctctctttctttctctctctctctcacacacaaaataaataaataaataaataaataaataaataaataaataattgattatctatatactttttccaaaccatcaaggacaatctagatcaagaatctggaaactgttgaccctggaacatatctgacccttaacttgtttttctcattaaagttttcttgaaacacagccatatacattcatttacttattgcctgtgactgtttttgccttaggtacacaggtttgaagagttgcaacagagaccttatggcccacaaatcctaaggtgtgtagtatttggccatttatccaaaaatctactggctgtactcttcaaagtgaccagagccaccaacctgtgtctgagtaaaccgttttactcccaaatgaacacttttcaaagaagcatcatcggctggttctacttaccaacctaaataaagaaaatctagtttaatcttatccactgaatagacttccaggttaaaaaaaaaattactcctgacttagttgcaactcatccacctgtagaccaaaggatgcttctcattaggtaacagggaagcatttgggataattcaacatccattaattagtaaacctctgaaggaattaatctcataacagcagccggaatgcaggagatgctctacacccgaatcacaaattgaatggatggcaagtggattttccctcctaaggctgattgattggttctggctgccagcaccctgagataagaatgatcctgcagcaaggaatagtcatcaattagtgatgcctgctgtggctatggaatgagaattacggtctgtgtgctacattctttccattcttggtggttctctcataaaccacaataaagcatgcatcttttaaagcaaccatgaccatcactagccaccaccatagccctctggctgattcatggatgaatttccaaattcaaatgtgaatttccagtgtcacatttgtgttcctttccctaaatgatgatgatggtgatgatggtgatggtaatgatggtacttgttggatgtgtgtatgtatgtatacacacacacacatatatatacacatacacacacacacacacacacacacacatatatatttgagatggagtctcactctgtcgccaggctggagtgcagtggcacaatcttggctcactacaacctccgccttccaggctcaagcgattctcctgcctcagcctcccgagcagctgggactacaggtgcgcagcaaatgtatatatatatatttttttttctttttttttttaaatttatttattttttattattatactttaagttttagggtacatgtgcacattgtgcaggttagttacatacgtatacatgtgccatgccggtgtgctgcacccaccaactggtcatccagcattaggtatatctcccaatgccatcccccccctccccccaccccacaacagtccgcagagtgtgatgttccccttcctgtgtccacgtgatcccattgttcaattttaaatacaaccaaataagcttgcttcttgcctgtgtggaatttatagtccagctggagtgaggaattaaataatcatccacttatctgagtgagcaaaattatgataaacactcttaaaaagtgtcctttaacagctgtcttgaaagattcaattccatcctctcatgaggttccaccctctgggtttgctttctccaagacctaccctcctgtgtggcttctttcttgactgtttcttttatgctgcctttcctcagcgtttcctcgtagcatctcacactacacacctttccttaggtcttgcaaccacgtccgtgttctccaaaactctgctctgctagttctcaccaatatatttgtttccaaactcctgcctcctacacctccctgcttccacagcaagtgcaggaatgtatttgacattttccttctctctgtgtaagtcagtggactaccatcctctcagctgcctacagtcgatcctagagtgtctgagatgcttttctccaccttggcattcctctccctggtggcaactgagagctctgtagaccacctacatgcttatcaaaaacactccgtcattttcggtatcactccctacagcaggtcacacctatcccttacctgcttcataactctgcttcctggctagtctctcggcttccaggtttccctccctgaactgtctacactgcagtcagagagatcctgctgagtcacactgttgtcttaacctgcttaaacccatatgggcagaatgcccttcatgcctccacctgtttgctgtagctgtgcacatgtggttcctggttcttgagaattcttcccctcctctgcctcctgaccatccaagtccctttcatgctagtcttctcagcttttatagcatgctgtaaagcagttgtcctgaagccaggtgccttacaactccctgctcccttgggacacttaatcccttctatcgccaacctcacacattgtatcgttggttgtttaattgtgtcactgatttccccagccccatgatggtccatggaacatcactgggatataaaaagtactggccaaaggaataaaatacaggaaaatattttgtgcattgtgggatctcatgaatgacagctgccacaatgatgatgttgatgataatggtgattctgatggtgatgatggttgtgatgatggtggtagtgatgatggcaatgatgatgacagtggtaatggtgatgatggtgataattatggtgatggtgatatagtaatgactgtgatgatggtgatgatgatgatgatggtgatgatcatgacgatggtgatgatggtgatgataatgattatgctgctgctgctgatgtgataatgatgatggtgatggtgatgatggtgtttatgatggtgatgatagtgatgatgaaaatattggtgttgatgatgctgatgctgatggtgatgatgatggggtgatagaaatgataatgatgatggtgatgaggatggtgatagtgatggtcatggtcatgtgatgatgatgatggtcagtgatgatgatggtcatgatggtgatgacaatggtggtggtgatagaaataatgatgatggtgatggtggtgatgctgctgctgctgatgatggtgatggtggtgatgatgatgatggtgatagtggtggtaatagaaatgataatgatgttggtgatggtgatgatgctgctgatgatggtgatgatggtgatggtgatgatagaaatgataatgatggtgatgatggtcatgctgctgctgctgctaatgatggtgatgatggtgatggtggtgatgatgatgatgatagtgatgatgatggtgataatgatgatggcgatgatgatggtgatgatggtggtgatgacggtgatggtgatgatgatggtgatgatggtgatggtgatgatgatgatgatgatagtgatgatgatggcgatgatgatggtgatgatggtggtgatgatggtgatggtgatgatggtgatgatggtgatggtgatgatgatggtgatgatggtggtgatgatggtgatggtgatgatggtgatgatggtggtgatgatggtgatggtgatgatggtgatgatgatggtgatggtgatgatgatgatggtgatggtgatgatgatgatggtgatgatggtagtgatgatggtggtgatggtgatgatggtaatgatgatggtggtggctatgatgttggtgatggtggtgatagtgatgattatgaaaatggtaatgattgctgttcatggattctgtgaaagaaccaaccccttttcctgaaacaatcttgctctacttgactatctgtggactgttctgtgtccttcctcccaagtctctgtggcttgcatgtcctccttctggtgggtaggttggccaagtctgacaccctcaactctgccctccttccatagctaacaacagccctaatatccgaagactcagggattctgctgtcagctcccttggctcagccaagcaaagactgtgcttgtgggagcccagaaagagggaatggaatacttctccagagagtaggtgttgcatttctgaatattgtaattaagccagatgagtctaggcaggcccacaggacctcttcaggcatcttcttgtccatgttttgcactatgcaggagaagtgatgctgtcagccatgcaagccatggccccccatacagcagactctcctacgaagccatgtagcttgcaaacaatgccatgttttagtttcatgttacccctcctgcagatttgcacatctaggctctgcttttaaaataatcatgcacctgtcaggctggaagttttcaggaaaatccttctcacctcatgtgtgttgctggctttttttttttttttttttttttggttgtggcttcctgagaacggggatgctacagcctgccactgttggaacaaaggtgcttttagtcactctacctgtcgctcttagggaacgtacgtgccctcaggggaaataggcggatgcacattttgcttctggctcttttgcctctttatttttttcatttttatttttttgaggcagagtttccctcttgttgcccaggctggagtgcaatggtgtgatctcggctcaccacaacctctgccctctgggttcaagcgattctcctgcctcagcctcctgagtagctgggattacaggcatgcgccaccatgcccagctaattttgtatttttagtatagacggggtttctccctgttggtcaggctcacacttctggaggctagaagtccaagatcaaagcatgccacgttcagtgtctggtgaggacctgcttcctggttcacagacggtgccttctcactcttgtcatcacgtggcagaagggtcgagggagctctctggggtcccttttagaaggacactcatctcattcctgaggccccaccctcatgacctcatcacgtcttaaagggctccacctcttaacactatcaccttgtaggttatgtctcaagacagggatctggggccgggtgtggtggctcacgcctgtaatcccagcactttaggaggctgaggcaggcggatcacctgaggtcaggagttcgaggccagcctggccaacatggtgaaaccctgtctctactaaaaatacaaaaattagccgggtgtggtggtgcacacctgtaatcccaagctactcaggaagctgaggcaggagaatcgcttgaacctcggaggcggaggttgcagtgagccgagatcacaccactgcactccagcctggcgactgtgtgagactccgtctcaaaaaacaaaacaaaacaaaaaagcaaaagcaaaaacaaaacaaaacaataaccaaaaaatggggatttcgagaggacacagacattgaaaccatagcacatggcgaccttgagtctttgagtttacgtgtgcagcatgaatgctcggtggtgatggatgaagagagagcaaggggggaatgccacacacttctaaactgtcagacctcgtgagaactcactcactatcatgagaacagcaagggggaaatccgccaccatgatccaatcacctcccaccaggtccctccctcaacgctgggaattacaattcaacgtgagatttggatggggacacagagccaaaccataacagcagcaatagtaaactcatacatcatatctatacatctctcctgaaccatccctgctagactcagtaggacctgtagagaccatctttccctgtattccttcaacatcctgcttccttatcatatgtttctaaggttgtatagttccatgagagattacagctacttttttttttttaagacatctcatcctgcaatgcagtcttttttttttttttttttttttttttgagacggagtcttgctctgtagcccaggctggagtgcagtggcatgatctcagctcactgcaacctccgcctcctgggtcccggttcaagcaattctcctgcctcagcctcccgagtagctgggattatggggacgtgccaccatgcacagctaagctctgtatttttagtagagacagggtttcaccatgttggccaggctggtcttggactcctgacctcatggtttgcccgcctcggcctcccgaagtgctgggattacaggtgtgagcgaatgggcccggccaatgcaatcttttagcaggaaatccatccaggattttggaatcaacagaaaagaaaaaccttgggttttggagtctcagattctggcggtcctgctagatgtgttgacgagtgtgttgggccagttaattaccctcataattgttctaattgcttttatcctgcaaatatccctctgtgttcattagctttgccattacgactgagcccaagtggattaaagaaagcctgtgatgccaccagacatcatttttgtttcggcaaaacagctttctctaggaatctggccttaatgtgttttggatgccccccacactgacagggtccttcatgagctctcctggatagaataacacaaaaaactcaaagcccattttaagaaacagcagcatcattaaaaaaaaaaaaaaaaaaaaaaaacctccactgccagcccacaggtcgctcattttcttcctagaaataaattccagttgagtggacacgtcttttacgggggaatttcagtcgtgattgatcatccgttgacctgtttaaaatgattgtcaagtgactgggctatcctcattcacagataactcaggcaggctcagattaattaacccttcgtttgtttgccatgtaggactaattagtcatcatccatctactgggaatcagacgtcattggcacagttatcaaggacagggactttgccggcttatcatgtagaaggaagaattaatggtgttggtgatatatggtcttgtgtagtggtagggtattcctctccctcttttcttcatgttcttctttctttgcttgccacacattcatttacaggggactctgaagccacgtgagggttaggggcacgtgaagaccttgtgtaactcttcactcccccaaaacttaactaatagcttgctgttggctggaagcctttcctgcaactagacggtcccatctaggggtaatgggagacagtgacagatcatgaggcaggtcattattgcaccagacacaaataatatagtaatattcttacaataaagtaagccaaaggccgggcgcggtggctcacgcctgtaatcctaacactttgggaggttgaggcaggcgaatcacctgaggttgggagttcgtgaccagcctgaccatcatggggctaccccgtctgtactaaaaatacaaaaaagtagccaggcgtggtggtgcgcacctgcaatcccagctactcggggggctgaggtaggagaatcacttgaacctgggaggtggaggttgcagtgagccgagatcgcaccactgcactccagcctgggtgacaagagcacaactctgtctcaaaaaaaaaattaatcaagagaaaaaaatatagtatgtattatatactatattcttacaatgaagtaacctagagaaaaatatagtaaatattctatattatattcttacaataaagtaagctgtgattttccttaagaaaatcgtaaggatgagaaaatatctttactgtttatcaggtggaagtggctcatgataaatgtcttcatcctcgtcatcttgacgttgaggaggaggaggaagagaagggggtgtctcgggtggcagaggcagaagaaaatccacatataaggggacacccattcaattcaagcccgtggtgttcaagggtccactgtcataggggaggctcaatattttagtttcctggagctgctgcgacacaattctacaaaccagctggctgaaagccacagaagtcaaatctctgacagctctgaacaccagaagtccacagccaaggcaggctgaccacctggtcatccaagggcagagcccgtgtcaaaggacattcctggagcagaaagccaacacatccgggtggaaatacaaccttccagtcactaagtatatttgcaaatctccagcaggtcactattgcaccagacacaaagaataagcgttcagtaagttgaagtattgtgtgcacacggccgggcgcagtggctcatgcctgttatcccagcactttgggaggccgaggcaggcggatcacgaggtcaagagatcgaggccatcctggccaacatggtgaaactccatctctactaaacatacaaaaaattagccgggtgtggtggcacgcacctgtagtcccagctactcaggaggctgaggcaggagaatcacttgaacccgggaggcggaggttgcagtgagctgagatcatgccactgcactccagcctggcgacagagcaagactctgtctcaaaaaaaaaaaaaaagtattgtgtgcacactgcaattatgaaatgcatttcattctggagtattaaggcagggctgtgccccttgcggaggctctggaggaggatcctccgctatctcttctggcttccttcgctagctagcaatcctggttgtttcttgtcctgtagaacagaggactccaaccccctggctgtggactggtactgagcaaagcttcatgtgtgttcacagccacttcccactgcacgcattaccgcctgaggtcacctcctgtcagatcagcagtggcattagattatcagaagattgagaaccctattgggaagtgggcagaccagggatctgggttgcatgcttcttatgagaatctaatgcctgatgatctgccactgtctcccatcaccccccggatgggaccatctagttgcaggaaaacaagtttggggctcccactgagtctacatggcaatgagttgtattgtagaattacttcatttaacgtatcatcatagaaataaagtgcacaataaatgtcatacgctcaaatcatccccagatccttccccctgcactcacagtgactgtctttctatgaagacagtttttgtgtgtgtgtggaaaaattgtgttccatgaaactagtctctgtgccagaaaggctggggacggctggtgtagaagcatcaatacagtatctgcctttgtcgtggccatctctgtgtctctatgccacagtgttcctcttctccttttttttttttgagatagagtttttgctcttgtcacccaggctggagtgcagtggtgtgatctcggctcactgcaacttctgcctcccgggttcaagtgattctcctgccttagcctcctgagtagctgggactacaggtgtgcaccaccgtgcccggctaatttttgtatttttagtagagacagggtttcaccatgttgggcaggatggtctcagtctcctgacctcaagatctgcctgcctcagcctcccaaagtgctgggatgacaggcgtgagccactatacccggcctccaatgttccttttcttataaggacaccagttattcagttaacagcgtacactactctaatgcaacctaattgtatgcaatgacaacctagttgtatgcaatgacactactctagtgcaacctaattgtatgcaaagatctgatatccaagtgagctttcattcctaggttctgggtggacacatcttggtgaggtcacagttaaacccacgtcacccaaggctaggggcagaatcagagtggatgttagatctccaggctcttgttctgggagtgtcattcaaagcctttcttcatggccacctgaatgacgatgtcatcctctgtgggtaacagacaccagcattgtgaatgatgctggcttcctttgctggtttctttctgacatttcccttttgtgctttcgtttatggcaagtgtagacatacatgcacactcagacacatacacacacgcacacatgcactcttgccatctacaatgcctcagatccgtactgcaattggccccagccaccctgtagaatttagatttagcgaaaaaagacttcacgtgttcgccaaattctgcgtttcctcctgagtcagaggcacctgcaatgcaggcagcgggaagttgttcttctaccagaacaagagcccctaggaaaattgccccttttattactgttttggtcaaaatatggcaacaacattggtgactccaggcgagttagtaaaaatcacagagaggcacattttgtgtccggggaatgctgggatgctcctaaaacccactgagccggccgggtgcagtggctccagcctgtcatcccagcactttgggaggccgaggcaggtggatcacgaggtcaggagatcgagaccagcttggccaacatggtgaaaccccgtctctactaaaaatacaaaaattagccaggcgtgggggtgcacgcctgtagtcgtagctactgaggaggctgaggcaggagaatcacttgaacctaggaggcggacgttgcagtgagccgagatcgcactactgccctccagcttggcgacagagtgagactctgtctcaaaaaccaaccaaccagccaaccaaccaaccaaccgaccaaccaaccaaccatcccatcgagccgttctcttgctgactcaagagagaataaatcaagaaacaaacacacaaggaaaccaaaacaaccctgtagctgaggattctcccctaggaggaagaaaacgggcatccacacggcgtgtgcccagctaaatataaactgcgaggggaagggaggagacagtgatgacaagccccagccttttccacaagaagaaaaaggtttaagttttcaatgctgcccatgatatccaagaacgaaccgcatttcacagccgcggtgtgcataccatactttcacttatcggaagctcattcattgtgtgatgtgcactaattacccgctggagatttgagaacgcacctgctgactgggagggcgtattcccacctgatgtggttgctttctgcactccagaaattccctttgagatgggctccatccttccatgacagcgtgaccgcttgtcctgtagtcacagtgttgtctgaagaatgcaggatagtttattttcatttttgtttatttatgtttctgttttagaggcaggttcttgctctgttgcccaggctggagtgtagtggtgctatctggctcactgcagcctctacctcttggactcaagcgatcctcccacctcagcctcctatgtagctgagactacacatacatgccaccaacacccagctatttttattttttatagagacagggtctcactatcttgccctgggtggtcttgaactccagggctcaagggatccttccaccacggcctcccaaagtgctgggattacaggactgaacctggccttgctgtggtctgtttcgagaagactttgtttttcgttttttgttttttggtttttttgagatggagtctcgctgttgtcacccgggctagagtgcaatggcgtgatctcggctcactgcaacctccgcctcccgggttccagcaattctcctgccttagcctcccaagtagctgggattacaggcatgtaccactatgcctggctaatttttgtatttttagtagagatggggtttctccatgttggtcaggctggcctcgaactcccgacctcaggtgatttgcctgcctcggcctcccaaagtgctgggattacaggcgtgagtcactgtgcccggctgctcacccagctatttttattttttggatggggtctcactatgttgccctgggtggtcttgaactcctgagctcaaggaatcttcccaccacggcctcccaaagtgctgggattacagccctgagcctggcctcactgtggtctgttttgagaagcctttgtttttaaacagaaccacatgttggtatttcagagccaactcttctgtcaagaatccaaatcagccaggcacggtggcatgcctgtgtagtcccagcaattccagaggctgagacagaaggatcatatgagcccaggagtttgagatcagactgggcaacatagtgagactccatttctttagaacaatactaatcacatgagggtggtaggccattgcctgggctggacaggtgagtagagggcaggtgtgcaggtgcagaggtctttttttgtcctcattccatgcacgactgtttctcaaacttgctatgctaagatgctacaggaacttactttacgtcacaatatcattgaccttttttcttccttcctgtggcttcctcttcccccactctctcacctgtgtgccctattttggataaccctcctcctgggttcctttctcaccatctcctgctgtcaacatctcacctctatttcctggccggatgatgcctcctccaggaagcctgcctaggtttcctgttggcttgcaaactctatgtgggtgcgaactgtccacaccgcgtcaggtacgcaggggcccttgaagtatcacacgttggcagctcagccctgaaaacttcagctccagatacaacaaccccttccccttttctccaacctgataatttataactccagggtgactcggttcagcggcactgcagtccctcagctcttccttgcagcagccgtggtttccatgggatgtagagggttatcctgcttggaaagcattagagctgggggactagagaccccctaattctggcgtggggagaatggaggccccagaggaaatggagcaggtgttttagtggaaaagctggttttgaaattccagcctcgcctcagaacacagcatagcttccctagatgatgtttcttttgaaaggtctcctctgaaaagagtgtgaggattctggcaaacttgcaacaatctctgtaacgatgggatggctgtgtccccacccacatggcacctggaattgtaatgattcccacctgtgaagggtggggccaggtggaggaaattgaatcatgggcgcggtgacccgcatactgttctcgtggtagtgagtgtgttctcacgagatctgatgttttataaatggaagttcccctacaggagccattttgcctgccgccgtggaagatatggttttcgtcttccgtcgtgattgtgaggcctccccaaccccgtggaactgtgagtccattaaagctctttttctttataaattaccccgtctcgggtatgtctatcagcagcgtgagaatgaactaatacagatgcaaagtagagccgcggtttatgagccacaagaaataccaacccccagccaggcgcggtggctgacgcctgtaatcccagcactttgggaggccgagaccggcggatcacctgaggttaggggttcgagaccagcctcgccaacatgatgaaaccccgtctctctactaaaaatacaaaaaattagccgggcagggtggcgggtgcctgtaatcccagctactcgggaggctgaggcaggagcatcgcttgaacccgggaggcggaggttgcagtgagccgaggttgcgccattgcactccagcctgggcaacaagaggaaaactccgtctcaaaaaaaaaaaaacaaagaaggaaaagaaaagaaataccaacctctccctttcaaacctaaaaccccaacatgctggatgctctagggggtctctggggcttcgctgcttacgtttgcccttgttgggtcctgggtttttatactcaacgggatcctggaatttatgtttcatttgtgattcggttccaatttgacacaactgcctgccttcccccagcggttcgtgtgatagacacactcacgctgtcaatcatggagctgtggggcgcgtctgggagatctatagcaaaactccatccactccggttcccttgtataatacaaaagggttttatcagtcatgtatttcgcctcaaaactagaagcatggatttcccaacccgattcaccattaaaattgtgaatttttctggttctggtaaggatacgttgactgtataatggattacataacagtgtgttttcttcaccttagtaagtagccctgggagtttgtagcaaagaaagaagaaacccgagcctcaagaaaatttctccgacgatggtgcccagaacaggggtcaggggtcacgtgtgatgcgcgaaaattaaataagtgataattaagggaaaagaaaaactcagtgcctcattgcactaactgtctggcaagcgcccagtgtccagctgtggacagcacagttgtctggggcagggaagatatggactttcctgcagagagtgctactctgcagcagtgaggtacacctttcagggatgtcccatgatggtgacagagacaccagatacacaggtagcaacagtttcatttgaaaagatcattcccacagatgggagcttttgcaataagaggaggagggactactgtaatgggaggaggaggggctgtgataatgggaggaggaggggctgtgataatgggaggaggaggggcggtgataatgggaggaggagggactatggtaaggggaggagtgtggactatggtaacgggaggaggaaggactggtaacagaaggagggactctgctaatgggaggaggtactatggtaatggaaggagggactatggtaacagaaggacggactatggtaacggaggaggggctgtggtaacggggagggtctacggtaacgggaggaggagggtctatggtaacgaggagggactatagtaacgaaaggagggtctgtggtaacagaaggagggactatggtaatgtgagaaggggggactgtggtaacggagggtctatagtaatgggaggagggactatggtaacggaaggagggactatagtaacgggaggagggtctatggtaatggaggagggactatggtaacagaagtagaagggtctatggtaatggaggagggactatggtaatggggagggactacggtaacgggagaagggactgtggtaacggaggagggtctatggtaacggaaggagggactacggtaatggaggaggggggactatggtaatggcggggagggattatggtaataggggaggaactattgtaacaagaggaggagggactaatgcaaccactggtggacgctgcctatagcaccatgaagcacacccgagcagtgacatctgggagcctcttggagcgcaggcagcataccattttcttttctagggacaggcacgtgatgctcggaacaaccgtgattggggtcgttcgatgtggggttcagtcatggataaaagctgccaaaccctgtggctgcatagctaattttgagcaggtcctaaggaagcgttgcttgatcctctgacgtttgctccaggtgaggctggcccaacatcccggggcctgataggaggagagaaacccaaccaaaatgtgatcacgttagatgggaattttgttcaggtcaaggaagacgaggaattcagtccatccctgaaggggcaaataaagaatgtgaatttggaggatgtggccagccttgtcctaggctgacttggaagcatctgtgagtaatgaggaagggaattttttttttttttttttcagtaaaaccattttctggaagacaaaggcagtggggaattcttaaccttcacagattcccaacagcacagttgtgtggaatgatggactgattgtgtctccgtaaaatacaaagccctcagctgggcgcggtggctcagactgtcatcccagcactttgggatgccgaggcgggtggatcacctgaggtcaggactttgagaccagcctgaccaacatggtgaaaccccatctctactaaaactacaaaaattagccgggcatggtggcgggtgcctgtaatcccagctactggggaggctgaggcaggagaatcgcttgaacccaggaggcggaggttgcagtgagccgagattgcgccactgcactccagcctgggagacagagtgagactctgtttcaaaaaaaaagacgaactgggactcctcaaactgggggaatggtgcatttgtagacaaaactcatggtgtgccatctgcaggtgtcattgtcaggaaggtgagcttggttcatctgtgcccacttgcaagctctttggagagtgaggagcaggttgggaagcatctatcctcagtcatgaacccggagctcctgctggaaaagacagccttggggtctctgtcatgcacatttcagtaggggagtccgggccgggcacaggggctcatgcctgtaatcccagcactttggaaggctaaggcgggcagatcacttgatgtcaggagtttgagaccagcctgaccaacatggtgaaacccgtctctactaaaatacaaaaaatagctggggctgggtgctgtggcttaggcctgtaatcccagcacttggggaggccgaagtgggtggattacttgaggtcaggtgttcgagaccagcctggccaacatggtgaaaccccgtctctactaaaaatagaaaaaattagccccggctaattttggtggtgtgagcctgtagtcccagctacttaggaggctgaggcaggggaatcgtttgaacctgggagatggaggttgcagtgagctgagatcgtgccactgcactccagcctgggtgacagggcgagactctgtctccaaaaagaaaaacaaacaaaaaaaaacaaaaactaaacacataggagagtcccttagcccctcacgaatactccacacacacatctagtccagctgcatcttgttgactcacaagacatcaagataagcctgattcaatgaagttcttcaaaatcagagttcatttgctcattttcttttcttctctccaccaattagtggtgagagtttcgcctgaatcacagtacctgctgtctccagttctgatgttggtatcacccatcttcagacaagatttcttgtgttatttccacatcagcttagccactgtctctcaacatgaaatgctggctggggggaagtttcaaccgcagaagcaaagctcttaaactcattgaaaagacaagctctttcccccttggtagggtcacgaaggctcctcagtgaagggtgtggtaggtttgcttctatagggtagaaatgagacaccctgaaaatcaggaggctttcattggcttttaatttacacagaaggcaatgtgtagtttcaaaatattcttttttatttacttatttacttttatttatttatttgagatggagtcttgctctttcgcccaggctggagtgcagtggtgcgatctcggctcactgcaagctccacctcccgggttatttatttttttgagacagagtcttgttctgttgcccaggctggagttcagtggcacaatcttggctcactgcaacctccgcctcccaggttcaagtgattctcctgcctcagcctcctgagtagctgggattacaggcacctgtcaccatgcctggctaatttttgtatttttagtagagacggggttttgacatgttggccaggctggtcttgaactcctgacctcaagtgatccgccctccttggcctcccaaactgctgggattacaggcgtgagcttccgcgcctggcctcaaaatattcttaatgagtaaatacccgtaagcatttgaatacaaccatttatgttttttgttgtttagcaattgtttgaacttcaatgtgcctcataaaaatgtttcattataaaacatttcacacatttgaaagacgcagagaataatttgaacagcatttgtgtacccaccatccagttgtatcaaatcgtaatgttttgccaaattagttataaattacgtatgtgacttgggtacccctctccaattattttgttattacataaaaaatgactttataacatgggtcaataggagaccttttttcttttttttttttttgagacagagtcttattctgttgcccaggctggagttcagtgccacaatcttggctcactgcaacctctgcctcccaggttcaagtgattctcctgcctcagcctcctgagtagctgggattacaggcacacggcaccacgcccggctaatttttgtatttttagtagagatggggttttgacatgttggccaggctggtcttgaactcctgacctcaagtgatccaccctcctcggcctcccaaagtgctgggattacaggtgtgagcctccgtgcctggcctcaaaatattcttaatgagtaaatacccgtaagcatttgaatacaaccatttatctttttcattgtttagcagttgtttgaacttcaatgtgccttctaaaaatgtttcattataaaacatttcacacatttgaaagacgcagagaataatttgaacagcatttgtgtacccaccatccagttgtatcaaatcataatgttttgctaaattagttataaattatgtatgtgtctttgtgtgcctgagtgtacatgaaataagacatttcagagactattgtgctcttgggtacgcctctccaattattttgttattacataaaaaatgactttataacttaggtcaataggagacatttaaaatattattttccatgcatctttgtccttgtttattttctctagaaaagaaaaatgtatttccctgttcttattttcaattcccaaatgaagcttcaatgtaaaactaattttctgagaatgtagcatcgttcttttttttttttcttttttctttttttttttgagacagtcttgctctatctcccaggctggagtgcagtggcacaagcttggctcactgcatcctctgcctcccaggttcaagcgattctcttgcctcagcctcctgagttgctgggattacaggcacctaccaccacgcgtggctaatttttgtatttttagtagagacgggatttcaccatgttggtcaggctggtcttgaactcctgactttgtgatccgcccacctcagcctcccaaagtgctgggattataggtgtgagccactgcgcccggctagcatctctctgtatttgctgaagccatgtgtgctgtgaagattgtagttttagccattgtggttcctcttgaaagggggccctatatcttcctgatggggaatggcttaactgaagcctggggaatggctggtgttcgtgaaatggctgcattcagatgagaaaccgcacatacacatcctcacaaagtctcagagtcagctttccagggggctgggttttattccggtgcaaaggagtgagaatattgtacacacgaatgatccatggtggctcctgcctgtaatcccagcacttttgggaggccaaggcgggagcatcacttgagcccaggaatttgagactagcctgggcaacatagcaagatctcgtctctacaggaaaaaaaaaaaaaattatccgggtatgatggcatatgcttctggtctccctctcaagatgctgaggcaggaggattgcttgagcccaggaggtggaggctgcagtgagctgtgactgctccactgctcttcagcctggctgatggaatgagacagtgtcacagaaaaagaatgagaaaaataagcccaggatgcagcaaagaatgctatcctttatttattaaccccctaccctggttgtatattgatggtcatttaaatattagagggtataaaaatacaatttccaagaattacctgaactattttctttttcttttcttttctttttttttttgagactgagtttcgctcttgttgcccaggctggagtgcagtggcgtggtctcggctcaccgtagcctccacctctgggttcaagtaattcttctgtgtcagcctcccgagtagctgggattacagccatgcccaaccactcctggctagttttgtatttttagtagagatggggttttactaggttggccaggctggtctcaaattcctgacctcagatgatccacctgcctcggcctcccaaagtgctgggattaaaggtgtgtgccaccacacccggcctattttcttagaattaatattttatcctctgccatcagccgtcgtaggggtatgagcagtttcctgcctattgtaagggtttagagaagggtttgtgataaattggccgtgtggtgaagagattcccattcgggaaagacattgggcagagggtaggatgtcatgtgaagacagcattcatttcaggcagggagagggggttcatagaacgctagtgttcagtgaactgttcctagaactagttcatatgtatacatgtgccatggtggtttgctacacctatcaacccgtcatctaggttttaagcccagcatgcattaggtatttgtcctaatgctctccctccccttgccccccacctcccgacaggccccggtgttcacagagctctagtatccacccaaggctcaccaaaggcagtcaccctttgctatggtggagtatcctgggagccataggtatccctgagctacctcaggttaaagactgcatacctgtgaaagcatgtgaggatttacccatttctgtgtattttgaggaaatctcacttccatcttcagagcttggtagccccaaggtaaaattttaagaagtaaagagattgtaagtttgcatattctgggaggtgatatgaggacaagctcttaggatgaactctctaggcatacaggagaaagaagtaaaggtcaaagcaaagtggcatcaaaaaggccaaaacctggccaggcacggtggctcacacctgtaatcccagcactttgggaggccgagatgggtggatcatttgtggtcaggagttcgagaccagcctggccaacatggtgaaaccctgcctctactaaaaatacaaaaatcagccaggcgtggtggtggctgcctgtagtcacagctaccagggaggctgaggcaggagaatttatttaagttccttgtagattctggacattagacctttgtcagatgaatagattgcaaaaattttctcccattctgtaggttacctgtttgctctgatgatagtttcttttgctgtgcagaagctctttagtttaatgagatctcatttgtcaatttttgaggcaggcattgttattaccccaatttcataaatgaggaaatgacagacagatagatagatagatagatatgccagttgtccctgaggaggcgaaattttgctcagttgaaaaccactgtgatatagatagatgatggatacatagatagatattagttagacagaaaatagctagatagataatagctagatagatagtaatggtcaatgatagattgtgatcaatgataggtaatagatgacaggtagataaatgatcgatggtcaatagatgataggtagatgatagacagtagatagagagtaaacagatgctatataatgatcaaagatagataaatgatagataaatatgtacttgatagataataaatggtaaatagataaatgatggtagataagtagatgatagatgataaatggtaaatagataaatgatggtagatagataagtagatgcttgattgtaaatggtaaatagataaatgatagacggtagataagtaggtgataggtggtaaataggtcgatagatattctataaatagttgatagataaatggtaggtgatagatgataggaagtgagttggatgataggcacacagacaaatggatcacatatgcatacaatctgtcatgctaaggcaggctttgtcaaccttggcagtatgtccatctggagctggatgattctctgtggtgaggccatgctgtggactgtagcgtgttgagcaggatccctgggctccacccacttgacatggatgtacccactataccccccaccgcagttataacaaccaaaaatacctccagacatttctatatgttcctgggggagggggaaacaaaaaggcctccaatggaaaaccactgatgtagatccctacagatgccagcccagttctgtggggatgtgcctactaccattcaatggcagtaacctggacctaagaccagtatgctctctgaggctctggaaagggactcccagcctcgcatcttgaggagagcttagacatcctacgtagcattatgattcccctccaaacatggctgtgctgtgtggatcaggggtctcctcccttatctcctccatcccacccagccgtctcctttcacctcagtccctgtgtgttgagtgtggaaatatctctgtgcccaggatcctgggccggttttgtggcggggattcttctcccacagctccatcatgcatgttccctcatctccttcgatgctgatgtgttattattcgtagaacagtgatgaaatggcagcatgataccatagaacggtgataaaatggcagcatgatatcatagaacggtgataaaatggaagcatgataccatagaacggtgataaaatggaggcatgataccatagaacggtgataaaatggcagcatgataccatagaacggtgataaaatggcggcatgataccatagaacagtgataaaatggaggcatgataccatagaacagtgatgaaatggcagcatgataccatagaacagtgataaaatggcggcatgatatcatagaacggtgataaaatggaggcatgataccatagaacggtgataaaatggcggcatgataccatagaacagtgataaaatggaggcatgttaccatagaacagtgataaaatggcggcatgataccatagaacagtgataaaatggcggcatgacaccatagaacagtgataaaatggaggcatgatatagaacagtgataaaatggaggcatgataccatagaacggtgataaaatggcatgataccatagaacggtgataaaatggcagcatgataccatagaaaggtgataaaatggcatgataccatagaacggtgataaaatggcggcatgataccatagaacggtgataaaatggcggcatgataccatagaacggtgataaaatggcggcatgataccatagaacggtgataaaatggcggcatgataccatagaacggtgataaaatggcatgataccatagaacggtgataaaatggcggcatgataccatagaacggtgataaaatggcggcatgatatcatagaacggtgataaaatggcggcatgataccatagaacggtgataaaatggcatgataccatagaacggtgataaaatggtggcatgataccatagaacggtgataaaatggcggcatgatatcatagaacggtgataaaatggcggcatgataccatagaacggtgataaaatggaggcatgataccatagaacggtgataaaatggcggcatgataccatagaacggtgataaaatggcggcatgataccatagaacggtgataaaatggcggcatgatctcaagggttgggattagacacccagaaatgggagcacctgtggttgggtggagttattgatccatccttctccagtgttcaactcctccacctatgctcatatcacttataaggcagacctggccaggcatggtggcttatgccggcaatcctagcactttgggaggctgtggtgggcggatcacgaggtcaggatttcgaggccagtctggccaacatggtgaaaccccatctctactaaaaatacaaaaattagtggcatatggtggtgggcgcctgtaatcccagctacttgggaggctgaggcagaagaattgcttgaacccgggaggcggaggttgcagtgagccaagatcacaccactgcattccaacctggtcaacagagtgagactctgtgtttcaaaaacaaacaaacaaaaacaaggtagaccttatgggtctttccctgggagccttctacagagtggttgttgctacagacagcagtgatatgagacaaaccatctaaggccctgaaatatgagtcttgaaaatggctgtggacaaggaaaatcaatgaaataacagtgacaccagcaccccactctctctagggctcttaaaagttcttagcctgtagcctcttttccaatccactccagccttccttttctttgaatttgaaaatgaactttgaaatttctttcagtgacaagaaaatgtcactgtgttacgtgttgtatatccatgtgtctccttgggaagaaaattaaaggactaattgaagaaagaattagaaacactgaatccacagaaacgcagccacactctgtaattaatttttgaagaaaagaaaatgaaatgcttgccgatggtgaacctctccagcatgttcattagatatttgcattttctgcctattccattaaaagtacctctaatcagacagtcaatcaaaagtgcttatccagacatcttctttttagaatttgaatcatgccatgttctgtataggagtgagaccttaccacataaacagggtagggcttgctgtgtgctcagaaacgacacattaaccaggctgaactgatggaactccagctctctgtatccttctttgtccctctaatacttgggcagattctgccccaccattaaaaattcaatcattaataccaagaagaaaattgaggggtttcaaagaacctcaataaaccacagatttaggtctttataagaccttggtaagcagttgtggattctatagtttgtacctaccataagttatgatgatcattatagcattactgataacattttaaaaacttttattgagctgggtgcggtagctcacacctgtaatcctggcactttgggaggctgaggcaggtgtatcacgaagtcaggagtttgagactagcctgaccaacatggtgaaatcccatctctactaaaaatacaaaaattgggtgtggtggtgggcgcctgtagtcccagctactcaggaggctgaggcaggagaatcgcttgaacccgggaggtggaggttgcagtgagccgagatcgcaccactgcactccagcctggcgacagagtgaaaactccatctcacaaacaaacttttatgataatgtgtatggaaagtgtctcctcttgaaatgttccattttctctaaccaaagccaacgctccagccagccagtaggtagcagccagtaggagctgtcagaactgattgctcttatcatcactaaacacacaaagagggaaaagccatttcctcattccccaaattccagctccatccttcctctgaaagcatcatgccatttctcgctccggatatgtatttggtgtttagtcattcaaccgtgacatatctaacgttggcagagagggggcagaattcgaagttcttgccattccaggaagaggaagccatgttccctgtctaagcatctgcccacatcgggccgtgtctcggtaccaactccaccaagagagcagtgagtgacaaaggcaaggatgttcttaccaaacttggcgataacctggctccattaccatcctagattaataacccttcagtcattccagaggtggatgttgatacccaagaaatggtgggtgatgtgtatttttttgttgttgttgttgaaacagagtctcactctgttgcccaggctggagtgcagtggcgcgatcttggctcactgcaatctccgcctcccgggttcaagcgattctcctgcctcagcctcccaagtagctgggattacaggcacgcaccaccacacctggctcatttttgtatttttagtagagacagggtttcaccatgttggtcaggctggtcttgaactcctgccctcgtgatccgcccaccttggcctcccaaagtgctgggattacaggcgtgagccaccacgcctggccccattataaccctcttgcatagtctatccttcactcttgcgaaatgtttaatgagatgttgaataaatgttactatgctttgtatctttttttttgcttctatgtcacttttctttttgccgtgggtggcaatggtgagttcttttgcactcagggaagcttcatgcctcatcaccccaaccttctggaaattttgattcttatagttcaaacttccataatttttaaaaaccatttttaagttcagggatacaggtgcaggtttgttacataggtaaactcgtgtcatgggggtttgttgtatgattatttcatcacccaggtattaagcccagtacccattagttattttcctgatcctgtccctcctcccaccttctgataggcctcaatgaatgctattcccctctctgtgtccatatgttctcatcatttagctctcacttataagtgagaacatgtagtaatttggttttgctgttcctacatagtttgctgaggataatcgcctccagctccatccatgtttctgcaaaggacatgatcttgttcttatttatggctgcatagtattccatggtgtctatgtaccatattttctttttctttctttctttttttttgatatggagtctcgctgtgtcacccaggctgctggagtgcagtacccttgaaaattcctctgcctcagctcactgcacccttgaaaattcctctgcctcagcctcccaagtagctgggattacaggtgcacgcccccacgcccagctaatttttttgtatttttagtagagacggggtttcaccatgtgttggccagactggtctcgaactcctgacctcgcgatccacccgccttggcctcccaaagtgctggaattacaggcgtgagccaccgcacctggcctatgtaccatattttctttattctgtctaccactgatgggcattcagattgatcccatgtctttgctattgtgaaaggtgctgccacgaacatacacgtgcatgtgtctttatgacagaatgattgatgttcctttgggtatatacccaggcatgggattgctgagtggaatgatatttctgtttttaggtctttgaggaatggccacactgtcttacacaatgttggaactaatttacactcccgccaacagtgtttaggtgttcctttttgtctgccaccttgccagcatctgttgttttttgatgttttagtaatagcctttatgactggtgtgagatggtatctcattctggttttgatttgcgtgtctctaatgagcagtgatgttgaatgtttttgcataggcttgtcggctggatgtatgtcttttttttttttttttccgagacagagtctcactctgtcgcccaggctggagtgcggtggcgcgatctcggctcactgcaacctctgctccccgggttcacgccattctcctgcctcagcctcgcaagtagctttggtttttgactttagttacatgcactttttcagaaatcaaggtatgcataagcaaagcacatctgtctttccaaactggatttaaattcgccatttactaactaaggaatattgtgcaatttagttaacttctctaagcctcattttcctcgtctatgaaatgggaagaatagtaagatctacctcaaaagaatgttgtaaaggttaaacaaggtaatcaaattgtttagtaatatgcctcccacatatcaagccctcaaccccgccaccatgcctggctaattttttttgtattcttagtagaggcagggtttcaccgtgttagccaggatggtcttgatctcctgaccttgtgatccacccgcctcggcctcccaaagtgctgggatgacaggtgtgagccaccgcgcccggccagctgcatgtgtatcttcttttgaaaagtgtctgttcatgtcctttgcctgacgtggcaaagggtgtgctttcaatgggattttttttgtttttatttttgttttgttttgtaaatttgtttaagttccttataaattctggatattaaacctttatcagatgcatagttggcagatactttctctcattctgtaggttgtctgttcacgctgttgatagtttcctgggctgtgcagaagctctttgaaactttcgtaactttaaaccaagtgttagctaactccgtttctcaactgagtaacttcagaaattaaattagaacaacaggttctgccttttgaagacaaagtagcataaccctagccatccaccacatgctatcacttgattctgattgctgttttgaggattctttttgtcccaatctctaattagttttttaaaataagcgttttgtagagaggatgtttttctcaagagttaccctgttttgactatggtagccacaccccagtgatgtacatgtgtttctctattttccatttcataaccaccgttatgtaggtgaatccttgatctgacacacagtgcctgtctttccctatgaatggcttagtgatttgcctggaaatcttagcttgctgtagtgtgtgtgtgtgtctgggcacagttttagagaaacaagcaatgattcttttttttttttttttttttaatttcctgagtcccaaagtgtttgagacaaatctcgttttcccatatcgggtctagggttatttgttcagatcctttgtcattcaggactctgtagctctttctttattccttactgaaatctcacattgacgaagagctctttccacctgatttgcttttccattggcagatgtcctttttgttcctcccttgatgcttttaggattttctcttgatctttaaagctccacggtttcatcaggatgaggttgatggacatatgggcatttaaaaataaatcgtatggcttactatacatcttataatggcagatctgggtttttatctcagggattttttttttctttgcacgaaacctttccatttacaattgacccttgaaaaacatgggggttagggacaccaacccctcacacagtcaaaaatccatgtgtaactttttttttctttttcgagacagagtttcactgttactgcccaggccagagtgcaatggtgtgatcttagctcactgcaatctccgcctcctgggttcaagcgattctcctgcctcagcctcctgagtagctggcattacaggcgcacgccaccatgcctggctaatttttgtattttcagtagagacggggttttaccatcttggtcaggctggtcttgaacttgtgacctcaggtgatccacccactttggcctcccaaagtgctgggattacagatgtgagcccctacgcctggcccatgtgcaccttttgattctccaaaaacttaattattaatagcctactgtttacaggaacccttgccaataacataaacaggtgattcactcattcatattttctatgttctatgtattgcatactttatgcttagactaaagtaagctagagaaaagaaaacgttaccaagagaatcatgagaaagagaaactacatttactattcatcaaatggaaagggatcatccccgaggtcttcatcctcatcatcttcacatggaggaggctgaggaggagaaggaggaagagggaggttggtctggctttctcaggggtggcagaggcagaagaaaatccacatataactgacctgtacagtccaaacctgtgaaggatcaactatgtttctgtgtctctttctcccagttcttgtcttcagagataccaacattggatgttgcctctcaactggtttccttctctttcatgttcttttctccaatcacttcatgtcatcatctttttcttctacattctacacgcttccacaagcctgccctctgcacccctgacatgattctccacattcattttttttctttttttgagacagagtcttgctttgtcacccaggctggagtgcagtggcacgatcacggctcactgcaacctctgcctcctgggttgaagcaattctcctgcctcagcctcgtgagtagctgggattacaggtgcccaccaccacacccagctgtattttgtatttttagtatgacagtgtttcaccatgttggcctgcctggtctcgaactcccgacttcagttgatctgcctgcctcggcctcccaaagtgctgggattacaggtgcacaccaccagacccggctaattattgtatttttttttttttttttgagacggagtctcgcacttgttgcccagggtggagtgcaatggcgcaatctcggctcactgcaaactccacctcctgggttcaagtgattctcctgccttagcctcccgagtagctggaactacatatacctgccaccacacctggctacattttgtatttttagtagagatggggttttaccatgttggcctgggtggtctcaaactcccgactttagatgatctgcccacctcaacctcccaaagtactgggattacagggtgagccaccatacccagctgagtctcctcattcttgattttgatcttccctctgtctactattgtccgggcttctctaggatgtgatgttatatctcctactcgtttccggcacccttcttattatgttaccgcattaacccttttgttaaacgtttaatatttttgtgctctgaatttattattttttatctgatatgaatatattaggttggtgcaaaagtaattgctgtttttgccattaaaagtaatgatagtcttttttttttttttttttttttttttttttttttagatggggtctcgctcttgtcacccaggcaggagtgcagtggcaccatcttggttcactgcaacctttgcgtcccaggctgaagacatcgtcccacctcagcctcccgagtagctgggactacaggcatgcgccacaacgcatagctaatttttgtattttttgtagaaacaggctctcactatgttgctcaggctagtctcaaactcctgagctcaagcaatccgtcgtcctcggcttcgcaaaatgcagggattccaggtgcgagccattgtgcccggcctgataatattttgactctgactttcttttcgtttctatttacctttaaatctcttttatgttccacctgaattactcctctgtgggtatcttttataggctgtatatttgtgttttccttccaacctatttcttgctataattgagatagtgaaggattagtggtctcaggtccttctgcctcgccccacataaatcttcatttcaactgatgctcttcatttcttttttatggaatattactttcctgttttttgtgtttgcctgtttttcccatgagtcccaagatggatattttccctccatacgggcatttattttaatgcccagtcttcacccctggaggatgcgtgagttggttcttttttcctccttgccccgtggacctcagacatggacacacgtgtctgtggttttgagggctttgttttatccgttcagttcttcagctgcttaagatggacggacagaggccgagcgcagtggcttacacctgtagtcccagcactttgggaggctgaggcgggcagaccacaaggtcaggagttcgagaccagcctggccaatatggggaaaccccatctctactaaaaatacaaaagttagccaggcgtggtggtgggtgcctgtggtcccagctattcgggaggctgaggcaggagaatggtgtgaacccgggagacagaggttccagtgagccgagattgcgccactgcactccagcctggctgacagagcgagattccatctcaaaaacaaaaacaaaaaagatggatgggcagggagtggaggctgtgggtagtgattgctgtccatgacccctgtctgtgagcacctgctctctaagctgagggaatccctggtgtcatcccagcagtggcgtgttccatgctgctgtaggccaggaacatggtgcagccgaagtggacggccatccagtgatgacttggccccagtggacagctgcccagtgatgggacatctggagtagatggccgtccaacaacagttcattattgttgtgctacgtctggtgtttccagtggctggaaccactagagctccgctccattgggttggagccattccagggtgggaatggccaccaggagacgatgcctacccttctcttcttgcaccaagtcagcacccatactcaggcgaggccctgtgtctcctcctcctccccagcatagtcttgctggagtcatgtagaaaagtcatggaaaggggcttgtgaagggatacgctgccttcttcctgggctctcctggtatcccactggtactcagtcattctccttccaaactgaggtgtgtgcatacatataatttgctggcccttaaaaaccacgtgtaggcctggctcctgtaatcccagcaatttgggaggccaaggcaggaggatcacctgaggtcaggagttcgagaccagcctgaccaacgtggagagaccccatctctactaaaaaaaaacaaaattagctgggtgtggtggtgcatgcctgtagtcccacctactcagggggctgaggcaggagaatcgcttgaacccgggaggcggagattgaggtgagccgagatcgcgccattgcactccagcctgggcaacaagagtgaaactccatctcaaaaaaaaaaaaaaaatgcaatcagctataatccttccctaaactactggtgtgactgtcttctgactccttcaactattacccaaaagatgaatgacttcttagtgaccctttgtcctaggaattatttcataggcttctgtagcaaatggaaccttgggtctcactaggataataagcatgttctgaattcctggacgcttttttctttttttcctgcacaacttcatttcggggtaaatgaggacagcacctgagttccccactcccctttggattctctagggggttgaaggtttcttctactgacatacacatggcttcaggaagatggtgttggacgctttttctttttttgagacagggtctggctctgtcgcccaggctgaagtgtaatagtgcagtcttggctcactgcaatttctgcctccgggctcaagcaatcttcccacctcagtctctcgagtagctacgactgtaggcacgtgctaccatgccctgctaatatttgtatttttttttgtaaagatgaggttttgccatttgtcccaggctggtctcaaactcccgagctcaagccatcttgcctgccatggcttcccaaagttctgggactacaggcaggagccactgcgtccagcctggttttggactcttggtcttgggtttggccaaaactttggtggttcagatggactcttgtagattttaaggagaattgaagttttgtggcttaagctgaactgctgttctcaatgcccgtgctggtccgaatgcccatgctggtccctatagcccttcatctactgtggctggtcttgtaggtctgttttatttgctgtaggagcctttgcctgtgcttgtagctatcaccgtagcattcaacacacctctgctgtatcccctgaagacgccgaaacgtggtattctcaccccaaagagtttccaccctgataagttccagcaaggcagcccagcagctacgcctgcagacacttgttggtaggaagaagtgtcagatgatctgtaacactgtgcgttgatcctgcatgtctgaagaacttcacagaattgtcgcatggtgagcagtgatactaagcaaagctgagtcacccgtaagctcccaggccctcagcccggcaagtaggacggtattttcacacctctgttgatgaagcacctcagatagctcaagtttttggagacagcctcgtaggagttttagtttaaccataatctgcttgcggatcactgatgtttccatgagtcattccctgagattgtagtgaagaaaacagatactatcccattcgcttctttgcaaaatacccacaaagccacatgcattttcatactgaacatcttgggataccatttattttcctgcaggattatatcatagtttagggttgagtgtgcctccaggagtcatcagctaagcttcctgttttgtggatagagaatacgggaggacatctgatcccctatgactgccagcatcaggcctgggattgtggttgtccaatggtgcttttagggggcaaaaatgcacagctgtttattgaaacaacaaatgttccaggctgggcacggtgactcacgcctgtaaccccagcactttgggaggccgaggcgggtggatcacctgaggtcaggagtttgagaccagcctggctgttatggtggaaccctgtctctactaaaaatacaaaaattagccgggtgtagtgttgggcatctgtaattccagctactcaggaggctgaggctggagaatcgcttgaatcgaggaggtggaggttgcagtgagttgggattgcgccactgcactccagcctgggcgacagagtaagggcagggagggctctcagtctggtagtctcacccaggtggtccagggttccagcactgagagccaggatgccaactcccaatgcatcatcagcctcctcttcagccatgcaggaagtcagggctggtcccagtggttaatccagacaccagagtgcatagcatggccctccccatgtccagcacactggcctttcactgtaccatgtcctctttctcccattgggtggcctgtgttgctttctcaatctccaagtctgtgtcagcaaggaagtgttccatcctttactgagtcatgacctgtctgaggctgacaagtgccagagctcatgttattcaggcatatttataagcaggtgtttttatttaaagacttagtccacatattacaagtattctgatggactcatcaaagcagatagggaaagttggccagtctcattttgaatgttacgatgtagccgaacatttacaaaactgtctttgactttctttctttttaattttactctaagttctgggatacatgtgcagaacgtgcaggttcgttacataggtgtgcgtgtgccatggtggtttgctgcgcctatcaaccaatcttctacgttttaagccctgcatgcattaagtatttgccctgatgccctccctccccttgcccccagctccctgacaggccccggtgtgtgatgttcccttccctgtgtccatgtgttctcattgttcaactcccacttatgagtgaaaacaggcagtgtttggttttctgttcctctgttagtttgctgagaataacagtttccagcttcatccatgtccctgcagaggagatgaactcatccttttttatggctgcatagtattccatagtgtctacataccacattttctttatccagtcttatcattgatggacatttgggttggttccaagtctttgctgttataaatagtattgcaataaacatacgtgttgaaatttttattttatcacggtcaaacgcttaccatgagagccaccctcttgacaaagtgttacatgtataatacggtcttgttaactctaggcacaactgctgtggtgtgcacagttgtacccagactgcagaactgattcatgttatataccaaaaccttatacttgtggaacagcatctccctacgtccctctctcctcatcttctgaaaaccatcattctactgtctgcttctgtgaatttgactattttagattctacatgtcagtgacatcatgcggtatttgtctctctgtgtctggtgtatttcacgttaacatcccccaggttcatccatgttgtggcaaatgacagaattcccttctttttaaggctgcgtggtattccattgtctgtatgtactgcattttctttctttttttgagatggagtcttgctctgtcacccaggctgcagtgcagtggcgtgatctcggctcactgcaacctccgcctcccaagttcaaatgattctcctgcctcagcctctggagtagctgagactacaggcacccgccaccatgcccggctaatttttgtacttcttagtagagacggtgtttccccatgttggccaggctggtctcaaactcctaactaactgcaagtgatctgcctgcctcagcctcccaaagtgctgggataccaggcgtgggccactgcacctggccaattacgttctttttttattttttttcttgagacagagtctctgtcgcccaggctggagtgcagtggcgcgatctcggcttactgcaagctccacctcccaggttcacgccattctcctgcttcagcctcctgagtagctgggactgcaggcgcctgccaccacgcctggctaatttttttgtatttttagtggaaacggggtttcaccctgttagccaggatggtctcgatctgacctcgtgatccgcccgcctcggcctcccaaagtgctggaattacaggcgtgagccaccttgctcagcccaattaccttccgtttaaggctgtaaagtatcccattgtgtgtatttacagcattttctttatttctttctttgagactgagtgtcactctgtcgcccagtctggagtgcagtggcgtgatctcagctcactgcaacctccgcctcccaagttcaagtgattctcttgcctcagcctcccaagtagctgagattacaggtgcctgccaccatgcccggctaatttttgtacttcttagtggacacggggtttcaccatgttggctgggctggtctcaaactcctaactaactgcaagtgatccacccgcctcagtctcccaaggtgctgggattccaggcaccgcgcctggcccaactaccttcttttgaaggctgcatagtatcccattgtgtgcgtgtaccgcattttcttttttttttgtttgagacggagtgtcagtctgtcgccaggcctgagccaccgcacccagctgtaccgcattttcttcatccattcatctattgaacgcttgggttcattccatatcttggtgattgtgaatactgctgccataaacatgggggtgcaaatgtctctcatagaccgatttatcttttggataaatacctagaagcatgcttgctggatcatcgagtagttctatttttaatttttttgaggaacgtccgtaccatttactgtattcacccatttctgcaggaaacagtggcagaggaacacaagttttcttcttccctgtcccagctgtgcaaaaagagacccacagccgggcgcggtggctcatgcttgtaatcccagcactttgggaggctgaggcaagcggagcacctgaggtcaggagtttgagaccagcttggccaacgtggtgaaatgtcgtctctactaaaaatacaaaaattagctgagtgtggtcgtgggtgcctgaaatcccagttacgtgggaggctgaggagggagaataccttgaacctgggaggcggaggttgccgtgagccgagatcgtgccactgcactccagcctgggcaacaggctctctcaacaaaacaaaataaaaaaaaaaaaaataaaaataagagacccacaagggctttggacctcctttctttgcaaaacaagaaaataatatagcagacattgggcagtttttcattctgactttccagtttcatttttgcttcttcctgtatggttgctgcctggacctctttcttattgctgggaggtctttcccctgcccccatccttttgagcctttctatctacttttcttttgaaagaaagtaaataaaaccccacacatccagacaataggagcgcacgcctcagaattctggctgcgagggactgaccccatccagagagaacgaacaaatgcatcaaaaccctggctgcaagcgactgaccccagcttgatccacttaagccagaagagcctttgcttctatgtttaatctgcaccaagcttagtgatcactttcttctcagaggccagaacacagagtccaacctttccaggatgccagcttcctatctctggggtctcctcttcctgcagagaagctttagtctcttacccgagctgcttctctattctcttttgccttgctttgcctataatactaacacactgtctttttcttatgttacgttggactatcccaaggcagggacccaattggcctggcttgggttccctgcctgactgtgggtttggctgaggagtgggcagcaatttccagccgttggcactgccagaacgcatgggtgtatggggtttctggaggcagcagctctatagtgaagcagatatgtagggggtgttcattaccaagacagcagtgattgtccacgagcagggtggttccaacagggagcctacagtctaactgcagatggatgctaccattttacatgtcccatgtatgacatccatgtaccgtatgttgctggacaccgcattatggcaactgaaaaacaaaaaggcattaaatgcctgggaaaatgtacagctcattacatctcatatggtttggctctgtccccactcaaatcttatttatttatttagagacagagtctcgctcactcaggctggagtgccgtggcatgatctcggctcactacagcctccacctcctgggttccagcgattctcctgcctcagccttttaattagctgggattacaggtgcccgccaccatgcacggctaatttttgtgtttttactagagacgggcttttgccaaattggccaagctggtcttgaactcctgagctcaggtgatccacctgtgttggcctcccaaagtgctgggattacaggcgtgagccaccgcgcccggccccaaatctcatcttgtattcccacctgttgtgggagggacccagtgggaggtaaccgaatcatgggggcaggtctttgccctgctgttctcatgatagtgagtaagttttatgagatctgatggttattataaaggggagtttcctgcacatgctctcttctcttgtctgtcacaatgtgagacgtgcctttcaccttttgctttccaccatgattgtgaggcttccccagccacgtggaactgtaagtccagttaaacctttcttttctaaattgcccattctcagatatgtctttatctacagcatgaaaacatacttatactttatttatccatccttatctatatcaaatactatttgaccatagattgtgtaaagacaatatggcacagagacaccatggaatactatgcagccataaaaaagaatgagttcatgtcctttgcagggacatggatgaagctggaaaccatcattctcagcaaactatcacaaggacagaaaaccaaacacctcatgttctcactcataagtgggagttgaacaatgagaacacatggacacagggaggggaacatcacacactggggcctgtcggggagtaggggactgggggagggatagcattaggagaaatacctaatgtagatgacgggttgataggtgcagcaaaccaccatggcacatggatacctatgtaacctgcatgttctgcacatgtaccccaggacttaaagtattaaacaacaacaacaaaaaaaaaaccagactcatacaacatccctacaaacaggaaaaatggggaggggaacatgggagtcaccttgtagtttacttagatttgctgtgagaagaagctatgggaggctttccaaaggctgcgggaaggatttgggctatcttcaggagattgagcttgacagcagcttcaaggcgccttgtgggaggggaggctgggggcaggaaaatcaggtgggtgaaaaatacactgatttgcagagaaatggtgccagcctggactgtgaaaacagagacgagaaaaaccacactcggcaatatttgagcacgtattaaatcctggatggcacattgcatttttatggatgtcattcctaagagattcacagtcaggggaagatggtacataacaactcgggcatgtcagatgcacctctgtagctgcgtgtccagatgccatggagtgagatgcctggttttgctcatagagttagaaacattatcagaaaatacatgtatttgagttaaattttagagagtgagtagaaattcatcgggtctacaaggaggcaaagagctttcctggatgaaattcctccttggcgttcacctaaaacttactaatttcttacagaacaaggataccacgggaggtgggtgccgcagaaccagggaactgtgtgtctgagtcaagatactgcagagaaatagaaccaatatgatgtgtgtactgatagaaagcacatttattttaaggaattttgctcatatggtgatggaggctggcaagtctcaagatgtatggggtagaccagccagctggagacccagggaggagctgatgatgtagttggagtccaaagtccatctgttggcagaatcccttctggctcaggtaacattagtcttctgttctagtcagaccttcaactgattggaccaggcccacccaccataggaaggacaaattgctttactcaaagtgtactgatttagatttttttttttttttttttgagacagagtttcactcttgttgcccaggctggggtacgatgcgatctcggtgcgatcttggctcaatgcaacttctatctcccaggtttgagcaattcttctgcctcatcctcccgagtagttgtgattataggcacacaccaccacgcccagctaatttatttttatttttttggtagagacaaggtttcaccatgttggccaggctgatctcaaactcctgacctcagatgatccacctgcctcagctgcccaaagtgctgggattataggtgtgagccactgcacccagcccagtcttttgttctattatgaccttcaactgattagaccaggcctacccaccaattcctttactcaaagtctcctgatttcgatatttatctcatttaaagcaacctcaaagaaacacccagaagaacatttaatcacatatgtgggcaccatggctcagccaagtggacttataaaatcaaggatcaagggtgcctcagaacaagagtacccagacagaacacaagttgggcagtatttcaagaggcaggggaagccatggaagctgctctgaggggacttgtgatcaggtgtgtatgttagggaggtcactgtggcagcagggtatagggtagactgcaggggtcttgtggcctctgtctctgtcacaggccaagtcatattcaaatttataaaattcaaaatttttacatcattaatttgaaattttattaaataaatacagtatatatatatatatatatatatatatatatatatatatatatgcttctttttatatactttaagttctggggtacatgtgcagaacgtgcaggtttgttacataggtatacatgtgccatggtgggttgctgcacccatcaacccatcatctacattaggtatttctcctaatgctatacctccactagcccctgaccccctgacagaccctggtgtgtgatgttccccaccctgtgtccatgtgttctcattgttcaactctcacttatgagtgagaacatgtggtgtttgcttttctgttcttgtgttagtttgctgagaatgatggtttccagcttcatccatgtccctgcaaaggacatgaacccatcctttttatggctgcatagtattccatggtgtgtctgtgtaccacattttctttatccagtctgtggtcgtatagtatttctggttctggattcttgaggaatcgccacactgtcttccacaatggttgaactaatttacactctcaataacagtgtaaaagcgttcctatttctccacatcctctccagcatctctcgtttcctgacttttttagtgatcgccattctaactggcataagttggtatttcattgtggttttgatttgcatttctctaatgacccgtgatgatgggctaaaaattcagagaaaatgtaataaaatgtttaatctagctcaagtatccttcctttgttgaatcagttttcaccttttctgtctttcctgctggctggcttgctggagcccgctctcatgagtggtgcaaggtcagagatagaaaaccaggcccatgtatggttgtgtcttttcacaagttcagccttttattgatgctatttcagtttacagaagccccaagatgcacggagttttcaaggaggcaattctccttaggacttcccatttagtactgaaatggcttgagcccttggagtactggagcctgtgtgccggcagcatttagtcagagctacaggcgcacaggctcctgctgtgacccaagtcagtcagtattgcaacctatacatactaatacacttcaccaatatatgcatgttatagattaaacattctacatcaaacaacgtaacatttatcatcaagagaaaaggggtaggaaaaagcttaacaaaggagcacagggatattgatgtggacaaaaaaaagtctcctggcctggccctggagggccatcagtggtcgccatcttgcaaggaagagcctttgatatcagtggggcagagccttttgcggtggatgctgcgtaatgattacaagtgacagcaagatggcatctgttaaggtagccatttggagctgctgaagccctgttctttcatgaccacagagtcctctggtgaggattgacaatggaagagggtgtttggttgtgtccttaactgtttggatgtggtctttattgatcaggtgaacatctggctcctgtaggcatgatgccttttgaatgaaatgtaacatggaatctttttctaaggtggagtcacttatgtcaagcgtgctctacacactcactgtaagaattaaagaggaaagaagcatgaaatgtcacttgacagttaaacacaggtttattttagagaaacctgagaggggcttctggctgagttaggtcagagctcttctctcttatagactaagcacatttaagggttttggaagggggtgcttatcataggttcagaatgtttgtatgtgagggagagtttattgcagggttgaatatctctggtcagaggggaggctgtctcagggttggtatgtttttggtcggagacgggtttatcttagggttggaatgtttctggttatgctgacatgagtcatgaggctgatgttttcgggctggatttaggcggtttttaatcaaggggagcctagaatggtggtgtttgttcaagatggccatgctcccgctctgtcacccacaacctgaagaccgttatcatattgattttgtatctcctgtgcgtacctgatggagaatgactgaatgtttgaattaaaagactcagggagaaggcaaagttgtgtttaagttgcaagttgaaaaaaacaatccattggctctgttagcagctattagagaggttggggcgggagcagagtctgtagcttaactttgcttttgttatgtcgatgctatgagcgtgggaatcatggaaactgtgaataaatggaagagagtctgtcagtgacctactgctgcatcttgggccagcccaggcatccgtgagtgttcagggagacctcgggagagttctcaggcagaaactagccactcacatgcttgtcatctgcggggttgacatggtgggctatttttatgctcagacacttgggagaaagggcaggctgtacccaaaggcagataagtgctggccagatgggcttgctgggcaccgtcgaactcatggtcaccgtcctgcccaggagctagaaatagaactagccccgggacaatccgtgaggtatcaggtgagtatggcccgatacatgtgactcagagacacaaggagtgagggtgtgtgctctgtctcaatgagagaagagagaagtcagggcttgctttggcaacaccaaatgcagatatcagactcctattcagaaaccagaattctcatctcagcatttattttctggatatgtggccgacagataggcatctctgtttataatgcctttaattttgatcttgacaaggactagaggaagctcttactgaaccttcacgcccacaaacaaaagcttctaaatcggccgggcgaggtggctcacgcctgtaatcccagcacattgggaggccgaggcggacagatcacctgaggtcaggggtttgaaaccagcctggccaacatggtgaaaccccatgtctactaaaaatacaaaaaattagccgggagtggtagcgggcatctgtagtcccagatacttgggaggctaaggcaggagagttacttgaacccaggaggtagaggttgcggtgagctgacatcacgccattgcgctccagcctgggcagtaagagtgaaactccatttaaaaacaaaacaaaacaaacaaaaaaacttctaaatcacattcaggaagcattttgtaatattttatttcttatcagggagcattttgtaatattttatttcttctcaacccctgtagtggattgaatggtgcctctattttacccccacccccaccaaaaaaaaaaaaaagacaagttcaccttgaatctgtacatgtgattttttatttggaaataaggtctttgcagatgtaaaaaaggatctggagatgagatcatcctggattgcagtggatcctaaatctaatgacaggtgtccttgtaagagacggaagaggagacacagacacagaggagaaggccacgtggagacggaggcagagactggagtgatgcggccataagcccagggatgcctggagcccccaggagctgggagaggcaggaagaattcttccctagagcagggagcatgtccctgtaggcacctcgatttcacagatgtagtctccaggactgggagaggttaaatggctgcttttgtaagctccctagtttggggtcatgggttacagtggtcccatcccaacctgtaagctctggagaacatgagtctggaatgcaagcgtgtgcggtgattcagcttgatgcctgtggtgggaaaagagccccttgtattatggcttcctgctgtgtgtaagtaaaaccagtcctctgaggaaatcaaagcccagtaaacccgtgcaccctaacttcccaggatcgcaaactggagagagagcggcagccattttctccccctgccttgatttgctgaacctgccacccgtgcagcatttcccaggaggctaacctggtgatattgtccattcttggtcctccgcaatgcaggcaatattcgttgctcagctcaaatgcttgcgtctcctctttcttctctccacctgcaaaacatcttttcataggtcccattgggaacaccagctcgttggctggtatttccacactctttttccttccttttgttgcttcatctacctctgatttgccagttgtctgatgtctcctctcacgagcctatctttctcccaagcctagtagacacgaaccattgaaagcatccttgaatgacaaaagtccaaatatcaatttgcaaggtgaagactgtggcttttattatttgttctcaatggcgggtgtctggcggggagtccagtcgcctgacgttgaatgcagtcatttcctaggtgtgggtcaagattctgatgtccacaggcaataatgtccgtgaacgtgtgtatgtaccttgatggacattactgactgtggactccagaacattggacattgtatatattgatggacatcatatatatatatacacacacacacacagacagacgcacacacacaccatggaatactacacagccacaaaaaagaatgaattaacagcatttgcagtgacctggatgagactggagactattactttttttattattatactttaagttctggggtacatgtgcaggacgtgcagtttttgttacataggtatacatgtgccatggtggtttgctgcacccctcaacccgtcatctacattagatacttgtcctaatactatcactcccctagccccccacccctcgacaggccccagtgtgtgatgttcccctccccgtgtccatgtgttcttattgttcagctcccacttatgagtgagaacatgtggtgtttggttttctgttcttgtgttagtttgctgagaagaatggtttccagctttattaaaagtcaggaaacaacagatgctagagaggatgtggagaaataggaatggttttacactgttggtgggagtgtaaattagttcaaccattgtggaagacagtgtggggattcctcaaggatctagaaccagaaataccatttgacccagtaatcacatgactgagtatatacccaaaggattataaatcattctactataaagacacatgcacacgtatgtttattgtggcactattcacatagcaaagacttggaaccaacccaaatgcccatcaatgatagaatgtataaagaaaatgtggcacatagacaccatggaatactatgcagccataaaaaaggacaagttcatgtcctttggagactattactctaagtgaagtaactcaggaatggaaaaccaaacatcgtctgttgtcactgatacgtggaagctaagctatgaggacacaaaggcatgagaatgatacaatggactttggggacttggggagagcttgggagggggcagcgagggataaaagactacaaatagtgtggaatgtgtactgcttgggtaatgggtgcaccaaaatctcacaaatcaccactaaagaacttactcgtgatcggatgtggtggctcacacctgtaatcccaacagtttgggaggctgaggcgagcggattaccttaagtcaggagttcaagaccagcctggccaacatggtgaaaccctgtctatactaaaaatacaaaaggaattagccaggcctggtggcacacacctgtaatcccagctgcttgggaggctgaggtaggagaattgcttgagcgtgggaggtggaggttgcagtgagccgagatcatgccactgcgctccagcctggctgacagagcgagactctgtctcagaaaaaaataaaaagaacttacttatataaccagatactgcctgtaacccaataagttatggaaaattaaagaaaaacacacaaaaagagtatattcaggatcacttaagtaagcatgatactacatcacatctcgttgcggaaattatatggattatcattccatgagtgtaccagcttccggaagtttctgagctcatatggggagtgggaagtaggtggtctcgtgggaactgcagggctggccccttgtcaggacggtcatcactagtgacataaataccccatggtagagagagctggggtgtcttcgtcggttttgtgtcactagaaaggaacactggaggctggataatttatagaggaaagaggtttatttgggttatgattctgcaggctgtacaagaagcacagggccagcatctgtctctgctgaggacctcaggaggcttccactcatggtggaacgggaaggggagctggtatgtgtacagagaccacacgaagagacaggagggaagacagacgggagacgccaggctctatttaacaaccagcctgtggagaactcatagagtaaaaactcactcatgcttcaagaaaggacattgatctcttcaggaagaatccatcgtccgttgctcaaacccctcccattcgacctcccatccagcactgaggcttacattttaacctgagtttgggagaggaggaattttaaagcagagcctgtagattctaaagcaaaatattctgggtctcctgcttgtagaatggttgtgagtgtgacttcctttttctatttttattttatttttttgaaacagagtctcgctctgttgcacaggctggagtgcaatggcactgtctcggctcgccgcaaccttcatctcccaggttcaagcgattctcctgcctcagcctcccaagtagctgggattacaggcgcgcaccaccatgcctggctaatttttgcatttttagtagagacggggtttcaccatgttgaccaggctggtcttgaactcctgacctcgggtgatctgctggcctcggcctcccaaaatgttgggattacaggcatgagccaccatgcctggcctgggattgttatttctaaatgattccagctttttttttttttttgtctcagctgaggcacagcggtggaacttgtcgtcttatcattgacttgttatgttcatgaaggacttggaaaaccaacgctgatcctcagagtaacagcatagatcctcacaagacagtctatgaagctggagccccctgggttgtaaaatgcctccgcaccccgtctctgtttctgaagaaggaagctctgctgagcagctaaacatgacgtgcttgttaagtgtgcattggttaaagaacagatgaaggtacaggctcagtctccaaaacttcattatacaatctcacagatgagtagcaccgttcagcattgagtgacacctactttcccgtctccaggtggttagatatcatcatctccaatttaaggcccatctaagaggtgcaccttttctcgatcctgaggctcaagtgtctaaacagcaactgtaaattttctccaatcagtgtttctcccctgtgtggaaataaattcgcatccttgaagttcagctctctccttcattttacaaaaaaacaaaaaacaaaaaaacttgttttaagcaagattaaaagtgaattttctattagcagtaattttatatcactccctgtcttgcttcttttgcactcactgaattgaagagaacgatatgaaattgcctggaaataaaaatgaaagtgcttctcagagccaaacaacactactcgtgtgaaagaatatagaatgaaagtttgaagtgtccatcagtcctgaacctgggatgatcctgtcctgatatccttaacgagaatgcatctaccaagaccctattcgcaaatcagttcacattcacggtgtttgggggttaggacttgggcatgtcattacgggaaatagctttgttggcttttctggttttacatagaaagagcaataaaggtcagccgcggtggctcacgcctgtaatcccagcactttgggaggccgaggtgggtggatcatgatgtcaggagttcaagaccagcctggccaacatggcgaaaccccatttctaatgcaagcagggcttaaaacctagatgacgggttgatgggtgcaggaaaccagcatggcacatgtatacctatgtaacaaacctgcatgttctgcatatgtatcttgcaacttaaagtaaaataaatctatctatctatatctatctatctatcttagggctgctgtaataaacgaccacacacttggaagtcttaaagccacaacaagtttattcttttccagtcctggagaccagaagtctgaaataacgatgtgggcagtactgtgcttcctctggaggctcacttgaacctgggaggcagaggttgcagtgagccaagatcatgcctttgcactccagcctgggcaacaacagcaaaactccgtctcaaaaaaaaaaaacaaaacaaaaaacaaaataccgtgaatatgttctctaaattaatctcacagcatgggagaaggtgaacaggataccccagtactgatgacaagtattatgggatggaaaagagaactggcattcttctttgctggcaacacaacctgtttttgttgatgtgaaggcagttaaccttgttgctagataaatgttactgcagatgtctgacgtaatgagaatgcgttatccacagcaaaatgcttttgaaaaagaaactgcagggaacttcacagtgagtgactaagactcactactgcagtctggcgtggtggctcacgcctgtaatcccagcattctgggagggtgaggcaggcggatcatgaggtcagtagatcgagaccatcctgggcaacagggtgaaaccccgtctctactaaaagtacaaaaaaactagctgggcatggtggcgggcgcctgtagtcccagctacttgggaggctgaggcaggagaatggcttgaaattgagaggcggaggttgcagtgagccgagatcacgccactgcactccctggtaccagagcaagactctgtctcaacgacaacaaaaaaacaaaaacaaaaacaaaagcatgatattaaagacactgtgctccatgactcagaagttgaaagagctactttgaatctgcaaatgatacctccatggatgtcgcctaagttcatgaaagatggaagcatagtgacagtaacaataatttaagaaggtttgaaaggaaaatcttggggtccccaaatcactaagctcaagggaaaagtcaagctgggaacttctcagagcaaacttgcctcccgttttattcaaagttactcctggccaggtgcggtggctcacgcctgtaatcccagcactttgggaggccagggcaggcagaacacgaggtaaagagatcaagaccatcctggcctatatgatgaagccccatctctactaaaaatattttaaaaactagctgggcatggtggcgggcacctgtagtcccggctactcgggaggctgaggcaggagaatggcttgaacctgggaggctgaggttgcagtgagccgaggtcgcgccactgcactccagcctggtgccagagcaatactctgtctaaacacacacacacacacaccccaaaaaaataatgaatgcaaccatttgtctcttatccacctatgacctggaagccccctccccacttcgagtcgtccccgtgtttctggatggaaccagtgtacctctcaacatatattgattgatgtctcatgtctgcctaaaatgtataaaaccagcgtgtgccctgaccaccttgggaacatgtcgtcaggaccacctgaggctgtgtcatgggtgcgtcctcaactgtggcaaaataaatttttctttttttttttttttgagatggagtcctactctgttgtccaggctggagtgcagtggtacgatctcggctcactgcaacctccacctccctggttccagcgattcccctgcctcagcctcctcaatagctgggattacaggtgcccgccaccatgtccagctaaagttttttttgcatttttagtagagacggagtttcaccatgttggccagacttgtcttgagctcctgacctcagacaatccgcccgcctcgacctcccaaagtgctgggattacaggcgtgagccaccacgcccggacttaactttctaaattaactgacaccatctcagatattcagggttcacaaaggcttggaggggcctgcaaatatatacaattatagaattaaatagtgatggatagagtcccttattcaaaaatactgttataaattaagttaaaatattaaagtcaaagaaacttcacacccataatcgcaatgctttcagaagatggaggattattttgagctcaggactttgagagcagcttgggcaacacagcaagatgccatttctacaaaaatttttcaaaaatagctgggcatggtggtgtgtacatgtggtcccagctactggggaggttgaggcgggaggatcacttgagcccaggagtttgaggctgcagtgagatgtgctcaaatcactgcactccagcctggctgagagaccaagaccttatctcttaaagaaagaaaataggcggctgggtccggtgactcacgcctgtaatcccagccagggcacgcgaatcacctgaggtcaggagttcgagaccagtctagcgaacatggtgaaactccgtctctactaaaaataccaatattagccaggcatggtggcaggtgcctagaattccagctacttgggaggctaaggcagggagaatcacttgaacctaggaggtggaggttgcagtgagccaagatcatgccattgcactccagcctgggtgacagagtaagactgtgtctcaaaaaaaaaaagcatacttttgagttaaaacaacagaattaccattcaacccagcaaccattcctgggtacatacctaaagaaataccaattattctaccgtaaagacacttttgcacatgaatgttcattgcagcattatttgcaatagcaaagacatgggaattaagctagatacccatcagtggtagactgggtaaagaaaatgtggtacatgtacgtcgtggaatactgtgcagctgtaaaaaagaacaagatcttattattttttgcaggaacatggatggagctggagatcattgtccttagcaaactaatacaagaacataaaagcaaatatcgcatgttctcacttataattggaagttcaacattgagtaaaggtggcctcaaagaaaggaacaacagacattggggtctgcttgagggtgaagggtgggaggagagggaggattaaaaagctgcctattggccgggcgcagtggctcacacctgtaatcccagcactttgggaggccgaggtgggcagatcacgaggtcaggagttcgagaccagcctggccaagatggtgaaaccctgtctctactaaaaatacaaaaattagccaggcagagtagcaggcatctgtaatcccagctactcgggaggctgaggcacaagaatcacttgaacccatgaggcggaggttgcagtgagccgggatcgcaccattgcactcaagcctgggcggcagagtggcactctgtctctactgcatatcagatattgtgctgattatgtgggtgacaaaataatctgtacaccaaactcccatgtcacgtaatttgcctgtgcaacaaacctgcacatggactcctcccgaatctaacatacaagtttaaaaaaatacatgtttgtacagctgcaccacgtgtgtatgtgttttaagctatgtgttatgatgactcaaaaacgttcaaaaaattaaaaggtgttaaagttataaaaaagaataaaatgcatcacacttttcaaatcatgaaatacctttttttacccatcgtgaatgtaaacattgacaccaatgggaagcttgagtattgtgtccattttacagggcaagaaaacaggggaatgggtaaatagcaaaacgagcaaagaaatgagtaggcaaaggcccatcacctatttctttgtggatgtctttgttgaactttttttcaacaaaatgaaaccaagccccctgattgttagttacctcacgcccatagtcttggccagtgagtcttttcgtaaaatggtactcaccgcagagtacattctgaatacacgttagacaacgatgaccaggaaaattcctgagtttttgatcgatcacattcctggccaaatcagatggatatttaagacctcagtgtgccctttgcaatcttgcaactcctgctttggttctctggaagaaatcttcttgtcgaagattcttactaaaactcaatgggttaaaatgcaaagatcttatttgttgcatagaatcaagactctgggtcaatacctggcagagtgactggaggctgcattggggtggactgtttttagacggcaggtcaggccccagagagaggtagttgggtgggaaacataagtcctatttctaatgcacagttgttgtgcctcctctggatatccaaatgtttggcacaatctgttttcctagaatcccagctgacatagagcagctaatgctcacatactgtcatccagccagtggctcatttagccaattaacacgctgatttcaaaagcattgtgaaaatatcactgcacacactaactagcttctgaccatcccttcccttcccttcctggcatatttctccagcgtaatctctgctcatagcctttcttacgagctacccacacccttgagcttcacaggacccattcagtctgtttgtgttttctccccgacctttcagcaatgtcaccatgatcttttcaagaatctttttctttgcttctcctgacaaatgcatcatccttctgagcaataaacagaggaattggcaaagttaataatgtcgttattgagcacttagtgaatggtgagcattatgctaagactgttttgtggtgtatccatacaccattccaacgatatatattttttaatttaagcatactttattggtaaacaatactaacaattatctgaacatttcgcgagtcaaaaccttattgctggtggagagtcttgcctcaatgttgctggctgtggactgatcagggtggtggttgctgagggtagagggtgctttggcaatttcttaaaatagacaacagtgatgtttgtcacatcagttgaccctttctgtcatgaaagatttttctgtatcaagcgatgctgtttgatagggttttacccagagtagaacttttttcaaaattcgagtcagggccgggcgtggtggctcacgcctgtaatcccagcactttgagaggccaaggcaggtggatcacctgaggtcaggagtttgagaccagtctgaccaacatggtgaaaccccatctctactaaaactacaaaaaaattagctgggcatggtggcgggcacctgtaatcccagctactcggcaggctgaggcaggagaatcgcttgaacctgggaggtggaggttgcagtgagccaagatcgcgctatggcactccagcctgggcaacaagagcaaaactccgtctcaaaaaaaaaaaaaaaaaaaaaaaaaaaaccaaaaaaccttcctgaaaggattcctcattctgaatgccatttagaaccttggtgattcatggcaggaagttaagatatccacattaacagaaatcgggaaaaagtgaattccaatattcatgaatgacattgagggggttcaagacttcagtggaggaagtcacttctgctatggtgaaaatagcagaagtaaaggtgcaggttgaagatggggctgaactcctgtaatctcatgataaaactggaatggaagaggagtttcttctcatgaaggagcagagaaaatggtttcttgagatagatactattcttgggcccatttcactgatgagaaaactgaggcctctccaggttgaagggtacaactaccaagtgtgggagtctgggctctaccccattactggacatctccagagcctgttctcccttctgctaagtttgcgggtcgctcaacattgtctccttggacgtgtgataagtcttcctgctcctccttcatcagtctttaacatttgagagacatttagagtggcctggaccaggctctttgctcattctcttttcttctactgaggcctctttcacaagtaggttttctcatctctctcttctttcatttattctctccttcattctctctttctcattctcttattctctctccctgtcttctttcctcttctcttccctcctcttcccctcctacttcttccttcccctccttctcctgcccctcatctcctcctacttctcctcctccttctccttcttctccttcatcttctttcgtttcttctccttccctttctctcctcctccttctccttctccctttccttcccttcccctctcttcccctccccttccctcccctcccctcccttcccttcccttttcttttctttttttttttctttcacggagtctcactctgttgccaggctggagtgccgtggcgcgatctcagctcactgcaacctctgcctccccggttcaagcgattcttctgcctcagcctcctgagtagctgggattacaggcatgcaccaccctgcccagctaatttttgtatttttagtagagatggggtttcaccatgttggccaggatgatctcagtctcctgacctcgtgatccacctgcctcagcctcccaaagtgctaggattacaggcatgagacaccgcacctggccccttctactttttttttcccttctccttcacctcctcttccccctcctcctgcttctcctcctcctctttcacctcctcctccttcctttctcctcctcctccttcctttctctctgtctctctctctctctctctctccctccctcccccccccccccccccccccgccgtctctctgcttctctctcattcactctcattgacgtccatatccaaatttttggaatcgcagtgctgccctcttagttctttgtcatgaaccatctgttgcccttggattgttttaccttttgtatccttggcagcttgacatacccatggtctaagcaagagtgttttctctgaaagtgcaggcatgagctgatacttgtgtgtttcatccattatcagcactgttttatgcatgtaaggagggtgtgtggcatttgcttcgtgggttgtaggaagggacacccaggaaacaaacaactaaagtgaagctttcctgcgggctaggatttgaaggtcatactaatgtccttcgagagagttaatgtcaagaattggtgtgaccaaacagtggtggatgtcatagtgttttcctcttttcataggttcacttttcaaatgagacagtagccatgagggaccatccatgcaggctgagactagtcttcaggaaaatatctatgcctagtagtttcagaaaggttagggttgcatagatgtacccacctgtccatcctgatccttactctaaattcgacctcttctatcattgctttcaccatcactgtcttgttggtgatgggcccagcttcgagaaactcagatctgcctcagtgctgctggagctggagagctggaagaaaaccaatatggcgtttgaaccgcacaatccaaaagtattgtagcagcactgattcataggttccttctcagtagaacctcttttgaattcctccaaacaaagccttctatttgagccatggcccttgagtagaccgatgtcatggactattagagtatgctattggtgctccagctacccatggccaaccaccaggcattacttaggtagagccccactgcctggcctatgcaccaggcatcaacatgaggtttcataaatacctgggagtacaagtgcagaatctctgttgaaagaatgcaatactctttttatttcttcaccgaataattaaataatttttatttcttcattaaagggcaattgaagagaagacaacatgtctctcttagtaggtaccatccccgagtagaactcatcctcctctgtgcaaagattcccattgttcagatcactctaatgctttgaggaaaacctccccacagtgtaacatacagaacactcttccgggggttatggcagatgctggagtctcttctaccaccacctaaagatgctggggtactctgcaacaccacctgaggaaaggaacaggatgaaacacctgttgtattagtcacctagggctgccatgacaaaatactacaggctgggccgcttaaacagcagacttttattttcccacagttctgaaggctggaagtctgtgagatcaaagtgtgggcagggctggttcttcctgaggcctctctgctgggcttgtagacaccgtcttctccctgtgtcctcatagggtcgcccctctgtgtgtgtctgtgtcctcatctcctcttatgaggtgtcttagtccatctcaggctgctatcacagaataccatagactgggtgacttataaacaacagacattgattctctcacagtcctggaggctggaagtctgagatccaggtatgggcagggctggttcctcctgaggcctctctcctgggcttggagacgccatcttctccctgtgtcctcacagggttgtcccaatgtgtgtgtctgtgtcctcatctccttttcttatgaggtgtcttagtccatttcaggctgctatcacagaataccatagactgggtggcttgtaaacaacagacgtttattctcccacaatcctggaggctgtaagtccaagatcaaggtgtaggcagggctggttcctcctgaggcctctcttgtaggcttgtagatgccatcttctcactgtgtcctcgcagggtcgtcactctgtgtgtctgtgtcctcatctcctcctctttttttttttgagacggagtctcgctctgtcgcccaggctggagtgcagtggcgggatctcggctcactgcaagctccacctcccaggttcaagcgattttcctgcctcagcctcccaagtagctggaactacaggtgcgtgccaccatgcctagctaattttttctatttttagtagagatggagtttcaccgtgttagccaggatggtctcgatcacctgacctcgtgatccacccacctcagcctcccaaagtactgggattacaggcgtgagccaccacacccggcctcatctcctcttcttataagcatcccagtcttctcggattaggggcctccctggtgactttgttttaccttaatcacctctttaaagactatctccaaatatggtgacattctgaggtcctgggcgttagggctttaacatagggatttgggagaaggaatcagcccatcacagctgtgcattctaagactccagtgactttgtgctgacaatggcttttccttgggtagctctaaccagatggtctggctgggtctatcttgagtctagtgactcccaccacgaggccaactgagcagggtggccaggaaagcctgtggccttacaacaaggtgatgctcacctgcagcacacaggccatcactgtagctctgctggctttattcttgggtttatagtgatggcttctttctgcctctgcctcccttgaggcatctcgtttctgtggttggagtactgtgagcctaagagacagagagcatgtccacagtcaggcttcccttacttgcttcagtagcatctcatgagtgtttccaatgcattcagggagactcttcttcactgaaggagtcagatccattttgcagctttgctgcttggaaccttgatggaatggctgagtacatggccgccagcgtcactcatgcacgaaaagtgttgttgaaagctaatagaaactgaaatctggtcgggcacggtggctcacgcctgtaatcccagcaccttgggaggctgaggcgggtggatcacctgaggtcaggagtgcgagaccagcctggccaacatggcgaaaccccatctctactaaaaatacgaaaaattagccgggcatggtggcaggcacctgtcatcccagctactcaggaggctgaggcaggagaatcgcttgaaccctggaggtggaggtttcagtgagccgagattgcgccattatactccagcttgggcaacaagagtgaaaatctgcctggaaagaaaaaaaaaaaaaagaaaaactgaaatagaagatttcccttcccccagttcactttgactgcgctaaagtaatttcctttgagggcagagaggacacggattgctttgggcatacttcaaaatgctactgtctccctaggaatattgcaaagtggttactttcccccaataacacacaactggatatttctttgatcttcaccctgggaacctggtggagctcccggaggtaaaatttgtgaaagtacaaggtcccctctaagatgggcccccagaagtttttctgttgttgttgttttttgagacagagtctcgctctgtcactcaggctggagtgcagtggtgcgatctgggctcactacaacctccacctcccagggtcaagcaattctcctgcctcagcctcccgagtagctgggattacaggtgcctgccaccacgcccggctaatttttgtatttttagtagagacggggtttcactatgttggccaggctggtctcgaactcctgacctcaggtgatctgcccgccttggcctcccaaagtgctgggattacaggtgcgagccaccatgcctggccaggagtttttaacttacttaggcttgtccactgtcagcctgcagctgtttaataattaccctgcaaatgtgtccatcaggtgctggctccagcaggaactcctagacaagcacaattccacttgccacctgtctgtccagtcttcaggcagcatttcgtcttgtgatctctattttctgatggatcgcagagttgctgattttcagtatgttctgctctttgcctattgtgaggataggaattaaaatgcgcaagctctctacatgttagtgaagtggctacgttgtctggggtatataccctggggttcgtcattgggcatcaggaaaatttaggacaaagacacacacgaggagtttaggagtggaagtttaatcaggagaagagaaagagaaatggttttctctatagagaaaggggtctccgagcggaaaggaccagctggcaccaaatgtgatggattttatagtccagtttgaggaggcggtgtctcatttacatagagctcagagattggttccatcaagcatggcatttacatagcccacaggaaaggctggttgcccaccctaatcgtttatgcaaatgggctttgtagttggtcggggctctccgagagattggttccatcaagcatgacatttacatagcccacaggaaaggctggttgcccaccctaatcggttatgcaaatgggctttgtagttggtcggggctctcggtcctgtttttcttactttacatgtggctgacaaagaggagggaagatggagccactgtcttgaacgtgtctagtctctagttcctgctgggaagatggagccgccgttttgaatgtgtctagtccctagttcctgccgggaagatggaaccgccatcttgaacgtgtctagtccctagttcctgccgggaagatggagccgccatcttgaacgtgtctagtccctagttcctgcccggaagatggagccgccatcttgaacgtgtctagtcgttagttcctcccgggaagatggagccgccatcttgaacgtgtctagtccctaggtcctcccgacattcacccgtacaagctcccagctggcttgtgtatgtctgcagctcgacttgacaggctgttcattgttagaaaatgacttggggctgcttttcgttaaagagaaaagctgccgggcgcagtggctcacacctgtcatcccagcacttttggaggctgaggcgggtggatcattaggtcaggggttcgagacgagcctgaccagtgaaaccgcgtctctactaaaaaaaaaaaaaacaaaacaaaaattagccgggcttggtggtgcgtacctataatgccagctacttaggaggctgaggcaggcgaattgcttgaacccgggaggcggaggttgcaatgagcgaacatcacgccactacactccagcctgggcgacagagcgggactccatctcaaaaaaaaaaaaaaaaagaaaagaaaaaagccttgccgaggactcccatacccttactgtctgcctaagtgatttcttcttaactcctgtatcactggcagactctgagttgcctgttgggtggagtactatattgccgagtatcatgactgtattagatgtgagggagacagtgtgaataggacatggtccctgaagagcacagagctttcacctggggctgggcggagcttctgtcctatccagtgttatggaacccttgcaagcacaggtcaagcagctcaagggctggaagacgtgcacacaaaatccaagggcaacgttggaaagaggtttagtgtttcttagaaaaatgccagaaggctgaagaagtgggggccccgagcagctctgaagggtgtgtatgcaattaaactgaagccaaaggctgagagagaggagtgagagccgcctacggagctctgtgcagcttcatcataaactcacagacaggcttcatgcagcgccgtctcagtgcattcaatgtttggattccacatgcatgcgtcctcaacccccttgcaatgctgttctccttggagggaaatgggtccttcttaccctatcacatgcaggtatctggtctaccagataaatgtgtgagaaatcaccaacaaagcagaaattacttttaattacaaagcagagtcatcgtaaaactttgtgcaaaatctttttttttttttttttccagacagggtctccatctgttacccaggctggagtgcagtggtgtgatcatggctcactgcaacttcaacttccgaggctcaggtgatcctcacatctcagcctcccaagtagctgggatgacaggtgtgcaccaccacacccagctaatttttactatctgcttaagtcatttcttcttaacccctgtatcattagaggagaaaccggaagcccctatttttgaaattagtaaccacctatcacctaaaattcctctcattactgtgacgataatgatgattttttcgagaccggatctcactctgtcacccaggctggagtgcagtggtgtgactgtggctcacgacagcttcagcctcccgggctcgagtgatcttcccaccacagtgtctaaagtagctggggctgtaggtacgcatcatcattcccagctatgtatatattttaaatattttgtagagatgggatcttcctctgttgctcaggctggtcttaaactcctggcctccagcagtcttctcacctgggcctcttaaagtgctgggattacaggcgtgtaccaccgtgtctggccaaaaaacatatctattctggggttcatagtgatgcttgtttctgccttggcctgtcttgaggcatctcactcctgtagttggagtactctgagtgtaacagatggagagtatgtccacacccactcttccctcacgtgtttctgtagcatcccgtaggagttttcaaatgcatttggagatgtattcaccctgtgacagattcaatgcatctctacaaggcagaatagctctaccatggtgtggctatggcgcttggctacctgagtctttattctgccttccaggtgcttgttggttggataactttgggtaggttcttgtacctctttgagcttcaagactgtcttagtcagctctggctgttgcaagaaaatacagttgaccttgatacaaaaattagctgggtgtggcgcctgtaatcccagatactcaggaggctgaggcaggagaatcgcttgaacctgggaggcggagattgcagggagccaagatcacaccattgcactccagcctgggcgacagagcaagattccatctcaaaaacaacaacaacaacaacaaaaaactagagttgacccttgaacaatgtgggagttaggggcgtcacacacgtccctggcacagttgaaaatccaaagataacttttgactcacccaaaacttatgaatatcctattgttgagcagaagccttatcaataccataaagtcgattaacatatattttgtatgttttatgtattgtatactgtattattaaagtatgctagagaaaagaaaatgctgtttgtttttttttagccgggcgtggtggcgcacgcctgtaatcccagctactcaggaggctgaggcaggagaatcgccttataaggaactttgagaatcaaaaatcataaggaactttcattcttttttttttttttttgagatggagtttcactctgttgccctggagtcaggctggagttcagtggtgtgatctctgctcagtacagcctacgcctcccacgttcaagtgattctcctgcctcagcctcccgagtagctggcactaaaggtgcacgccaccacgcccagctaatttttgtatttttagtagagacagggtttcaccacgttggtcaggctggtcttgaactcctgaccttaggtgacctacccgccttggcgtcccaaagtgtggagattacaggcttgagccaccacgcctgataaggaacttttattctaagtgaagtaactcagggatgaaaaaccaacatcgtatgttctcagtgttacgtgggagctaagctatgaggacacaaaggcataagaatgataaaatggaatttggggtcttgggggggaagagtgggaggggggtgagggataaacactacaaatagggtgcagtatatactgttcgggtgatgggtgtaccaaaatctcacagatcaccactaaagaacttaggtaaccaaataccaccagtaccccaatcacttatggaaagataattaaaaacaaaaaaggacaccaaactaaatttttaaaaatcatagagaagagaaaatatatttactatttctgaagtgggagtggatcgtcatgaaggtcttcatccttatcgtcttcaccttgagtagcctaagatgagagcggacaggagggattggtcttgctggctccggggtggcagaggtagaagaaaatgcccgtagaagtggacccgtgcaattcaaacctgtgttgtttaagggttaactggaccatagatggggtggcataaataacagaaatttatttctctatagtactggaggcagaaatgtttacatccaggtggcaccatggttgggtacttgagaggttcctcttcttggtttacagatggtctcgcagggcagagagagaggggggtggagcacgagggagcatgtgtgccctggtgtctcttcttacaagggcacgaatcccaacataaggatcccaccttcacgacctgatgtaaacatcatcatctcccaaaggctccgtctccaaataccatcccctttggcattagggtttccacacatgagattcggggtgacaccattcattccatagcaggagccctccttggcagactgggacaccaacgcctcttccctcttgggctgacacgagctgtaaatgtcagtggacatttaaatactgcgttacacattcgatgtcctgtctgcaatggagccgggttctgtaaacataagctgccatggcgaaatcggatcatcatcgcccatcaagctctttggcagcagtgctgtaatcagtgcaaacatttatttatataaatgctcccatcccctcggcatgaagatatacttaggctctctcaatggacagccacgccacaagcccaggaatgagagcttgtcagatactgaggctgttttcagagccagtgttcggctgaagtggcacagaagctatcattgtttgcaaatctctgctgcttgtcaagccacagggttaagtaaccccggatgttgcgaacactctgaagtgctgacctgcagtgtctttttggatcactgagccctcaggcagacaggctgtacgtggaccgacacgtcatggctgctgtcttgcacttaaccctctttatctttagaccttgattgtgcacctgtttctcattggaagctaatgacaatccacgaagcggcttggcagtgactgtctctgattgtgtaaggaggggttgccacattcacccatgttgttgactttcaactgtacacttgaaaacgtcaaaagtcagagtaagcattgcctcatgtctccgagtgtagcaattctaggaaaactcttccgaatgggtttaaagtcaaacaaatccaatcaaaacagacttgcagggccaggcacggtggctcatgcctgcaatcccagcactttgggaagccaaggtgggcagatcacttgaggtcaggagttggagaccaacctggccaacatggcgaaaccccgcctccactaaaaatacaaaaagttagccaggtgtagtggtgcgtgtctgtaatcccagctactcaggaggattagggaggagaatctcttgaacctgggaggtggaggttgcagtgagctgagatcaccccactgcagtccagcctgggtgacagagcaagatcccatctcaaaaaaaaaaaaaagaaaagaaaagtccacatagggaaatatgtgaagctctttgggtcatatgatcgctaccacaacagcgcaatatgtaaatgaatgggcaagttctgtgttctaagaatcttgagggacactgagatgtaaatgtatatatttatcacgtggcacaaaatacagttgacccggccgggcacagtggctcacaactgtcatcccagcactttgggaggccgaggcgggtggatcacctgaggtcgggagttcaagaccagcctgaccaacatggtgaaacccgtctctactaaaaatacaaaaaattagctgggaatggtggtgcgtgcctgtaatcccagctactcatgacgctgaggcaggagaatcgcttgaattcgggaggtggagattgcagtgagctgagatcacgccatcgcactccagcctgggcaacaagagggaaactccacctcgaaaaaatatgtatatacagctgacccttgaacaacacgggggttaggggtactgacctctatgcagttgaaaatctatgtataggttctgactcccccaaaagttaaatactggtagtgtactcttgaccggaagctttattcataacatagagtcgattagtacatagtttgtatgttatgtatattataaagtcagctagaaaaaaaatgctaaggaagagaagagaaaatattttactacttactaaatggaagtagatcatcataaaggtcttcgttctcttttttttttttttttttgagatggagtctcactctgtcaccgaggctggagtgcagtggcacgatctcggctcactgcaacctccgtctcctgggttcaagcacttcttctgcctcagcctcccaagtaactgggattacaggcacacgccaccacacctggctaatttttgtatttttagtagagacggggtttcaccatattggccaggctggtcttcaactcctgacctcgtgatctacccgcctcggcctcccaaactgctgggattataggcgtgagtcactgcactctgcaggagtagggagaggagggggaggggaggaggagaagggagggggggaggaggggggacgaagagggaggaggagtcatctcgggtgaaagtccaaatgggtgaatctgctcagttcagatgtatgttgtccaacagtcaactgtgttatccttcttttgattttttttaacccactgtttaaaagatgtggaaatagttttttggtttacaaggtgcacaaaaataggcaaggggctggattttgctagagggctgcagttgaccaaccccgggttagaccattaccattgtcagtgggcacacaaagtaatgaaattattatagaaaacatgaggcgttgtttactggaaaggggtcttgatcctgaccccaagagagggttcttggatcttgtgcaagaaagaatttggggtgagtccatagagtaaagtgaaagcaagttgattaagaaagtaaaggaataaagagtggccactccattggcagagcagcaccgagggctgccagttggtgatttttatggttatttcttgattctgtgcgaaacaagggaaagattattcgtgagttttctgggaagccggtgggcggttctgggaactgagggttcctcccctttttagaccctatagggtaacttcctgacattgccatgacatctgtaaactgccatgaggctgatggaagtgtcttttagcagcgaatgcattagagttagcgtataatgaacagtgaggaagaccagaggtcagtctcgtcgccatcttggtttgcatggggtttggccagcttctttaccacaacctgttttatcaacaaggtccttaggacctgtatcttaatgccgacctcctctcatgccagtggtcatgtgcattcatctggctggaagggtatctttttttttttttgagattgggttgtcactgtgttgcccaggctggagtgcagtggcacagccttgaccttctcagctcaagtgatcctcccacctcagcctcccaagtagctgggactacaggcatgcaccaccatcaccacacccagctgcttttttttttttttttttctgtatttttggtagacacgaggtttcaccatgttgcccaggctggtctcgaactgctaggctcaagcaatcctcctgcctcagcctcccaaagctctggtattacaggcatgagccactgcacctggccttcaggactatcttcagacacttgttgtagcctcttcatttctgcacatccctccccagcggagatgctctcacaaattgctcataaggaaatttcttgtgggctccaaaatctttcccctaaaacagagttctgttgaatttctccctgacaatgtaaattaacaacttgtcttcacaagtgtgggacaaagataagactagaaatgatctctccgcccaccctgagacaaatgcatgtttgacatcttcctcttctgtatgttgactttgtcttatgcaaaagtggatttactgtgcatgaaatgaacgcgtgattgactgttcctctacccgcactttgccatgtaaaatgtgtattcagagagtgccaatcaaagactcacaagaatgtaatcatttgcctcttttatctactctccttcttttttttttctttcctctttccctcctgcctgcttttttccctttctataccaaagccctcaaaaccatccttggaaaaagcacagggccgcacgcagtggctcacgcctgtaatcccagcactttgggaggccgaggcaggtggatcacctgaggtcaggagttcaagaccagcctgccaacatggcaaaaccccgtctgtactgaaaaataaaaaaaatagcagggcgtggcgttgcatgcctgtaatcccagctacttgggacagtgaggcagaagaatcatctgagcccgggaggtggaggctgcagtgagctgagactgcgccactgcactctagcctgggccacacagcaagactctgtctcaaaaaaaaaaaaagccaggcgcggtggctcacgcctgtaatcccagcactttgggaagccgaggcgggtggatcacctgaggtcaggagtttgagaccagcctgacaaacgtggtgaaagcccatctctagtaaaaatacaaaaattagccgggcgtggtgacgtgcacttgtaatcccagctactcaggaagctgaggcaggagaatcacttgaacccgggaggcgaagggtgcagtgagccgagatggcgccattgcactccagcctgggcgacagagggagactccgtctcaaaaagaaaagaaaaagcacggagcacaggtcctatggtgactggcgtctgtttttcctggactggggcacattctcaaccgtggcaaaattaacctctaaactaatggaggcttgcctcactcatcttctttgattcaaaactttgagttaatccatttatgcctgaagttgcaagtttttgaatttttgccatcagatcttggcgatgaccttgagcagtaggatataaataactccacatgcttagcattccaataatggaacactaggcatacgtgggtttaatcaaaggagagatcatctgtgctggacctgcctcaaagagggtgagatgaatgagtaattcttcttcttcaaataaacttgagatggtctcagagatccttttcctggtttttgttgttattattgttgttgtttttgaggcagagtcttgctctatcacccaggctggagtgcagtggtgcaatctcggctcactgcaacctccacctcccaggttcaagcgattctcctgccccagcctcccaagtagctgggattacaggcgcccactaccatgcctggctaatttttgtatttttcgtagagacagggtttcacccttttggccaggctggtctcgaactcctgagctcaggtgatcttccccacctcagcctatcacagtgctggaattacaggcgtgagccaccgcagccggccctttttgctggttttgaagaagcagactcccatatgacaagttgctgagggtgtcacagcaagcagagagccaccattgtctgacagccaaaatgaaaatgagacttggccgggcgcggtggctcacgcctgttatcccagcacttttggaggccaaggccggtggatcacctgagatcaggagtttgagaccactctttccaacaaggagaaaacccgtctctactaaaaagacaaaaattagctgggtgtggtggcaggcacctgtaatcccagctactggggaggctgaggcaagagaatcacttgatcttgggaggcggaggttgcagtgagctgagatcgcgaaactgcactccagcctaggcaacagagtgagactctgtctcaaagaaaagagagaaaatgtgactcaatctcacaaccacaagaagctgaattttgcctcccaattcagcatgcctggaagagcatcctaagctacagatgtcatctcagctttgtctgacaccttaattccagccttgtgagactctaaatggagacatcctgttaatctaaacccaatcttctgacttacagaactgtgagatcataaaggggtgttgttttttaaactactacgtttggggcgttttgttacgcagcagagctagctaagatggatggctccttaagcagctcatttgagggcagagggaggcaacttctgcagacagatgggcatctatattcgctaggttcaagctgttaatgctgctatgtatacccaaatgacctcactaccttctcaccaggcagcaagaaacaggatcctcagacgaacagaagtccaacaccttagtctaagtctgtttatgttctcctgataggaaatcttttcatctcataaaaagctgctgatgtaggcctttctcaccctgtaccccacgttactgatgcctgttttgttgccaaactggactggtgtccacttgcctggtgcacttaggtcaaacctccacaatgaggctttgcagcaagagaaaggatagtgtttatttggacagcaccaagccaggagactcaggcagctcacgcttaagacctaacgttttttttttttttattgaaacggagtttcactcttgctgcccaggctggagtgctatggcgtgatctcagctcaccgcaacctccacctcccgggttcaggcaattctcctgcctcagcctgctgagtggctgggattacaggcatgcgccaccacgcctggctagttttgtacttttagtagagacagcatttctccatgttggtcaggctggtctcttaactcccgacctcaggtgattccctcgctttggcatcccaaggtgctgagattgcaggcgtgagccaccgcacctggcctaagacccaatcttttcaatgacttccgagccatagtgtttcaagtcgggtaaatttcaggacagaagctgctccaggcaaaatcatgaggacgaagttctgatttttttatcttgcccaaattcctatctaaagggtctagggagtcattctttacaaaccatgagttctcattagatgggttttatttaaccctatatatcgtaacttactttccaatgtgactctggcataacataatgagacaaggaaaaacaatgtatttaaccccaaaatatatttccttgccataccttgaaattgccctgagaagtctcttgtgggaaaaatccacattctatagagaatagcctttcctccctccctcccttacctcctttacctcccttccttccttccttccttctccccttccttcctcccttctccccttccttcctcccttctccccttccttccttccctcccttctttcccttccttccttccctccattcctttccctctctcccttctttccctccctccctcctttccctccctccctccttccctccctgcctccctccttccctccctcattccctccttccctccctcattccctccttcattccctccttccctcccttccttccctccctcccttccttccctccttccctccctctcttccttccctccttccctccttccttccgtccctccctttgttcctttgttccttcccagatctgggacataatcaactgagagccaggcccccttttaggtctgataagaaacattttacaacctgttctctctgaagtctgctatctgagagcttcctgtgcaaaataaaacttggttcccacaatcctttatctccacctggacatttcctttctgttgattccaggtcttcagataaactcaaccagttgtcaaccagaaaatatttaaacttacctatagcctggcagcccccaggttgagttgtcccacctttctgaaccaaaccaatgtatttctgaaatgtatttgattgatgtctcatgccttcctaaaatatataaaatcaagctgcaccccgaccacctggggtacatgttctcgggatctcctgagggctgtgtcacgggccgtggtcactcatatttcgctcagaataaatctcttcaaatattttacagagtttgactcttttcatcaacaattataaatcacggctgggcgtcgtggctcatgcctgtaattctagcactttgggaggccgaggtgggcagatcacgaggtcatgagatcgagaccatcctggccaacatggtgaaaccctgtctctactaaaaatacaaaaattagctgggcatggtggcgcttgcctgtagtcccagctatttgggaggctgaggcaggagaatcgcttgaacctgggaggcggaggttgcagtgagccgagatggcaccactgcactccagcctgggcgacagagcgagactacatctcaaaaataataagtaaaaaaaaaatcataaatcaatacatggaagctatacgttggtttggcctaaaaagggatatcttgggccaggtacggtggctcatgcctgtaatcccagcacatttgtaggctgaggcaggcagatcacctgaggtctactagtagttcaagaccagcctggccaacatggtgaaaccccgtcttgactaaaaatacaaaaaattacccaggtgtggtggcaagtgcctgtaattccagctacttgggaggctgaggcaagagaatcgcttgaacctgggaggcagaggttgcagcgagccaagatcatgccactgcactccagcctgggcaacaagagcgaaactccatctcaaaaaaaaaaaaatatatatcttgaagctgggcccgagggtggggttgcttacaggaacaaggtggattcaaagacttttggacttgcaattggttaaggaagtggagctttgtctaagacttgcggtcagcagtaaaagcacattggatctggcccatgggcaggacctcctccaggaccctcaggaagaaatttaaaacaaggaacagggatcagagttcagtccctagctctcccacgtctgaggtcttcatgccagaggattccatagggtagaggtgtgagtttcttttattttttttaattatactttaacttctggggtacatgtgcagaatatgcaggtttgttactaggtatacacgtgccatggtagtttgctgccatccatcatctacattaggtatttgtcctaatgctctccctcccctagtcccccagtccccgaaagacccctgtgtgtgatgttcccctccctgtgtccatgtgttctcattgttcaactcccccttatgagtgaaaacatgcagtgtttggttttctgttcctgtgatagtttcctgagaatgatggtttccagcttcatccatgtccctgcaaaggacatgaactcatccttttttatggctgcatagtattccatggtgtctacgtgccacattttctttattagttgctctagggaagcgaacatccctgactctaatttccttggttgttattttaagctactgtgactttcttcttcatcaagttgctcattaacttctcccagccagcgaagtgcctggagtttccttcctggaaggaactcaagatttctcttgatttccatgcttggtcgggggtggagagagtttcctggtttgcccctaagaggggtccctgccaggtctcagttcctcaagctttctctttagcacctttagcagacagatactatcacagcttacagtgcttgcagcatgggtggtggcgtggggattttgatgccgttggattttccccactttttccattttgtgcccagaagcattactcttgaagcatttaaatttgaacacagtgggaaacagcttcttaggaattaagttttaactggtttccagtgtatctaaacagcagacaggtagacccttggtaacttctttttgatgtataaacaactcagaccattaaatcgacgctcattagcaacctatgctgctcatccaagctaccctgaagtttacttttagcccagtcctgtgggtggataatggtttcaacgcattcccaggaggacgatttacctccttggagacagaattgttcttgaaagctcttcacaagtccgcgtttccacggcaacatcaagattgacttctcgcccttgggtagtgccttgtcttcgaaagcctttctttcctctttacttacacaagctctttggggcatctgctctttgcctcgcgggtgggtcaatggtgctttcattttaatcttcttttctagactagacctgggagtcagaggacaactttaattatctgaacactttaccattctgacaacaatatttacagagtttatcctgaaggtggtttctgaggacagctgtgtatccgaggagcattgttttaacttgagttctctcgtagtgatgtatctcaagtgctcaagagggagaggagggccatcgtagtaaacacaatgaaaacaaaggcgtcacccacttatttatcccaccatgccaggcagctctctccccatctctctctttctctctctgtatgtctctctctctttctctccctctctgtgtcacaacctctgtctctctcattctattcctctctgtccctctctgtcactttctctgtgtctctcctctttctctctctctgtctctcgcttattctctctgtctctcagtttctgtgtctctctccttctgtctctctttttttttttttttgacacagagtgttgttcttctcattcagtctggggtgcaatggagtgatctcggctcactacaacctccgcctcccggattcaagcgattctcctgcctcagcctcccgagtagctgggattacaggtgcccgccaccacgctcagctagtttttatatttttagtagagacggggtttcaccatgttggccaggctggtctcgaactcctgacatcaggcgatccacccgcctcggcctcccaaactattgggattacaggtgtgagcctgtatctgtctctctgtgtctctctggcacactctctgtctctttcaagctctctttctgtgcttctatttctgtgtcacaatctttctctctgtctctttcctccctctgtctctctctttctctcccattctcaccctctctttctccataactttctctgtgttttgttcttttttcttcctctctcttgcttattttctctctctctccctctctctctctctctcacacacacacacacacatatacacacacacacagaataatctcgctgcagcgtctttcacagtaggtcttaggggcagatggatagctgcctcatacaaagaaaataggatttcaggtctccagagaggcgctccatacctgcataacgactaagagatactggtatttcacctttatttttaaattgataaatatatagaaatgagagacgcagggggtgacaaccaatctgccctccttcttggcaaattccggcagttcgggcacctgggttccttccctcctgaatgaagagaggccagaagccatcatgagcttcgtccctgctcaagactttgcaggctgtggtcgcatcagctcttggctccaagaactgggctttttgggtagcaggacggctgttgctacccacaagtgcgggaagaactgtcctctggctgcctggatcccggaggttctggcttaccaagacactcgtgaatttattaggatgcgtagggacggggcaggtgcagacggattcaggggctgtgttggctgttggtagatgcttgaaagctgttgctgctctgagctgaacgccttctccacaagcgctgcctcctggtctaaatgatgggtttttattttatattattttgagacagggtcttgctctgttttctaagctggagtgcagaggtgcagaggcataatcatagctcactgcagcctcaacctcctatgctcaagcagtcctgccacctcagcctcccacgtagctgggattgcagacatgcaccaccacactcagataattttttatgacttccttttgtagaggtagggtcttgctatgttgcccaggctgctcttgaactggcctcaagcaatcctcccacctcggcctctcaaaatgctacagtgacagggtgagccaccacacctggccatgatgattttcaaattagcccagttgggttacaaggttgactaagatctgattttcaggtagtggttatggacacacttatcacatttattctaggagctctttaataatatttcagaatggacagcatttctggaaatttttttcttagtattaaatacatttgcttttgtatgtctcagtggaagacttctttaagtttacatttttatgatttttttcttctgtatatataaatgttactcatcaagcaattcctgccctcctagcaaatttcttctgctatgcttttttcagaatttctatcagaacagcataaatttcacaaaacaaaccacctcagactctttttgtccaaccagtcagtatcagggcacttatctgttctttgaaagtctagaagaattttctaaaataccctctgcactcatctaccctttcttcatgccattctttcattattcttctctatttttcttatagctattggtctgattagacctaatttccttgattgaattgggataattagtatctctgagaaaattatttcctcgagattttcacattttacttacaaatgtaacatattatcaggatactaagaaacagaaacctatcattttaaagcttttttcatacagtacagtgtttcctatttgtaagtttgcatttcctgcctcattaaatatattattgacagtattttctgggaccttgtttctccttcttccttccttccccgtttccacccatcctttcctccttccctttcttccctcctttctccctccctccctttctttcttccctccttccattcattcttgcttccctcccctcccctccccttccctctttccacccatcctttcctccttcccccacaatgttgattttgttcatttctccctgcctacctaggaattcttgaaaaatatacttggatattgtgttattctgaagaaaatgctgtgaaaatggcacattatagcttcatctcaattcagcatttggtttatgattttcaagttagccctgttgggttacaaggttggttacacagatccaaaccatgccttcataggcgatgatcctccttgttccattaacgttttagacttcaatcattgctgtcttgtgtgactagggccatttctacttggtttttgcttgtttggctgataaatgtgaacgttttaacaattgttgaacaattgttaaaacaattgtcgaacaattgtcgaacagttgttttaacaattgtaattcctcctttttaatactctgtatctttaccatcaagatacagacatcacctttttcacaggctctgagtgtaggaggccaccattttggctttatatcatgaccagtaactgggagcgccctcgttggctgaagctgtacttcctgcttcttttctgttcttgccacatggataactggtatactccatcttattccatgagctacgtggcagacactcattttgtagctcctaggagtgcgttaaatactcccaaacactctaactttcatttctctaaattatctaaatagaatgaaggtatcgttgaaggtactccaggtggaatgaaaaaacctatctcaagtcttccggagatcctcctgtgttcggttccctggtccctctcatggtgccctgggaaagggacgcagctcctacatgggttaggttccaggtgaacgcagccactgagctcctagcaagtacgatttcctgtgtcctatgcgcagatcaccctggtgtcttggtccagtgggcttgaagcctcatactcttttgtttttccttgttttttattttattttttttatttttattacttttttttttttttgagagggagtcttgctctgtcgcccaggctggagtgcagtggcacaatctcggctcactgcaagctccgcctcccaggttcatgccattctcctgcctcagcctcctgagtagctgggactacaggcgcccgccaccacgcctggctaattttttgtagttttagtagagacagggtttcaccatgttagccaggatggtctcgatctcctgacccctcgtgatccacccgcctcggcctcccaaagtgctgggattacaggcgtgagccacccaccccccggccttgtttgttttcttttaaaaaaaatttcatgaggtacacgtgcagctttgttgtaagatacattgtgtagtgctgcggttcacgcttcagttgaacctgtcactcaaacggtgaacaaaatacctcataggtagagttttagcctttacacccctctccctcccctgctcttggaatgcgcaggtgtgccagcttcccatttttatgcctgattattcaatgtttagctcctatgtataattgagaacaagtggtatttaattttccgtttctgtgttaattcacttaggataatggcctccagctgcatctgtgttgctgctaaaaacatgatttcattcttttttatggctctatactattctacggtatatatgcagcaactacattttcttcatccaacacataattgatggacacctgggctgattccctcatgcctcccaagattgaatcaggaagaaatcagatccagaacagactcatttcatgacaagttatgaaattgaatcagtaatttacaaaaacctatcaatcaaaaaaaaaaaaaaaagccccaagaccagacaaattcacagctgaattcgaccagatgtacaaagaagagctggttccaatctgactgaaacgattctaaaaaattgaggcggagggattcctccctaacttattctacaaaacctgtatcatcttgataccaaaatctgacaaggacacgacaaaaatagaaaactacaggccaatatcccagatgaagatagacgcacaaatgctcaaccacatactagcaaacagaatccagcagtgcgtcaaaaagatgactgatcatcgaaaccttgtctctactacaaatacaaaaattagccaggcgtggtggtgcgcgtctgtaatcccagctacttgggaggctgaatcgcttgaacctggcgggtggaggttgcagtgagccaagatcgcaccactgcgctccagcctgggcaacagagcaagactctgcctcaaaaaaaaaaaaaaaagataattgatcgcaatcttaattgtgggcttcattcctgctctgctctttgtccaaagagatttttctgaatgtcaggggtgaagttcaagttctagcacccagtgagcattctgccttcccctgctgcagggcttgatgtatcggctcatcttcccctagtgatgccagccataccctgttccccttacccttcctaccagtgtttctcttggtgcgaggtagctcctgaatggatgcaaaaaaaaaaagatgctgattgcaagaatgagcaaagcccgttggttgcctgtattactccgttctcacactgctctgaagaaatacctgagactgggtaatttttaaaaattttaagttccgggtacatatgcaggattgtacatagataaacatgtgccgtggtggtttgctgcacctatcaacccatcacttaagtattaaagcccagcatgagttagctattctttttattattgtactttaagttctggggtacatgtgcagaacatgcaggtttgttatataggtatagacgtgccatggtggtttgctgcacccatcaactcgttatctacattaggtatttcttttaaagctatctctccccttgccccccaccccccaacaggccccagtgtgtgatgttcccctccctgtgtccctgtgttctcattgctcaactcccacttaagagtgagaacatgtggtgtttagttttctgttcttgtgttagtttgctgagaatgatggtttccagattcatccgtgtccctgcaaagcacatgaactcatcctttttaatgtctgcatagtagtccatggtgtctatgtgccacattttctttattcagtctatcaatgacgggcatttgcgttggttccaagtctttaatattgtgaacagtgctgcagtaaacacacatgtgcatgtgtctttatagtaggatgatttataatcctttgggtatatacccagtcatgggattgctgggtcaaatggtatttctggttctagatccttgaggaatcgccacagtgtcttccacaatggttgaactaacttccactctcaccaacagtgtaaaagcattcctgtttctccacatcctctccagcatctgttgtttcctgattttttaatgatcgcccttctaactgatgtgaggtggtatctcattgtggttttgatttgtacttcactactgagcaggcattagctatttttcctgatgctctccccctccctgacccccacccacaacacgccccagtgtgtgttgttcccctccctgtatccatgtgttctcattgttaagcacccacttatgagtgagagtgtacagtgtttggttttctgttcctgcattagtttgccaagaataatggcttctagctccatccatgtccctgcaaaggacatgatctcgttcctttttatggctgcatagtattccacggtgtatatgtaccattttttttaatccagtctatcattcttgggcatttgagttgattccacatccttgctattgtgaatagtgctgcaatgaacatatgtgtgcctgtatctttataatagaatgatttctatttatttggatatatacctagtaatgggattgctgggtcaaatggtgtttctggttctaggtctttgaggaattgctacactgagactgggtaatttataaagaaaagaagtttaattggctcatggatctgcaggctgtacgggaagcagagcagcttctgcttctagggaggcatgaggaaatgcataatcatagtggaaagtgaaggaaagcaggtgtcttacatggccctagcaagagaaggagagacagaggtgcagttggggtgggctggggagatgctacacacttttcaacaaccagatgccacgagaactcattcactattgcaagcacagcacccaggggatggcactaaactattcctgagacatccacccccgtgacccaatctccccctacaagggtccacctccagcactggggattccaattcaacttgagatttgaatgaggacacagatccaaaccatatcactacccatctatcaattcatccatccatctatccatccatccatccatccatcagttcatccatccatccatccatccattcatccatccatccatccacccacccacccacccatccatccacccacccacccatccatccatccatttatccatccatccatccatccatccatccatccatccatttatccatccatccatccatccatccatccatcagttcatccatccatccatccatccatccattcatccatccatccatttatccatccatccatctatccatccatcaatccacccacccacccatccatccatccacccatccatccatccatccatccatccatccatccatccatcagttcatccatccgtccatccatcaattcatccatccatccactcacccatcctctcatgtatccatccatcaatccatcgatccacccacccacccatccatccatccatccatccatccatttatccatccatccatccatccacccatccacccatccacccatccacccatccatccatccatccatccacccacccatccacccacccatccacccacccacccacccatccatccatccatccatttatccatccatctatccaatccatccatccatccacctatccatccatctacccatccttccacccatccatcaattcatccgtccatccgtccatgcatgcatccatctgtattagtctgttcttgcattgctataaagaagtacctgagattggatgatttataaagaaaagaggtttaattggctcatggttctgcaagctgtacaggaagcagagcagcttctgcttctggggaggcctcaggcaacttacaatcatgatggaaggtgaagtggaagccagcacgtcttaatggctagagcaggagcaagagtggaggggaggtgctgtgcacttttaaacaaccagatcttgtgggaactcattcatggtcacaagaacatcaccaaggggatggcgctaacccattcgtgagaaatccacctccatgatcccatcacctctccccaggccactcctccaacactgcggattacaattcaacatgagatttgggtggggacacagatctaaactatatcaccacctcgcaagccagtgatctcaatagaatgctgatgttcatgttgctagtggctataagccttttttctcaaggagcaagaaaaatgcatcttctagtttttttaaaaaaaatccattcacactgctgtttttggaagctcagcttgtgcttttacccatcctttgatcactggttccaattattagcagtagtatgggttttcctctttcttacatccccacaagtgtttttgtggaaaattacagcagtacctcaggagtttctatccagatgacactgtgctcagaatcagcgcttttaaactctccatggcaaaactgcctctcccctaatctgcagcagattgataactgccgtagatacaataaaaatgaattactaaaaaaaatgcatttaagaaacatggaaactagaagctctcagtgtgttttttttaagtcattggattgaacaaagcttaaatgactgtcattattttttaagtttctaaacatttactttcaatttctgaacatgtctcaccacagacagcttgcagtaacagttcacagagtggcagccgtctgattcaggagtgtgtgtaccatcataccatccaatatattactttatttatttatttatttattttttgagacagtctggctctgtcacccaggctggagtgcagtggtgcgatctcagctcactgcaacctccacctcccgggtttaagcaattctcctgcctcagccatccaagtagctgggatttcaggtgcctgaccccatgcccggctagtttttgtatttttagtagagatgcagtttcaccgtgttggccaggctggtcttgagctcctgacctcaagcgatccgcccgctttggcctcccaaagtgctgggataacaggtgtgagccactgcacctgcccacccaactgtatttctctaaggaaaatattgaaagtacttatttccttttccttgatggcctggtgacttggtacagatgggcttcattctccatgatgaggaagctgttatattatcttaaaacatgccttccaagagaaggttaaagtatatatttcagatcacaaggtcaggagcacttttggctgccacgtttggctgactcttggatgttgtgttatttaaagtgtcctagatcagccacaataaaacaaaacctaatcactgtgtctcaacctcaggtgtgtgctgcaggaagcgccagttcttgtgatatcggagccatgtccacctctgttctggggacccgggaccccacgggttggtctgagtatgtcatcaagagctagatgaggccgggtgaggtgcttcacacctgtaatcccagcactttgggaggccgaggcgggcagatcacaaggtccggagttcaagaacagcctgggcaacatggtgaaaccctgtctctactaaaacacaaaaattagccaggcgtggtggcgggtgcctgtagtcccagctactcaggaggctgaggcaggagaattggttgaatccaggaggtggaggttgcagtgagccgagatcgcaccaccgcacttcagcctgagctacagggtgaaactccatctcaaacaacaacaacaaagaactaggtgaaaagacctggcgtgctcctgcagcgcaaccagccgtgatcatacaaagaccagaatgctgcaggatggcatgtcatggcccatccctctcatctctgctccacgcagcaataagaccaaagctaacctgcttccagagacacctcgtggaaatgtgcaaggctcagcaaagaaaggctaatatctaatgattcatgtatttacacagctttttttttgagatggagtctggcactgtcaccaggctggagtgcagtggcatggtctcggctcactgcaacctccgcctcccaggttcaagcgattcccctgcctcagtctcccaagtagctgggattacaggcaatgcaccaccatgcccagctaagttttatatttttagtagagacagggttttgccatgttggccaggctggtctcgaattcctgaactcaggtgatcgcccgcctcagcctcccaaagtcctgggattacaggcgtaagccactgcgcccggcctgcttttttatttcttactagcacgagaacttagagtgatacaaatcttctgaatattttggctgcattctgcagacggtgacaccttctgtttccgtggatattatttataaaacatttttgtcacctgctatgaattgttaccctgtccacatgctttaaaagggcagtttttgaaatcaacatgagtttgggcactgggaaattgcatacttaataaaattaaacattaaaaaggggctctttctgctttcctatcaactcaggcagcagggtgatagatatagggggtgagggatgcaccctgtgttggccagggttctctagagggatataactaacaggataaatagctatatataaaggggggtttattcagtattaactcacaggatcacaaggtcctacaataagctgtctgcgagctgaggagcaaggaagccagcccgagtgctaaagctgaagaacttggagtccaatttttgagggcaggaagcatccagcacgggagaaagctgtagcatgggaggctaggccagtctaaccttttcacattcttttgcctgctttttgaatgtgctgtgctggcagctgattagatggtgcccaccccgattaagggtgggtctgcctttcccaccccactaactcaaatgttaaacttgtttggccacaccctcacagacacacccaggatcaatactttgcatccttcaatccaatcaggttgacactcggcattaaccatcacacctggtgtgtgtttctctgattataaggacaccagtcctactggacgagggcctcacccttttgagctcctacaggccctgtctgcaaataaagtcacattggagtttaagggttctgatgatgagtgagggagggcacggctcagtctataacgatgtcctatatctattgcaaagaaaaaatgaaggcactattcaattcctccaaattaggaggtttgccagagcctcagacaaaaggattttttagggaggtacagttcattccataatgatgttctctatcgcaaagaagaaggggtaattcagttcctccaaaccaggcgatttgccagaactccaaacaaaaggaatttttttttcttcttgatccctatttatcaacacatgcctctgtgtctttccagttgacttcatctcttgggcagcattaatttcagaaatctgtatttctgacttgccctcaggaaacccctttagatgttagaaattcttctgtggatgaagttatctttttttttttttgagacatagtcttgctctgtcgcccaggctggagtgcagtggtgtgatctcggcttactgcaacctccacctcccaggttcaaacgattgtcctgcctcagcctcccgagtatctgggattacaggcgtgcaccaccacacctggctaatttttgtatttttagtagagaccggatttcaccatgttggccaggctggtctcgaactcctgacctcaggtgatccacccatctcagcctcccaaagtgctggggttataggcatgagccaccacacccggccagatgaggttatcttcttgagtctcagggtttactgtctgtcactgagttgcaaataaaagaaaagttggatgagttattggcagcctcaagagcaacagtgagaattgtagactcactttctgcattggagggtgtggtgtgtgggctacgggaagcgtggacatcattcaccatgctaggtgccgagaggggcatcagacacagcaggtgcgtgaatctcctgtcttcatatgatactgtctcactgtcagaatcacagtgacagaaggcatttgttactgtggattcacactccgttagggttaagatttttattctgtgtgagttccttagggttactgtgaaaagcacatcttatcttctctcgataatttttaagtgacatttaaaaatattcaagcatgtgacttgaccgaattgcttagcatttgagttgttgcattaaatggagcatctcgtcactttcaagtatttgatactggcagttgctaagagttaaaaggcagctggatttgtcgcagacaatgagttaaggaatccttccacatttttcccatttttttttttttttttttttttttttttgagacagagtttcactcttgttgcccaggctggagtgcaatggcacgagctcggctcaccgcaacctctgcctcccaggttcaagtgattctcctgccttagcctccctggtagctgggattacaggcatgtgccaccacacccggctaattttgtatttttagtagagacggggtttctccatgttggccaggctggtcttgaactcccgacctcaggtgatccgcccgcctcggcctcccaaagtgctgggaatacaggcgtgagctgccgcgcccggcccgtttttcccaactttaaaagtaagggttctcaggaccctgtgtagagcagtgaaaataagacctcgtgtgtgtgtgtgtgtgtgtgtgtgtgtgtgtgtgtacacacgcgcctgcaggagaactgctgttccacttaggtgagaggatgggctgtgtgcttcagaccaggaaatgtgtcatcttgccaagcaacctggctgagtgtgctggagtcaggatcttgaacagaaacttccttttctggtgttgttcactacagagctaaaatggccaaatatatactgtgaaaattgttttttttttttttaacaaaagaccagatccctccttcagctgtatacatttttgaataaaatcatattgaactaacaaaaaaaaaaaaaacaccaaaactggggaacttgcacaatagaaatatatcctctcccaggtctggaggacaagactttaaatccaaggtgtctcagggctgagctccatccagacgctctaggggaggatccttttggcctcccccagctcctgggggctccaggcatcccacggcttgtggctgtatcactccagtctctgcctctgtcttcacatcatcattttctctcatctgtctcaagcatgcctgttcctcctccttataaaaaccccaggctaggcgtggtagctcatgcctgtcatcccagcactttgggaggccgaggcgggcagatcacctgaggtcaggagtttgagaccagcccggccaacatggtgaaaccccatctttactaaaaatacaaaaataagccgggcgtggtggcgggtgcctgtaatcccagctacttgggagactgaggaagggaggatcacttgaactcgggaagtggaggttgcagtcagccaagatctgtccgctgtattccagcctgggtgacagagcaagactttgtcaaaaaaaaaaaactcaaaaagacaaaacaaaaaaaactccgcactcctgtcatcctagcattttgggcagcagtatgataacaaggccaggagtttgagacctaccttggcaacatagagagacccctgtctctataaaagctaacaaacaaaaaacaaaaatctttgtcattatatttaggctaatacaggataatttcctcatttgaaaacctttaatgtctaaacaccctattttcatacaaggtaatcttttcacaggttctagagattaggaccaggagatttttagggacggagtggaggataccgtcatttagcctaccacattcttactaccttaggaaaggatggccaggcaaggtggctcacgacggtaatcccagcactttgagaggccaaggcgggcggatcgcttgagcccaggagttcgagtccagcttgggcaatattgcaaaatccgatctctacaacaactacaaaaagtagccaggcgtggtgctgcgcacctgtggtcccagctactcaggaggctaaggagggagaatcgcttgaattcgggaggtggaggctgcagtgagcccagatcacacctttgcactccagcctgggtgacagaacgagaccctgtctcaataaatgcataaataattttaaaaaggaaagtaattcagcacaaacatttgcatattcccaagatgatgctcacagcttgcagtgcctgcctgggtcctattcctatctgcctgggtctatctgcctgggtcctattcctatctgcctgggtcctattcctgtctgcctggggtctatctgcctgggtcctattcctatctgcctgggtcctattcctatctgcctggggtctatctgcctgggtcctattcctatctgcctgggtcctattcctgtctgcctggggtctatctgcctgggtcctattcctatctgcctgggtcctattcctatctgcctgggtcctattcctatctgcctggggtctatctgcctgggtcctattcctatctgcctgggtcctattcctgtctgcctggggtctatctgcctgggtcctattcctatctgcctgggtcctattcctatctgcctggggtctatctgcctgggtcctattcctatctgcctgggtcctattcctatctgcctggggtctatctgcctgggtcctattcctatctgcctgggtcctattcctatctgcctggggtctatctgcctgggtcctattcctgtctgcctgggtctatctgcctgggtcctattcctatctgcctgggtcctattcctgtctgcctcgggtctatgcatttcctttttgtctgaggacacatttttgcttcatgctgatatttttcacttcacctttctccccttttcttcttttctctttttccctctccttccctcccctccctctggggcagaagctggcatgcggcagagcgccagcagaggacgtggcccaagctcccatacatcttccctttacctcttccgctgacttttttctgggtgtgcccagagagcctagctctggacactcaaagatgcatcatttcaatgtatgttccaaagttacgtagcatccaaggcatatgagacatgcttaaaaacatactggtcatgcaagtgaggaggtgcaatgatgggtactgtcgttgcgattgcggaagccagatctagagatgcccggcgtggcttggggttcaggaaaacttcctgaaggaggtgacacatttgcgtttacgatccccaagtgaggcacacaagcatctctcggcgagaaccccacagtccatcccagaaaaggaaagtcaagagaatgggctacgtatgggaggaagggaactatttatggtcttcgatgagaaaataaatgtgcgtatgcgccccagctttgtgcttcggtattgccacatgccggaaccgcgtgaaaatacaagccgtcaatacaagcaagtgctagccctcttttattattctactgcagaagaaggaagtccttgcttctgagtcattttgtgtattagttacacatgccgtgtaacaaaataacacagactcagcagcgtgtcctaacagcctggtaatattttatccagaatgacgtgttttagaaagttatgtcctgtcaaagtaatccagataccatttccttttcttcttgtttttttggtattattatactttaagttctggatacatgtacagaacgtgcaagtttgttacataggtatacacgtgccatggtggtttgctgcacccatcgacccgtcatctacattaggtatttgtcctaaagctatcccttccctaaccctccaccccccagcaagccctggtgtgtgatgttcccctccctgtgtccatgtgttctcattgttcaacttccactgatgagtgagaacatgcagtgtttggttttctgttcctgtgatagtttgctgagaatgatggtttccagcttcatccatgtccctgcaaaggacatgaactcatcctttttttatggctgcatagtattccatggtgtctatgtgccacattttctttatccagtctatcattgatgggcatttgggttggtttcaagtttttgctattgttaatagttccgcaataaacgtatgtgtgcatgtgtctttatagtagaatgatttataaacctttggtatatacccagtaacgggattgatgggtcaaatggtatttctggttctagatccttgaggaatcgccacactgtcttccacaatggttgaactaatttacactcctaccaacggtgtaaaaatgttcctatttctccaaatcctctccatttccttttcttctccttatacagtaaggaatatgaaactaacacacactttctctcatttcattctctttctttttctgtctgctctctttgtctttctccctctctctctccctctctttttcctctctctctctccctctctttttcctctctctctctctctttctctgtctctctctttgtcttcttttctctatttctctctgtctctcagtgtttgtcacgctctctctctttgcctctttctgtctctttttttttttttgagacagagtcttgctctgtcacccaggctggagtgcagtggcgcgacctcggcttactgcaacctccacctcccaggttcatgcgattctcctgccttagcctcccaagtagctgggattacaggcgtgcaccaccacagtcgcctaatttttgtatttttagtagagatggagtttgaccacaatggccaggctggtctcgaactcctgacctctgcccaccttccaaagtgctgagattacaggtgtgcaccaccacagctggctaatttttgtatttttagtagagacgaggtttcaacatgttagccaagctggtctcaaagtcctgacctcacgtgatctgcctgccttcgcctcctaaagtgctgggattacaggcatgagccatcgtgcccggcctctttctttgtatctctctgtctgcctttctctctttgtcccttttactgtctcccgtccctctctctctttctgtttctctctctcactgtgtctctttgtctttatctctgtgtgttttttctctcttccccttttcctccccctccttttttctctttctctcttagcctttctttctttctctctttctctctctctctgcttctatctttctatctctctctttctcattcttacactccatctctgtctcttctctctctctgatggtgagtggagagtcatttcgttttggaatgatgatgagcattccagtaatagttttggagagtaaggctcatagagcttattaagcaaggtgtgtctgtcataaaattgattgctggcattttacacatcagtgcagacatggggggcacaggcagacccctccccccaccacacacacacactgcttatcctctgaaagctatgtggccttcataaaaatattaacagttcttttacagtaatgattttcccctatgaggctccccagtgaggaggctgtaaatgacactgaccaccagcagccctgcagatcaaggctgttctcttctcggccagcccagaaccagcctctgctcgctccctccctgaggactcctgtctctgacctctgcacacatgctgtgatttgctcttccacctcacaccattccccatcctcacctttcagaactcactggcagtgtcccccaataccttccacctctctccagaaattaccttcccatctcaatgtaagggaacttgcttcttccctcagagatctgctgtctctgctgcaagtaatagctagttttcatgcattttgttctgtctgactttaggttgttgcattgttctcccaacctccttgaacccatggacctggaggcagaattatatacctgtgaatttgcttttctttctagttcctctccctccaaaacctcagtccttctgggaaaaaaaaaaaaaaaacagctttaacacaatcaaacacatcacttttagcgatggagacccactgggaatttagagagaaagagtgaagttgatatactgaatacaatagacataagtctacctctctacctatgtgatgttataaagctgtccctgagtcattcactctctaaaaatgtcatctttggctggacacagctgctcacgcctgtaatccaacactttgggaggctgatgtgggaggctcacttgagcttaggagttcgagaccagccatggggacatagtgagaccctgtctccaaaaacataaatgtaataaaaaataaaatgctttcttttattattcttctgcagaagaaggaagtccttgcttctgagtcattttgtgtattagttacatatactgtgtaacaaaataacagactgagcagcgtggaagagctcatacttactatctgtagcaagggatccataaatggcgtccttttttattattatataaaattctatattctcctgtggaagaaggaagtccttgcttctgagccattttgtgtattagttacatatgccctgtaacaaaataacacagattcagcaacgtggaagggctcgtacttcttactatctgtagcaggggatgcataaattgcttcctgtttgattattatataaaattctatattctatattcctctactgcagaagaaggaagtccttgcttctgagtcattttgtgtatcagttacatatgctgtgtaacaaaataacccacagactcagcagcgtggaagggctcatacttactatcccacagctgctgcgggtcaggaatctgggcaggtgtaactgcattctctcttcggggtctcactgggctataaccaaagtgtcatctggcctgaggtcctctctggagctcaggatcttcgaaattcacatggttatacgcagaatccaattcctggaagctgcagatctggggatctgagtatcttgctggcttttggccaggggctgctgtcagctcctagagaggccatgcccaggttctggccccaaggcgctctcacaaaacatcagctcacatcaaggtcaggaggagaatgacaggtcccacacagactcaaggaaaggggactatacaaggatgggactcattgatctccctagagtatgagctcctcattgtaccctactgacatgtccaattcagtgttacttcctggacaggcgtggtggctcacgcctgtaatcccagcactttgggaggctgaggcgggcggatcacctgaggtcaagagtttgagaccagcctggccaacatggtgaaacattgtctctactaaaaaaaaaaaaaaaaaaaaaaatacaaaaatacaaaaattagctgggcctggtggcatgtgcctgtaatcccagctacctgggaggctgaggcaggagaatcactggaacccaggaagcagaggctgcagtgagctgagatcctgccacagcactccagcccggtcaacagagcgagactccatctcaaaaagagcagaaaaaaaaaaagtgttacttcctagatgaaattgagtttgacctgtttagaaattttcttaatctctgaaataggttgggagataaccaggtattttttgttgttgtccttttccagtggaatttttatactgtgacttggcttccatgacttccatccggcagtttgtgcagaagttcaagatgaagaagattcctctccatgtcctgatcaacaatggtgagtcctggtgaaattgcagcaagccaggggttaatttgaatgcaaacaggaactctagctttcatgcgggagaagtgtctcagcaaaacaggatatccatgggaattattgaacatacctgctatttctagtcagtgcttcatttcacggatagctttggaagagcatcattcttgttagcatgttactttgaaataatggtaaacgcgataacatgttgtatggagttgacacgttgacttgtccacttggactaaagggtatgaggcacatgctaagggttggtgttttcccaaatgttatcttacaaaaccatcaccacattcccctgagagtcattatttgggcactagaagctcattaccatttatctcttgattttaccccctgttcaacattctcacccagataggtggagtcaatatctccccttccccaccttcaatctgcccatctgccaatcttcaacacaaactacccttgaccttgagcccttctttgagcctcgctgagtgcttaaggtcattgcaacgcttactgttgaccttgagcccttctttgggccacgctgagcgcttaagatcattgcaacacttaatgtttctcctcgtaacactgatgcccattactctcatcccctgctgcagtccattttattttttataaaagttaacctgaaccctccacactgaggaggtacagttattgacatctccaaactaagtaaatacatagaactaaaggtctcagaaatacaccaacaaacatgtgtgctagtagaatttaacgcatcactttcacagatggagaccaaatgcaaattcagagaggaaataaatagtgacattaatacagtggatagaacagacgtacgtcaaacagtgagcccataaagacagcacattcctttcaaatacatgaaatatttatcaagttattgacacttcagattgcagacaaaaaaatcagcaaaaggatcttgtgattacccaatgtaattactccattacccacctagaccattaaagattcttaattctgcaaaaccccttgtgctacctaacgtaccattttcataaattctggagattaggatatggacatgtctgtaaggagggagaaagcattattctttgtactaaagttgtaatacctgtctgtttccagctgccaagatgtggtagcttctatctaatttttttttctttttgtcttgatgtgtttcgtgtttttgtataacattaatgggattggaggataggaaagtggatgagatacccacggttccccctcaacccacttgtttaattggaaattattatgctagagtttaaaggagaagcatgggatataaaactatacatagagtgtgatgccaatttatgcataaaaatttgtacagacatagctatgtgtgagtgcatatgtatttgtatatgtatttgatgtatgatgtatatgtatttatgcataaaaatacgtgcagacatagctatgatgtgtgagtgccactcaaatagctacagacaacaccatttccatgtacttagcctggtaagaaacatcgtattatcagtgctagtggctcctgttggaaggtccggaatgattttaactttgtgtgtcttctttggagatcaataacacttttcagatttgccatcctggtgggatctgaagtttctacgcaggcataaatgatttcccagtcagcagccatttggaatcttctgtctcagcactgggtgtggacttcctttgctgaagacctatcagtattagaagtgattagaattatagcattataagtcaccaaatgtggagaccacttagaggcactgtggagatcctacacgacccgacgtctcatttcctcgttctgtgtaacacccttactcattagtaatgggagcactttatcacagagcagttggagatggaaatacatacatgacatggtgcccttgcacagagacacacaaaacagaactgtccatcctcttaggacttttgtgcgactacttccatccatttggtatgggcttgcatccaccagtaagcagaaaaaattaggaatctcaggccgggcgcggtggctcacccctgtaatcccaacactttgggaggctgaggtgagtggatcacctgaggtcaggggttccagaccagcctgaccaatatggtgaaaccctgtctctactaaaaatacaaatattagccaggcgtggtggcgggcatctgtagtcccagctactcaggaggctgaggcaggagaatcgcttgaacctgggaggtggaggctgcagtgagccgagaccacaccattgcactccagcctgagcaacagagcaagactgtttcaaaaaaaaaaaaaaattaggaatgtcagatatgatatgtttctccagcagaatcttactgtgttctggggggagcagaattttactgagcaatgtgtatatgaaccacatctgtgacagtggatacaggctaacaccagttgacacaggctaaccagcgtatactccatcactcaaccaccacgtttaccttttgaaatggctattgcattcctaggattctcctctgttccttttctcaacagattttaaacaaggcacacagggctctcagaaacaaacaaaaatattctggaaactgggacagggttgaatttgaatcaaaagggtcttgttgttggattgtctctgtaccctatctcttctgtagaaaatctcatgcacatattgggtttacttcttcctagacttatctagacctttcttccatgctaagaccttttaccttcgctcaatgcctcagaggcacctcaagccagtaagtccagtgtgaaattcctgagtctatggctgacactggttctagaggagagtatttccttccccagtttttagaagactgtcagcgtttcttcacccatggcctccaacccggccttaaagccagcaatgatagtggctcacgcctgtaacctcagcactttgggaggccgaggcaggtggattacgtgaggtcaggagttcgagaccaacgtggacaacattgtgaaaccctgtctctactaaaaatacaaaattagctgggcatggtggcgcatgcctgtaatcccagctactcgggaggctgaggcaggagaattgcttgaacccgggaggcagaggttgcagtaagctgagatcacaccactgcactccagtctgggcaacaagagcaaaactccatctcaaaacaacaaaaacaacaacaaagccagcaatgagacacctttgaatctctctttcttgttctctctctctccctctcttcccttctctctctttctctctctcatcttgccttctctttttttttatctccttcacttacttttgttcttctgcctgccttgtagaagaaccattgtgattatttggggcccaccaggatcatctcagataatcacctcatctcaagatcttccactaattcacatctacaaaggcccttttgccgtgaaagtcacattttcatgtgttccagagatgaggacatggacattttttcatcttttgagttattactcttccaaattgggaataggttgtgggcatctctggggtcattattgtgtcgaccacatgagaattagtctgtggacatctttagagccattattcagtcttccacatgaggattaggatgtggacatctttggggccattattctgtttcccacatgaggattagaatgtgaacatctttggggctattattctatctaccacatgggaattaacatatggacatctttggggccattgttcggcttccacatggggattaggatgtggacatctttggggccattattctgtcttccacatggggatttggatatggacatcttcggggccattattctgtctcccacatggggattcggatatggacatcttcggggccattattctgtgtaccacatggggattgggatgtggacatctttggggccattattctgtctaccacatggggattaggatgtggacatcttcagggccattattttgtcttccacatgaggattgggatgtggacatctttgggtcattattctgtcttccacatgaggattaggatgtggacatttttggggccattattctgtcttccacctgaggattaggatgtggacatctttggggccattattgtgtctcccacatggggattacagtgtgggcatttttggggtcatgattctgtctcccacatgaataatgtggacctggacatcttgagttgtgcattatttaacctgccatacctacctactctgcccttcacatacttcgcttgcaggaaaaataaaataataagcaagattcttgacctcatagaaatcatactttagcaacggaaacaaacattggaccaataatcattctgtgaaatgttctgccttagaaaacacacctcttgcaatgtgacaacacagtcttgtaaagtacagagaagattgcaccccaagtcacacgcctccctggaattccccagcctgtgctgctcagaacaccatttccaggaggtgataatgagaatccatttgttacaagatgatggcttgaaataacactttgcactttcttccttttatctttttgttctacatctttcaagaggttgctcaggctgtggctttcctggactccctataggtttttgtggctgactaaggttcatcttgtccctggggtcactgttgagaagagctcagttgcagaggatctggatttttttttttttcctctgtgggtacagacagaagcttctagaaaagagctggagacttcgcttttggaggctgtgttgaatacccattgcccactcttcacaagaagacagaaatgcagagaggcagtctcttgttgacaaatcctcttggttctcttggaaatgcaacagaaccatggagcttcgtgaagcccatgggcttggaaaggggcctcccgaggtacccagggtggatggaaagctgcagggataagtgctcctcaagccagaagtagcccagatggcacagtctatgctgagaatggattcatcaccagcctgtgtgctggaggcttgggccagatgaaccttgatttagagaggaagtaaagcattttttgccttggtttgtgcatcagaattcatcttcatggtgtgcaaatgacgaggctggattctatacagtcagcactgagaatggattcagcacaagcccgtgtgctggaggcctgggtctgatgtacctggatttagggaagaagcaaagtatttttctcatttattgcatgccttagtttgtgcatcagaattcatcttcgtggtgtgcaaatgagaaggctggattctacacagtcagcgttgagaatggattcatcaccagctcttgtgctggaggcttgagccagatgtacgttgatttagagaagaagtaaaggatttttctcatttgttgcatgccttggtttatgcatcagaattcatcttcgttgtgtgcaaatgagaaggctggattctatacagtcaacgctgagaatgggttcatcaccagctggtgtgctgaagcttgggccagatgtaccttgacttagagaagaaatcaaggatttttctcgttggtttgtgcatcagaattcttcttcgttgtgtgcaaatgagattgctggattgtatgtttgggatattgctggtgtcaacttatgtaaatagagtttctatttataggcagcctcagggaaggactccagtggtggtacttttagtgtctaagaggctagtagggggtctgcagacccctaaaccagggctgtccaacccccaggtcatagtaccagtccatggcctgttaggacaccggccgcacagcagaaggtgagtggcaagtgaacaagcaaagcttcatctgtatttacagccactccccattgttcacatgactgcctgagctctgcctcctgtcagatcagcagcagcattagattcttataggagcacaaaccctactgtgaactgtgcatgtgagggacttaggttgtgcactccttatgaaaagctaaagcctgatgatctgtgcatgggaaggatctaggttgtgtgctccttatggaatctaattcctgatgatctgtcactgtctcccatcacccccagatgggactgtctagtcacaggaaaacaagctcagggctcccactgattctatatgatggcgacttgtagaattatttcattatatagtacaatgtaataataatacaaataaagtgtacaataaatgtcatgccccggaatcatcccaaaaccatccccacattccacctccaccttctgtcttcagaaaattgtctttcacaaaagtggtccctggtgccaaaaaggttggagactgctgccctaaactatttccccagaaccttccctccaaaactcctgctagtcaaccacgtgcctcaagtctcatggaaaacagccccagctgagctcagccagggtgacttccaaggcaagaaggagctacacttcgtgcttttctttttttattcttagagcaatcaaggttttgcaaacattaaatacttcagacatagaatatctttttcatttgctagtgggttgaaaatagaacctgactgcctctgtctggctgctgtgggaagctcagaggcaacgcgatgatttatcaagcacaagaataaatcaataatagacctcctgcagagccggtatttatggtttattcacttcaaaattgtatttatctagcttcccatccccatgtctgaaaattgatagatttttaataatgcagaggatttatagatttatccttgtcagccatcttcccataactctaatggatgaatttctttctgagataatgaattactaagcattatttttcctaccaccaaagaaatacgtccacgatacagggtgaccctgaaaaataacaatgattcttccctggccagagacctaaagactctgttttttggtacagttcttcattcacccattcattcattcattcattcattcattcaaattcattcattcacttgaatgaattcaaatgagtgaatgaatgaatgaaagaattcaaatgaatgaatgaattcagaggaatgaatgaatgcaaatgaattcaaaggaatgaacaaatgaattcaaatgaattaattctaaggaatgaatgaattctaatgaatgaacaaatgaattcaaaggaacgaatgaattcaaaggactaaatgaattgaaaggaatgtatgaattcaaaggaatgaattcaaaggaatgaatgaatgaattcaaatgagtgaatctgaatgaattcaagggaatgaataaattcaaatgaaggaatgaattcaaatgaatgaacaaatgaagtcaaaggaacgaatgaattcaaaggaatgaataaattcagaggaatgaatgaatgaattcaaaggaatgagtgaattcaaaggaatgagtgaattcaaaggaatgagtgaattcaaaggaatgagtgaattcaaaggaatgagtgaattcaaaggaatgaacgaattcaaaggaatgaatgaatgaattcaaatgagtgaatttaaatgaataaattcaagtgaatgaatgaattcaaaggaacaagtgaattcaaaagaaggaatgaattcaaatgatgcaaatgaatgaatggaatcaaatgaatgaatgaattctaatgagttcattcaaatgagcaaatgggcacagggcacctacaagacccatgagagttaaggaagattcattcggggaagcccaggtgtgcagttctgcatcaacagaagactgaggtgcagtggagccggtccttactgaggacccactttttggtggacggacacctgagcagccatctcctgtctttgtgggcgcctggcattttctatgtgactcgggctccacagtcatctggtctccctcccgggaagacggaaagtgttgcatcgcggcgcatgcattcgtcagcggatccttgagtctgcacaggtgtagaccatttattctgcgtgccttctgtttgcttctcttccagagctgctctcctgtggatagagtagctttctgttccgtagtggtttcctctgcctctcccgatggcgccttctctgaacaggaggcatttggatgttcttttagtgttggtgttggcagcagcatgggatgtggtctgttgtgactctgcggcaggctgttccctgccagagaaggctagatgttcagggcgtccgtcccatagcctccctggactggctccatccttcccaccgccctcccgagattctaggaagtgggttgagaagcagtggtttttcagttactcaaatgcttttctcctctctctctctctttctgtaactctctgtctctctctcctccttctccccgtctctctgtcattctctctttccacctcttcactgtctcacttttcctctcttttgctttttctctctgtctctctctctcctcagtctaccccatccccgcttctactattttgctctcgacctcccttctccctcctccctccctctctccccctctctctccccttctcccttctctctctccctttctccctctctctccctctctctctttctctcttctctctttcttctctctctccccctccctccctcgctttctcccctcttctctctctcccattctccctctccctccctccctctctccttccttccctctctccctctttctcccctcttctctctctccttttctcccattctctctctccctctctccctccctttcccttcttctctccctcccctctttcttctctctcccctctttcttctctctctccctttctgtttccctctcgcacaccctccctcttctccctatctcctttctcttcctgtctctccccttgtctctctatctcctttgtcttcctctgtgtcccacttctctctctttcctccttcccccatctctcctcctctctcctttgccttccttctctccccctttctctctttctctctgtctctttctctgtctctccccttatttcctccctctccttctctcttcctttctcgtttgccctccctctctctccctgttccctctccatctctctctctctttcccccatttcctcctcttccttctctctccctctcgtttgccctccctctctctccccgttccctctccatctctctttctctctctttcccccatttcctcctcttccttctctctccctctcgtttgccctccctctctctccccgttccctctccatctctctttctctctctttcccccatttcctcctcctccttctctctccctctcgtttgccctccctctctctccccgttccctctccatctctctttctctctctttcccccatttcctcctcctccttctctctccctctctcgtttgccctccctctctctccccgttccctctccatctctctctctctttcccccatttcctcctcttccttctctctccctctcgtttgccctccctctctctccccgttccctctccatctctctttctctctctttcccctatttcctccctctcctccttctctctccctctctcgtttgccctccctctctctccccgttccctctccatctctctttctctctctttcccccatttcctcctcctccttctctctccctctcgtttgccctccctctctctccccgttccctctccatctctctttctctctctttcccccatttcctcctcctccttctctctccctctcgtttgccctccctctctctccccgttccctctccatctctctttctctctctttcccccatttcctcctcctccttctctctccctctcgtttgccctccctctctctccccgttccctctccatctctctctctctttcccccatttcctcctcttccttctctctccctctcgtttgccctccctctctctccccgttccctctccatctctctctctctttcccccatttcctcctcttccttctctctccctctcgtttgccctccctctctctccctgttccctctccatctctctttctctctctttcccccatttcctcctcttccttctctctccctctctcgtttgccctccctctctctccccgttccctctccatctctctctctctttcccccatttcctcctcttccttctctctccctctcgtttgccctccctctctctccccgttccctctccatctctctctctctttcccccatttcctcctcttccttctctctccctctcgtttgccctccctctctctccctgttccctctccatctctctttctctctctttcccccatttcctcctcttccttctctctccctctctcgtttgccctccctctctctccccgttccctctccatctctctctctctttcccccatttcctcctcttccttctctctccctctcgtttgccctccctctctctccccgttccctctccatctctctctctctttcccccatttcctcctcttccttctctctccctctcgtttgccctccctctctctccccgttccctctccatctctctttctctctctttcccccatttcctcctcctccttctctctccctctcgtttgccctccctctctctccctgttccctctccatctctctttctctctctttcccccatttcctcctcctccttctctctccctctcgtttgccctccctctctctccctgttccctctccatctctctttctctctctttcccccatttcctcctcctccttctctctccctctcgtttgccctccctctctctccccgttccctctccatctctctttctctctctttcccccatttcctcctcctccttctctctccctctcgtttgccctccctctctctccctgttccctctccatctctctttctctctctttcccccatttcctcctcctccttctctctccctctcgtttgccctccctctctctccctgttccctctccatctctctttctctctctttcccccatttcctcctcctccttctctctccctctcgtttgccctccctctctctccctgttccctctccatctctctttctctctctttcccccatttcctcctcttccttctctctccctctctcgtttgccctccctctctctccccgttccctctccatctctctttctctctctttcccccatttcctcctcctccttctctctccctctcgtttgccctccctctctctccccgttccctctccatctctctttctctctctttcccccatttcctcctcctccttctctctccctctcgtttgccctccctctctctccccgttccctctccatctctctttctctctctttcccccatttcctcctcctccttctctctccctctcgtttgccctccctctctctccccgttccctctccatctctctttctctctctttcccccatttcctcctcctccttctctctccctctctcgtttgccctccctctctctccccgttccctctccatctctctctctctttcccccatttcctcctcttccttctctctccctctcgtttgccctccctctctctccccgttccctctccatctctctttctctctcccccatttcctcctcttccttctctctccctctcgtttgccctccctctctctccccgttccctctccatctctctctctctttcccccatttcctcctcttccttctctctccctctcgtttgccctccctctctctccctgttccctctccatctctctttctctctctttcccccatttcctcctcttccttctctctccctctctcgtttgccctccctctctctccccgttccctctccatctctctctctctttcccccatttcctcctcttccttctctctccctctcgtttgccctccctctctctccccgttccctctccatctctctctctctttcccccatttcctcctcttccttctctctccctctcgtttgccctccctctctctccccgttccctctccatctctctttctctctctttcccccatttcctcctcctccttctctctccctctcgtttgccctccctctctctccctgttccctctccatctctctttctctctctttcccccatttcctcctcctccttctctctccctctcgtttgccctccctctctctccctgttccctctccatctctctttctctctctttcccccatttcctcctcctccttctctctccctctcgtttgccctccctctctctccccgttccctctccatctctctttctctctctttcccccatttcctcctcctccttctctctccctctcgtttgccctccctctctctccctgttccctctccatctctctttctctctctttcccccatttcctcctcctccttctctctccctctcgtttgccctccctctctctccctgttccctctccatctctctttctctctctttcccccatttcctcctcctccttctctctccctctcgtttgccctccctctctctccctgttccctctccatctctctttctctctctttcccccatttcctcctcttccttctctctccctctctcgtttgccctccctctctctccccgttccctctccatctctctttctctctctttcccccatttcctcctcctccttctctctccctctcgtttgccctccctctctctccccgttccctctccatctctctttctctctctttcccccatttcctcctcctccttctctctccctctcgtttgccctccctctctctccccgttccctctccatctctctttctctctctttcccccatttcctcctcctccttctctctccctctcgtttgccctccctctctctccccgttccctctccatctctctttctctctctttcccccatttcctcctcctccttctctctccctctctcgtttgccctccctctctctccccgttccctctccatctctctctctctttcccccatttcctcctcttccttctctctccctctcgtttgccctccctctctctccccgttccctctccatctctctttctctctctttcccccatttcctcctcctccttctctctccctctcgtttgccctccctctctctccccgttccctctccatctctctttctctctctttcccccatttcctcctcctccttctctctccctctctcgtttgccctccctctctctccccgttccctctccatctctctctctctttcccccatttcctcctcttccttctctctccctctcgtttgccctccctctctctccccgttccctctccatctctctttctctctctttcccccatttcctcctcctccttctctctccctctcgtttgccctccctctctctccctgttccctctccatctctctttctctctctttcccccatttcctcctcctccttctctctccctctcgtttgccctccctctctctccccgttccctctccatctctctttctctctctttcccccatttcctcctcctccttctctctccctctcgtttgccctccctctctctccctgttccctctccatctctctttctctctctttcccccatttcctcctcctccttctctctccctctcgtttgccctccctctctctccctgttccctctccatctctctttctctctctttcccccatttcctcctcctccttctctctccctctcgtttgccctccctctctctccctgttccctctccatctctctttctctctctttcccccatttcctcctcttccttctctctccctctctcgtttgccctccctctctctccctgttccctctccatctctctttctctctctttcccctatttcctcccctccttctctctccctctcgtttgccctccctctctctccctgttccctctccatctctctttctctttctttcccccatttcctcctcttccttctctctccctctctcgtttgccctccctctctctccctgttccctctccatctctctttctctctttcccccatttcctcctcttccttctctctccctctctcgtttgccctccctctctctccctgttccctctccatctctctttctctctttcccctatttcctcctcttccttctctctccctctctcgtttgccctccctctctctccctgttccctctccatctctctttctctctttccccctatttcctccctctcctcctctctccctctcgtttgccctccctctctctccctgttccctctccatctctctttctctctcttcccccatttcctcctcttccttctctctccctctctcgtttgccctccctctctctccctgttccctctccatctctctttctctctttcccctatttcctcccctccttctctctccctctcgtttgccctccctctctctccctgttccctctccatctctctttgtctctctttctccctatttcctccctctccttctctcttccttctttgccctccctctctctctcctctctctctctctgattgccctttcatccccatcactctcctttctctggagttctccgcttggagagcggagaactctcccttctcctcccgttcaggatacacctcacctgtgttcactgcttcaggcacaatatgtgattgtgaccctgagcgttcactccccagtaaaatgccattaggtgcacagaccaatgaacgataattgtattgcgtattttccacctttgaattggcagatcaatggacgataattttactgtttattttccacctttgaattggcagatcgatggacgatagttttattctgtattttccacctttcgattcgcagatcaatgaacgatagttctattgtgtattctccacctttgaattggcgaagagacagattccgtgaatgctcctaacgtggacggcacccgatacactgacgtggccacagggttttcttattccttacaaaattcgcaatgaaacatcagtatatttgctgatgattaaaacttgtgcaacaaaatctcagaagtcaccacaaaagaatgtatccatgtagcccaaaaccactggtttcccaaaaattattgaaattttaagaaacaggccgggcgcgatggcccacgcctgtaatcccagcactttgggaggccgacgtggatggatcacgaggtcaggagttcgagaccatcctggccaacacggtgaaatcccgtctctactaaaaatacagaaattagctgggcatagtagcatacacctgtaatcccagctactcaggagcctgaggcaggagaatttctggaacccgggaggcagaggctgcagtgggccgagattgtgccactgcactccagcctagcgacagagtgagactccatctcaaaaataaaattaaattaaaatttttaaaaaaaggcaaattattattttattttatttatttatttccttttttgagacagagccttgctctgtcgcccaggctggagtgcagtggcacaacctcttctcactgcaatctccgcctcccagaaaaaaacaggcaaattaaatctatggtaatggaaattggaattgtagttaccttagaagaatgtgataattaattttggatcaaaaaagggcttaggggtgcagatgtgggaggcggttacctgagaggggagagtgctcgctttggatgattccattgagatttccctcatgatctctgcaccttttttttttttgttttgaaacatagtctcgctgttgtcggccggggctggagtgcagtgcacgatatcagctcactgcaacctctgcctcctgagttccagaaattctcctgcctcagcctcccaagcagctgaaattacaggtgcccgccaccacactcagctaattttttttttttttttgtatttttagtagagacggggtttcaccaagttggccaggctggtctcaaactcctgacctcaggtcatccgcctgcctcggcctcccagagtgctgggattacaggtgtgagtcaccgtgcccagccctgtgcaccttttttatactttcctttgatttaaaagaaaataataacttgacaaaaataaataaatagaattttactgatgccgaaaaaaacatgattatggaaaatttaaaacacatacaaaagcctacaggcatttgaatttgccgtcgattgtctaactagtactcaattctgcatttcggacttccgtcaatccctcctctggggtaccatcatctcttcctaggccatgataatggcctcctaacaggcatctcaggcacccatccaatctctctacctggcaccaatctggtctttcaatgctctgcttacataggaagaggaaaattaatacctaaagccactggcaaagaactcaacaacaaaacaatttctccttcagaatatgtcaggctttcgttccgtaaatatcagcgtttcaggtgggtttgctgcctagaaacgtctccgtgacactgtggtttaaaatacgggtgcgtggccgggcgcggtggctcacacctgggatcccagcactttgggaggctgaggcgggcagatcacttggggtcaggagttcgagaccagactggtcaacatgacaaaaccccatctctactaaaaatacaaaaaaaaaaaaaaaaagtttagccgggtgttgtggtgcacacctgtaatcccagctacttgggaggctgaggcagaagaatcacttcaacccgggaggcggaggttgcagtgagccgagttcaacccactgcaatccagcctgggcaacagagtgagactccatctcaaaaaaaatgaaataaaaaataaaatacggacacactgcactccagcttggttgacagagcgagactctgtctccaaaaaaataataatattagtagggctgggtgcagtggctcacacctgtagtcccagcactttgggaggccaaggcgggaggatcagttgagattaggagttcaagagcagcctggccaacatggtgaaaccccgtctctactaaaaatacaaaaaatagctggccatcggggcaggtgcctgtaatcccatgtactcgggaggctgaggcaggagaatcgcttgaacccaggaggcagaggttgcagtgagccgacatcacaacactgcactccagtctgggtgacacagcaagagtttacctcaaagtaataataataataataaaataggaataaacgtaattactcgcagtagctcactaacgatgaattatcagcatccagggcccctgcgcgtggctgctgcattcaccacggcgcaggaattctcacgcagcttccccgccaggcgagtccctagcacggctcggattcatctggagcacaggtcaccacctgcctgcacagaagcactgtcccctctgctcttgcaaaagataccttccccaacgatgctgttgtcaccaagaatttgctcagagctgcaagccattatcctaagagaaccagcacagaaacagaaaaccaaatactgcatgttctgacttacacctggaaggtacacagcgggtactcatggacacaaagatgggaagagcagaaactcttgactgctagaaggtagggggagggaggcaggggatgaaaaaccacctgttgggtacagtggccatttcctgggtgacaggttcactcacagccccaccctcagtctctaatgtgtattcctctattccgtatgccccttcaatgccagaagcatacccagagcttagtgcccacttacaagtgagaacgtgtatttgcttttctgttcttgagtgactccacgtagaataataacctccagttctatccaagttactgccaatgacacgattccactctttttaatggcttagtagtattccattccattttctttatccagtactccacggaggggtacttaggttgattccgtatgtttgcaattgtgagttgtgctgcaagaaacagacaggtgcaggtattttgttttgtattgttttgtttgattattttattttattgatttatttatttttgagatggagtcttgctctgtcacccaggctggagtgcagtggtgcgatctcggctcactgcaacctccacctcctgggttcaagcaattctggggtttctccatgttgcccaggctgctctcgaactcctgacctcaggtgatctgcccgccttggtctcccaaagtgctgggatgacaggcgtgagccaccatgcctggcctgcaggtgtctttttgatataaggacttcttttcctttgggtagatacccaggagtgggattgctggatcgaacaaatgatctgcttttagttctttgagaggaacatccgtgctgttttctatacagcttgtatgaattcactttctttcggggcacaggaatgtaggcagttctgcctggggggtctcctgtggggctgcagctggggctgactttatctgaaggcttgaccaggttggatgtccaggatagctttctctggtgtcaagaagctggtacagcctgtcacctgggcttagctgggagggccaacaagaacaggtacctggggcctctccagcatgtcaggctgaaggtgctcagtctttttaaaccaaagctggctcctcccagactcagcattcccaagaaccaagcaggggccacgtgaccttattgacccaactttggaagtcacacagtgtttacaccactgtggcattctacaaaagaattaacgagaaagttaatgagcatggccgagattcaagggaaggggcgtagactctagctcccaaggagacgagtgtcaaaagaatttgcaggcctgctttagagccccctgaagctgcctttcaaaaccatgcatgcataagccaggtgttcatgataagctcgtctctcctaagctgggaatttatgacacttcaggcacggattgagctgtgtgtctccagattcttcacatcaaataaaatatgaggaaaatggcatcgtgaaaaagatgtttatagttcatcaaaatgcaaagcttcccgtccacccacagcaacctattctggtgtttttgtttttttgttgttggtttttttttgtttttgagacaaaaatcaacttaggttgattccgtatgtttgcagttgtgagttgtgctgcaagaaacagacaggtgcaggtatgtttttttgtttcgttttgtctcactctttcgcccaggctggagtgcagtggtgtgatctcggctcactgcaacctctgcctcccaggttcaagcgattctcctgcctcagcttcccgagtagctgggattacaggcatgcaccaccacgcccggctaattttgtatttttagtagagacaaggtttctccatgttggccaagctggtctcgaactcctgacctgaactgatctgcccgcttcgccctctgaaagtgctgggaggattacaggcatgacccaccgggccgggctttttttctggataactcctgaggtgaattctgacatacttctcagaagtgttttgttagatgggctttgaggactgtaggagtgttgaatgtttaatacacatgtgtcttgtgactgattgatactggaccctgattgatattggatccctcccagttggtttatactcctgatgttttacaggcataagctcagggaataaattctctgtatcctggaagtttttttgaaagctagatattcacgtaggagggggaagcactgagtctggctggaaagtgtgtgcaggtgagaagcaaggactgcacctgaacagtctgctcatttctccctgaggatttcagcaggccacaggcctggaatggcatggtggtgcctctcccctgccaccattctctgtgagagtgtgtccagaatttattccttcttgtgggttcttggtctcgctgacttcaagaatgaagccgcagaccctcacggtgagtgttagggcttttaaagatggtgcgtcccgagtttgttccttcagatgttcagatgtgcctggagttttttccttctggtgggttcgcagactcgctgacttcaggagtgaagctgcggaccttggcagtgagtcttacagctcatacaggtagtgtagacccaaagagtgagcagcagcaagatttatggtgaagagtgaaacaacaaagtttccacaacgtggaaggggacacaagctggctcaggtggccagcttttattcccttatttggccccgcccacatcctgctgactggtccattttacagagtgctgattggtccattttacagagtgctgattggtccattttacagagtgctgattggtccattttatagagcattgattggtccattttacagagcactgattggtccattttacagactgctgaatggtccattttagagtgctgattggtgcctttacaattctttagctagacaaaaggtctccgggtctccactcgacccaggaagtccaggtggcttcacgtctcaaaagcagcagatctccatccacgtttattttttatttcccccttgctgtacccaaagcactacaaccgcactgtggaggctacagccagaataagacgttggtttttcctcaaggacctcacaattgtcaagcctccactggggccagggacgtgtagagccgcgggacccactgctgagtcttctgtgggccctccgcgcaatggggcatccagtgcggcctgtgcatccacagttttgaaaggcgggttggagaggctgtaaaacaggcctgcaaattcttttcacacttgtctcttcgggagctggagtccctgctccgtctcttgaatctcggctgtcctcattaactgtctcgtaattcctagaatggggcagtggtgacaactctgtaggagttccaaagttgggtcgataaggccacgtggctcctgcttggttctttgggaatgctgagccggcgaggagccagctttggttttgagtgttcataaagtacaactggaaagactgtgtacacaaacacaggcaggtacacaaatgcacacgcatcaaaaatttatagggaaatgggtccatgtaccgaggcacaaataacatacagatattacagtacacacagaagcaagcacatatacaaatgcatgtacctcaaaaaatgtatacacctacggatacacctctacatatacaaacacatagagaaatgctagacctacatatatgtatagatagctccatataagatacacacaaacacaagcacgtgtacaaatgcatatgcatagaaaaagatgtacgctatgcagatgtacatatacatacacaaatacatacagaaacgctagacctatagatatatacatatctccatataaaatacacacacggccgggtgcagtgtctcacgcctgtaatcccagcacttagggaggccgaggtgggcggatcccctgaggtcaggagtttgagagcagcctggccaacatggcaaaaccccgtctctactgaaaatacagaaaaatttagccacgtgtggtggtgggtgcctgtaatcccagctactcgggaggctaaggcaggaaaattgcttgaacctgggaggcggaggttgcagtgaggcgagactgcctcattgcactccagcctggacgacaagagcgaaactcctcctcaaaaaataaataaatacatacatataaaatacacacacacatacaagcacataaacaaatgcatgtacctaggaaaatgtattcatgtacagatacacgtatacatatacaaataagtagagaaatgctaggcctatatatgtgtagatatctccatataaaatacacacaaatacaagcacatatacaaatacatgtacatataaaaaatgtgtgcacttgcagatgcatgtatacatgtacaaatacacagagaaatgctagacctctatatatttgtgtgtagatataaaatacatacacactaatacaagcatatatacaaatgcatatgcataggaaaatatgtacacatgcagatatacatatacaaatatgtagacaaatgctagacctacatatatgtatagatagctccatataaaatacacacaaacacatatacaaatgcatatgcatagaaagatatgtacacatgcagatgcaaacacatatatatacaaatacagaaatagatctacaaatatcaatatagctccatattgaaatacatctttgaacacaaacgtgtccatatgcaaatggataggtgtgtgtgtgtattaatcatacacctcaaatgcatttgcaaatgcaaacgtgcacaaatgcaaaagctatgggattccacagatgaatcaaaatgcatattcatgcgtgcaatacacgtagatgttccaatgtacaaataatgacaaatgctgtgtgtttgtaggtgtatgaacacatgcaaatacttgcgattgtacaattccaaatagaaacatataatatatacatacactgtatgcagatacacatgcaaagatgtaaatgtgtatggacatgtatatacatgtgaataaatgtgtacacatgcaaactcatgcacatgtgcatacaacacatatgtaaaagaaaatatgcacaaatttataggcatttgaaaatgaatctgcatgtaaagacgtgaacacatatgtacatgctaacatatatctctataggcatatatctttgaattatgcatacatgcagttatatacccaagtgtatagctatataaacacatttacaaatgcgtatgcatatatgtatatgaatagacgtgcctgtatttgcgttacgtgtagatagatacagaattccaggtacatatataacatgcctatgtatacacatctacattatccatgtacatacaaatacatatctacattggcattaatatccaagcaaactggtctgctctaagtacaaggcagtatggttcgtgcgtgtttctaggacaagtcacctttgagatcaggcctccacagcaaggacttcagggcaggcgctcagccgggcttggcctgacaggggtgggctgttctgtgtctggtagatagaacatgtcaagcacagaacctgcggtgatgatgatgtctatagaatgatgaccgacagggctgccctgtggtctaggggtgaggacaggccatgtttatactgaggtcggcatttctcaaaggacatctgagcagtttgtttgtgggatactcagtgaagagggggtgccatagcagctatacttgtccagaattctggggggagacaggatctctgttgcccaggctggggtgcagtagcacaatctcggctcactgcaacctccacctcttgggctcaaacaatcctcccgcctcaacctccccgagtagctgggactacaggcacgcaccaccacacccactaattttttgtatttttggtaaagatggagtttcactgtggtgcacagcctggtctcgaactcctgacgtcaagcagtctgccctactcacctacccaaaggctgggattacatgtatgagccatcacacctagccgcccagaataattaattgtccaggggactctgtttggtgacttggatgattctcactctcttgtgtgtgttgctgtgttatcattgtggttattatttttcttttccttttttttttttttgagatggagtctcgctctgtcaccaggctggagtgcagtggcatgatctcagctcactgcaacctccgcctcccaggttcaagcaattctcctgcctcagcctcctgagtagctggaactacaggaccctgccaccaaacctggctaatttttgtatttttactagagacaagggtttcaccatgttgggcaggctggtcttgaagtcctgacctcagatgatccacccgccttggcctcccaaagtgctgggatgacaggcatgaacttctgacctcaggtgatccacccgcctcagcctcccaaagtgctgggatgacaggcgtgagccaccgcgcccggcctgtggttattatttttaaactcaaggcacagaggtgcagagacagaaggcaggaagggacttcagtgatcttctagaatcttctccatcacacctaaagcaggaaacagaggcccaggaggaagacatggccgccagctctacaccccaccctccgatgtcctgggccatttgcgcatctggggaatccatctgtgagatttctccactgtcttccccagtctaactccttctgatattctcttttgtccagctggggtgatgatggtccctcagaggaaaaccagagatggattcgaagaacatttcggcctgaactacctagggcacttcctgctgaccaacc

SEQ ID NO: 2891 - DNA, 281462 bp, human
gcgcagagtcccgcgggcggcgcggaagcggcggcggcgcggccggggcagccatgtcgccattgtctgcggcgcgggcggccctgcgggtctacgcggtaggcgccgcggtgatcctggcgcagctgctgcggcgctgccgcgggggcttcctggagccaggtcagcggggcggggcaggggtcagggctccggggacccgggtgggcgcgggctggctcgggggcgggggcgcgggggctccgcgtgaccttggcgaggcggtggcgctcccggaagtggggctgggcgggggtcgaggtgtggccgggggtggggggggggcggcgtgcgcgctgggacctccccgccccgcgctttccgtccccgccggctcttctgcgcgcctggcccggcccgacccggcccgacccttccctccccgcgcgtgtggcctccccgcctgtcccgggtcgggctccaaccaagcagcccccgtgcagccgcccccccgcgcaccctgacacctccgggccatggccggggacccgggggctcgcacgccccgcgcccaagacatcaggcggctctgcctgccgcctgcggtcggccagtgaccgcgcgcccccgccaggccccggaggggaggagcgggcgtcccagggacctcgacccctacccaccccagggtaagtgaggatgggcccttctccggaggacgtctccagagggggcccagaggcggcttctcgggcactggggagccacggaggtctggtggggagggcaggcccgttaagtggcaactttgtttccttggcctttgtaaacatctctgagtcacagatctccaactttgcaggactcgttcactgtctgaactcatcagtgatgaccgccactgtgttttgtgtatgcagataacttctgttcctagatttgcaggttcagaatttattattattattattttttgtaataggaagtagagatgaagtcttgctctgttgccgaggctactctcgaactcctgggctcaagcagtcctcctgcctcagcctcccaaagtgctggcattacaggcaccagctactgcatccgactaatgttttaaagttttgtagacggggtcttgctatgttgctcaggctggtctcgaactcctgggctcaagcgatcttccttcctttgcctcccaaactgttgggattacaggtgtgagccaccacacctgtctaatgttttaatttttttgtgtagcaatagggtcttgctacgttgcccaggctggtctgaaactcatgggccgaagcaatcctcctacctgggtcccccaaagtgctgggtttacaggcgtgagccaccacgcctggctaatgttttaaattttttgtagagatggcatctcaccatgttgcccaggctggtcttgaacccctggcctgcagcaatcctccagtctgggcctcccaaactgctgggattacagacagagcgccactgtgcccagcccatattctcaatttaaacctagaaacctgtaaacaattatttgtgaactggaataaagggaatgttaattccatgttaggttaaatgatactttgtttcaaaaataacagttttccaaaacagagcgttcagagggtcagtgtggtgggggtgggggtgtacgttgccctgaatgtcttaaatgtccagcctaagaagagagctgttatttctgcctctgtagacagtttcatggcatgtcaggaggcctctggaagacactactgcacgcctctgggagactgggagtcagccaggcgaagcgcttgggtgccttattgtgaaatgacttttgacttccactctgcacccactgaaggaatcccaggggtcccagcgccaccctttgagaagcgtgcctggagtggatgttttaaaatgagcctctctctcccgcctctagccagagaaaaagagctttgagttttctgtgagctaagcttttctttttctgccaaactggccttcagtatttttttttaaacccacttagcataattacaaatgcatagaagaaggagagtaaagggaactgtagtcaggctttcggagggcaggagagcatgtttgtttgaagtaagtaatcagttgcaaggtgaacggtttacagctgctgaacaattgtgtggagtctcgcagaagattatgtttatccgggcagttttgcttacagaaaggtccccttaaacctccttaagggcctgtgtgggccctggcagaagaggccggggttcctgcagcagctcaccaaaatgctggcctttgaaaaacttgctctttgtgcattagaaaaagggctggaatcttttttttttttttttttcccatttactgattaaacaacaacagaaggttgttaaagaggacgagcttctggtgaagtcacgtgtctgccaagggaatctgtacccgggtgtgtatcgaaacagaatggccttctctaaagattaacttaagtggcttgccctcatcgagccccttcctatgtatggattaaaaataattttcgataccagtggaggaatgctgttgtccttggtctgctggtggccagcttcctaaacggcattttttatttgcttctctctggtaggccttcgctgttggtgaggaaacattgaactttgtccagggcatttgagctaagctgtttgaataaccaagagggccaatttccccactgcagattggaagcaagggcagttttttcttagaacttccaaatggagcgtgttcttcttaggtatcgtacaaaggaaatgcctgggttacaccttccacatgagttgacttacatggtatgagaaggaagaaattgtggctggaatccactcctaaatggtgtcttcttacagttcatcatggaaaaacaagataattacaaattaatcatagatgttggtcatgcctttacagagggggtttagaagcaaattgagaattcccataagagggtctgtctctgtgttcttaagactatatccatgcggcccattcagtaagttgtatctgttggttggattttaaaatagatgatttaatcagtgcatttaatatcctaatatggcatcaaaacttgaacattgatatggcctgaaatctgttgaaaatgatcatattgagtaaagaaagtctctacccaccggtattaataacagggtgatctgtttagaaattacattttctctgatacatcaatgagttttgcaaaggagagaaaattgatggtacctgtagtcaagtccagttccaatactgccacagaatttttcttaaaagttctattgtaaataataggccacagaatattccttcactttctgggatgcaaaatggattcgtaaatgctgtaccacaggagtgagtatttacaaaaaatatgccaactggcccacttacaaagctatttatagaagtcctacttttcaaactattttttttttaacctgtaaagggaaagttaattcttgttggttttatgagtagtgaacagtggctattagaaatcaggtagaagtaaaaacagcagttttccaacttcttcttctttttcttgagaccaagtttcgcttttgtttcccaggctggagtgcaatggcgtgatctcagctcaccacaacctctgcctcccgggttcaagcgattctcctgcctcagcctcccgagtagctgggattacaggcatgtgccaccatgcctggctcattttgtatttttagtgagatggggtttctccatgttggtcaggctggtctcaaactcctgacctcaggtgatagtccaccttggcatcccaaattgctgggattacaggggtgagcccctgcccccggcctccaattccttgatcatagaatctctttcaaaaaaaatgaggaccccagacagtttttgtttttgtggattataacagtcaataagtcatcctgttagacattaaaacagaaatttaaaacatatttaacaatctatttaaaagtaatggtaacaggccaattacatgttacatacaaaaatgtatgtaatatatttattgtttttatattttatttttattaaatatatatatttttagaataatttatacttttctataaatataaaatacaaataagttatatttatataatttagatgtaaataaaaacaattgatatttttatataaatatataaatgtgtacacttatggggcacagtgtgatgctttgctgtatgtttgcattgtggaataattaaactaatatctatcacccgctatttttcctttgcggtgggaacatttaaaatctcttttagctatttttgttttttatttccataggttattggggaacaggtggtgtttgattccatgagtaagttttttagtggtgatttgtgagattctggtgcacccatcacccaagcagtatacactgcacgcaagacatttaaaatctctattggcgggccgggtgcggtggctcatgcctataatcccagcactttgggaggctgaggcgggtggattgcctgagctcaggagtttgagaccagtctgggcaatacagtggaaccccatctctactaaaatacaaaaaattagctgggtgtggcagtgtgcgcctgtagtcccagctacttgggaggctgaggcaggagaatggtgtgaacctgggaggtggaggttgcagtcagccaagattgcgccactgcactcaagcctgggcaacagggcgagactccgtctcaaaaaaaccaaaaaaacaaaaaaacaaaaacaaaaataaaaacctcttttagctattttgaaatatgtaatacactattaactatcgccaccacgctgtgcagtaggtcactgaaacggattcctcctgtcgaacagaaacttggtaccctttggccatgtgctgtatgttttttaaaagaaaaatgattgtcatttccaaaataacaaaaacctagggagaagagtggctgagttttagggttttgtcagtctcatccataaagggacggatggcggctggctccttcctctgcttcttcacactggtctcttgcgacgtgtcgttctggtaagagtcatgtgaggcacatccactggcctctcatggatgtgcaattggaaacgtgaaatcgccggccccctgagagcgttttggggagtgtcccccccaaacccccctccccccgcactggggatgctgcaccagtcttgaagaatgaggcagtgagaggctggtttacagcaacctttattcgtggccttgtgtgctcggaagcgctgcaagggaggaggaaggaggaaggagggtactcactgcagaaggtcagctctgctgtggctgttacgtgggttcaggtggaacccacctactgtgtggacggttctttacctgggaatcccatggaattctgacagcaggagacgtgggagggagcttcttgtttctccttccaggagtcacttggttaggggtttgggaattttggctcttagtacaaaacttcactccaggtactagacctgtttcagccaaatgatgatcatcataatagaatagaaacctttgttcacctaaataataacaataatattaataataatagaatataaacctttgttcatggtactggggcgtctttcagcccaataataataacaacaataggaataatgataataatgataaaatataaacctttgcttcacgtcctggaacgtctttcagccaaataataataataatattaatgataatagaatataaacctttgttcagggtactgtgacttctttcagcccagtaataataataataatagtaataatgataataatgatagaatataaacctttgcttcatctcctggaacgtctttcagccaaataataacaataataataataatgacaatagaatataaacctttgttcagggtactgtgacctctttcagcccagtaataataataacagtagtaataatgataataatgatagaatataaacctttgctccaggtcctgggagctctttcagccaaataagaataataatagaatataaacctttgttcacagtaccaggacctctttcagaccaacaataatgacagtaataataattataatgataatagaatataaacttttcttctaggtactgggacctctttcaaccaaataataatagtggaatataaaacttggctctaggtaccagaaccttttttcagccaaatagtaataataagaatagtattaatagaaaacagacctttggtccaggtactgggacacctgtgagccaaataataataataatgataataatagaacataaacctttgactgaagtgccagaacctttttcagctaaataataataataaaatataaacttttgttccaggtacccggacttctttcagcctaataataatcatagaatataaacctttactacaggtcctggcacctttctcagccaaatagtaataaaatagaatataaacttttgttctgttactgggacctctttcagcctaataacaaaagtaataataatagaataaaaacctttgctccaggttctagaacctctttcagcctaataataataataatgatagaatgaaaatttttgttccaggtgtcgagacctcttccagcctaataataataataatgtaataatataagcctttgctacaggtaccaggacctgtttcagccaaataataataacagcaatgataatagaatataaaccttggccccaggcactgggacttctttcagtcaaacaatcacaataataataataataatagaatatggatgtttgctccagctttcaggacctctttcagacagataataataaccgagtacaaacttttcttccaggtatcgggacctcttccagcctaaaaacaatagtaataatagcatatatatctttttttttgttttcttctttctttgagacggagttttgcgcttgttgcccaggctacagtgcaatggcgccatctcggctcactgcaacctctgcttcccgggttcaaacgattctcgtgcctcagcctcccgagtagctgggactacaggcatgtgccactaccacgcccggctaattttgtatttttagtagaggaggggtttcaccatgttgtccagggtggtctcaaactcctgacctcagatgatccacccaccttggcctcccaaagtgctgagagtacaggcgtgagccgctgtgcctggtgccagcataaaaatctttgctacaggtactgagacctttttcagcctaataataataacaaccgtaacaataataattagaatataaacctttgttactggtactgggacctcttccagcctaatcttcataataataaaaataataataataatggaattgaaacctttccttcaggttccagaaccgctttcagccacataataataataataatgataataataataataaatagaatttaaacttttgtttgaggactgggacctctttcagcccaatagcacaaataataataatggaatgtaaaccttttcctcccaattaccaaaacctgtttcagccaaataataatatgatgatgatgatgatggaggatctgatacagctgtgtcctgtcactcaggtcggacttaggaggcctcttgagattcttttccccctccgttgactgtgtaatccaggggccccaccctaactcggctgcagaagatgcagtttgggggttcctcgttttgtggaagtcccggtcatgttattcattctctcagcaccttagaacaaaccagggtgctggcattggccacaggacccccctccttgcaccccagtcttgggaagtggcactgctgggctctggcaatgcccagctcacctggcacgtggcggcgtctccctaaaaagcactgggcgggcaccgttgacggaaagccagcaacgcaggccgcgactgcccgtgaagacggggggcctttctaagacctccactcattatttcgggcaaaattaaccttcagaataccttgctttaataaagtaccagaaaccggagggcttaaaaccatagcttattctctcccagttctggaggccagaagtctgtaatcaaagtgtctcagggctgcgctccctccggaggcttacgcggagggtgcttcctgcctctcccagctcctgggggctcctggcgtccctgggcttcaggccagccacatcatcactctagtctctgcctctgtctccatgtggccttctctgtgtctgtgtctcctcttctgtcttttataaggacatctgtcactgcatttagggctcactcaaatcccggatgatctcatctccagatccttaactcatgagatctacaaaatttctaataaccaagtaagatctcattccacatcctgggctttaggctgtggacagatctttctgcgggccactgttcaatccaccatgattttatccagttcattgtggaggctctagaggaggatccttcctgcctctcccagctcctgggggctccaggcgttctgggtttgtggccgcatcactccagtctcggcctctgtctccatgtggtcttctcctgtgtgtccgtgtctcctcatctgtcttctattaaggacactggtcactgcatttaggaccacctcaattgagaataatctcatctaaagatccttaccttcattattaatacatctgcaaagaccctttttccaaacaaggtcccatacacaagtaccaggtggatacagattttctttggtaggggaggacgcttttcaacccactatagtcatcattgaaatatgcctccttgcactgactgtatcccaacactctgaacgtgcctgggtggtgcattttgatatttaccctcctgagcactgtactggacacttggagacacaattacaccttttaacaaagcccagctgtcattttgggcaacccagtcacagaggtggcctcctgagtggcagctggaagggcctgtatgtgtgagcattcaacctcaacaggaaccctggggactggcttctgggtcatctaagcctccacaccgactgcctgatgtttgcacaggtgtgtgatatttgcccagttgggcctttctgcccacaggtgtgactggacacaatgggcattttgagaagttccagggattgagaaatccatgcttcttcagacgtgcttacagatcacggatgcacctgtgacgttccacatggcttcattttaaaccataaagtttgagaagagtgtgcagtgcctcttagccataggaaagctggctttagtcagatggaggtcctgtttggcttctttaatgcagtgaatgaagctcaggtggcattcagagagtcctgctgtgatggttggcagtggggggtctgcctggccacttgtggattcttctatgtaggcttcatccccagaaaagatctacgcagctttcccacgtggcaggtgcttgggaaactcttaggacaggaacaacaagcccctgcgatgacagaggcattgtcaggctgggcgcggtgactcacgcctgtcatcccagcactttgggaggccaaggcgggtggatcacctgaagtcaggagttcgagaccagcctgaccaacatggtgaaaccctgtctctactaaaaatacaaaaattagccaggcgtgatggcaggtgcctgtgatcccagctactgaggaagctgaggcaggaagatcgcttgaacccgggaggcggaggttgcagtgagctgagatcacgccattgcactgcagcctgggtgacagagcgaaactctgtctcaaaaaaaaaaaaaaaaaaaaactaaaggcacttgtcaggtacagccctgcaaaaatgccgtgctcactcgcaaacctgtatgttgacacgtgcggcatcgctgcagtcggattaacgtggaagaaagagcgtattcctgcgctaggttccctcctccactctgcaaaagtgacccgcaaggaaggtccagccgtccggccccagtgccctttggttgaaagcggagctgccccggcaccctgtctgtctccccggcagggctcccgtgcgtgcctgggtcccttctcatgctgtgtttgtcttggcccttctcagcaggtccccacgcatgagcagccgtccagcaggcaggctccggtggagaagcaatggagaataaaagcctggagagctcccagacagacctgaagctggtggcccacccccgcgccaagagcaaggtgtggaagtatttcggcttcgacaccaacgccgagggatgcatcctgcagtggaagaaaatctactgccgcatctgcatggcccagatcgcctactccggaaacacctccaacctgtcctaccacctggagaagaaccaccccgaggaattctgcgagttcgtcaagagcaacacggagcagatgcgtgaagccttcgccaccgccttctccaagctgaagcccgagtcgtcccagcagcccgggcaggacgcgctggccgtcaaggccggccacggctacgacagcaagaagcagcaggagctgacggccgccgtgctgggcctcatctgcgaggggctgtacccagcctccatcgtggacgagcccaccttcaaggtgctgctgaagacggccgacccccggtatgagctgcccagccggaagtacatctctaccaaggccatccctgagaagtacggggccgtccgggaggtgatcctgaaggagctggccgaggccacctggtgtggcatctccaccgacatgtggaggagtgagaatcagaaccgcgcctacgtcacgctggccgcccacttcctgggcctgggcgcccccaactgcctgtccatgggctcccgctgcctgaagaccttcgaggtgcccgaagagaacacggcggagaccatcacgcgagtgctctatgaggtcttcatcgagtggggcatcagcgccaaggtcttcggggccaccaccaactatggcaaggacatcgtgaaggcgtgctccctgctggacgtcgcagtgcacatgccctgcctgggccacaccttcaatgccggcatccagcaggccttccagctcccgaagctgggggcgctgctgtcgcgctgccgcaaactggtggagtacttccagcagtctgccgtggccatgtacatgctctatgagaagcagaagcagcagaacgtggcccactgcatgctggtgagcaaccgcgtctcctggtgggggagcacgctggccatgctgcagcgcctcaaggagcagcagttcgtcatcgccggggtcttggtggaggacagcaacaaccaccacctcatgctggaggccagcgagtgggccaccatcgaggggctggtggagctcctgcagcccttcaagcaggtggccgagatgctgtcggcctccaggtaccccaccatcagcatggtgaagccgctgctgcacatgctcctgaacaccacgctcaacatcaaggagaccgactccaaggagctcagcatggccaaggaggtcatcgccaaggagctttccaagacctaccaggagacgcccgagatcgacatgtttctcaacgtggccaccttcctggacccccgctacaagaggctgcccttcctctccgccttcgagcggcagcaggtggagaatcgcgtggtggaagaggccaagggcctgctggacaaggtcaaagacggcggctaccggccggctgaggacaagatcttcccggtgcccgaggagcctcccgtcaagaagctcatgcggacatccacgccgccgcccgccagcgtcatcaacaacatgctggccgagatcttctgccagacaggcggcgtggaggaccaggaagagtggcatgcccaggtggtggaggagctgagcaacttcaagtcccagaaggtgcttggcctcaacgaagaccccctcaagtggtggtcagaccgcctggccctcttccccctgctgcccaaggtgctgcagaagtactggtgcgtgacggccacgcgcgtcgcccctgagcgtctcttcggatccgccgccaacgtggtcagcgccaagaggaaccggctggctcccgcgcacgtggacgagcaggtgtttctgtatgagaacgcccggagtggggcagaggcggaacccgaggaccaggacgagggggagtggggcctggaccaggagcaggtgttctccttgggggatggcgtcagcggcggtttctttggcattagggacagcagcttcctgtagcgaggaagcgtgttgtcttacaagtcatccccgcagcagcccattggatgctttgctgtaaatacttacccggtcagcttggttttgaacctcagagaccatccactgtctttgacacctagaaggtggaaaaaggaaagagatttgagaagtgagagagggtcgggggcggtggctcctgtctataatcgcagcactttgggaggccgaggtgggcagatcagctgaggtcaggagatcgagaccagcctggccaacatggcgaaaccccgtctctactaaaaatacaaaaattagccaggactgatggcatgtgcctgtaatcccagcttctggaggctgaggccagagaatcgcttgaacctgggaggtggaggttgcagtaagctgagatcgctgcactccagcctgggcgacaagagcgagactctctcaaaaagaaaaaagaagacacaagagaggtggctttgagtgggtttcctttcctcccctattcccggggcccggacgacttctgcttgggaactgccaacgcttctgcttgggaattgcgtgcagcagagcctagaggagctgttccttccttcacagatacttaagacctccaccatgtctgattcgagttctccctgggagggtttagaagaaacgcaggaacattctgggtggcgtcgaaggagcctttcccgatcatcatgtgtgacttctgcgaggtccagatcactgaattcatgtttacattctcgtgcaagcagggacctcttgcttctgagaaatggggaagagaccttttagccaaaatgcccttcttaaaaagagagacctttttttttaatgttcggttaaaaatgtgacagatgagtacaaaaatgcagacacttaacaaaaagcaaacagaaaaaaaagtgtggaatgtgttgtattttcgacaggttgctgccagagagcctgcttcctgctgcctgccgaaatttcactttgcggagttggtccttaaaactgggcggtggccgggcgtggtggctcacgctgaggtcaggagttcgagaccagcctggccaaccaacatggtgaaacctcgtgtctactaaaaatacaagaaactagccagatgcggtggcacccgcctgtaatcccagctactcgggaggctgaggcggaagattcgcttgagcccaggaggtggaggttgcagtgagccaagactacgccactgcactccagcctggaggccagagtgagactccgtctcaaaacaaaacaaaagtgggtggctcacgggtccggaggttatgtcttcggtgtctcagccctaaaagtccagttcccccgtgcggccagcttttccacataaggtgtttttgatttgattaccggaaaggactcttgattcttctcttttaaactgaataccataggggaaatgaattttaaaatattgcccccggaggggttttccgtggctggattcctgcgagttgctttcagtcattcagggaaacagaaagacgttttccaacatgtagaactgctttttaactggaggaaaaatacttcaggaggcttagcatattgcttggattctacgtgcagcgggttctctgcctccgtgaagacaagctgggctggggagaacggtgtctaggagggatgaccccactcagctccaggcagtgttctgccgagaccccaagaactcggggtgtcagagggcaaaggaactacctgcctttcacggctgctgacttctcagggctgcaagcagcacagaatgttatccttacgtcctgagccggtttaagtctgtggaaaaggaagcacgggagaaatccacgtaacctttgctttctttttaagggaagcggttccgccgtgaacttggaaccctcagctccgggtgttctcggcagaagggcagctggaagggacacagtggggcaggctttggggttgctccctgttctgccccgaggccggggacgcagggcagcccacgcctccgtgggctccattctgtagcattgccagcgttctcttcacgtctctaacaatccttcgcttttcctcactcacgtggaaatgtgaactgtcccggctctgtcttcatttttatttttaagccatcgttcccctcctgaacggttgccccttatttaatgctgtaaagttggactgttgttcaataaaccagagcaatgcattagctcctcattcatttgtctgccgcgtgtccgtctggactgcagtttgtctgaaccccttgatcctgggagtggagggaggtttatcattattattatttttatttttgttgtggtccttgttgaaagcaactttttccagggcacccacggtcagttctgtgctcctctttcttgtctgtaaatcctcaagttatgatgtactttcgggtgttttggcatcaaaatttctgagtgaataaagccggcagctggtgaaagtgttccccgggagcagagatttttgccggttccttcacttagtggatagttgtataaacggaggccccatggacgaggcagcctggatggatccggatggcatcagcgccttccctctccccccagcctccttatcacccctctcttcctgtcttcctcacctcctctcacatggtctcttccttccctcctccttccgtccaaccctccctctcttcttcagccaacaaatccttcctttcttccttctttccttccttccttccctcccatccttgtctcttcttctctcccttccttccctcccttcccttctttctttctctcccttccttccttctctcccttccttccttctctcccttccttccttctctcccttctctcccttttctcccttccttccttctctcccttccttccctcccttctctcccttttctcccttccttctctccgttccctccctcccctccctctctgcctccctttcctcccctccctccttcccccatccctccctccctccttccctctcctccctccctccttccttccctctgtccctccctgtctccctcccttcctccttccttcctttcctccctccctctgtccctccctcccttttctccctccctcccttcctctttcgttttccttccatccctttttccttcctccctccctcttttcctccctcctgagaaaacaatggcccccaagaaacacaggaaggccgggatgtgcacctctgcccagacttgccctttccaagtgctgttggttgactgcctgtccttgggcatcattaaaatgccgaaatttctctttcttgcacgttttgggttgaaaggggttcattttcagtcctcataactaagcatttgcatcgtgatgttcatttaagtgggacatgtttacacgtttttcccattaggagtaattctagtccttgagggtttcttacagagacatttccctaaccccgacggttctcatcccagcctgtgtggcactccttccgcacagtggtgggatttttcggttcggttttgttttcacgcttgcatctggctgcacagccctaactctgagctggttgtttttgtttcccccccactttgcagaattgcctgcttcgaactgttttcccagcaggcctctgaagggtgaggaaaacagcttggggaaagtgagaaaaaggtttcggatgttttagtaaagaggcagctggtgggaaggagccggttgggctgtttctggggtgccgaaatctcggtggtgacgttcatttgctcgtgagtgcagaggaggcccagagaccgggttcctggcgcagccagctcctgcttttgttccgaccatcttcctgcgccttctgcgagtctcagatgtgcttgggcagcagttctactgttttcccctctgtgatctcaggcccgccgccccgtcctttcccagtgatttctgctccgtcaaatcgtggggctcacctgagagttttataaaatgaactcgccatgcccctgcctggtgaacagagaatgcaaactctcacaggaccgtctgcagcaaaacggcagtgttttgctcatttcttcagacgacgaaaacagcagggtttggctcgtttcttccagattttctcaaactgcatgagttcctttctgagcaacttctgggaagctttcgggtttcagggctttgcagccaggctccttcctagctgcggctgcctgtccttttgtgttgcagtcagatgcgggaggtccttggcatgagtaccctgatggtgtcaactttaaggggtcagagaggaaatatttttggctccgcggaccatgcattctctgtctctcaacaacttagttttgccgttgtgtctaaaagcatccattgctgggtgtggtggctcacatctgtcatcccagcactttgggaggccgaggcgggtggatcgcctgaggtcaggagttcaagaccagcctggccaacatggtgaaaccccatctctactaaaaatacaaacattagctgggcatggtggtgggcacctgtaatcccaggtactgaggctgaggcaggagaatcgcgtgaaccagggaggcggaggttgtagtgagctaagatcgtgccactgcgctccatcctgggcgacaagagcgagactccgtgtattccactcccacttcgtgggcactaaattttatataaatgttgtgtcaagaaatattattgctctgttgacttctttttttcccccaaccattaagaaattcagaaaaaaaatgtacgaatgtaaacactgttcttggtgagtgggccttccaaaaataaccgctggactttgttgaaactacttttttttttttttttttttgccactttttcccttttttttctcgaggcaccaattggaatccacttatttgtcctggtttgagaaacagctcagatcgcacactctgggctctgtgtttctttaggtaacacacgtgaggtttttgtcactggaattcagtaatctgtgttaatattatcacaaaagaaccggggggcatttgtgtcttctcagaattgctgattaaaacagctgcatggccaggtgcagtggctctcatgcctgtgatcccagcactttgggaggccgaggcaggcggatcgcttgagcccaggagtttgagaccagcctgggcaacatggccaaacctcatccctactaaaaatacaaaaaattagccaggcatggaggcgcatgtctgtagtcagtcccagctactcaggaggcgaaggtgggaggatcacttgagcttgggagttggaggctgcagtgagctgtgaacataccactgcactccagcctggaaaataaagcaagagatgctgcctctaaaaataataataataataataaaaattagccaaacatggtggcacgcatgtgtgatcacagctacttgggagactgaggtgggaggatcgctggagcccggaaagtcgaggctgcagtgagctgagattgcatcactgtcgtgcagcctgggcaaaagagtgagaccctgtctctaaataaataaataaatgagttcacgattaagcagaagttgtgcttgttctgccaggatttcagttgggttctttgtgccctaatttacgtgagctagtaggttgtgcgttatcttagagggcttgcatgaaagaaagagggtagcctttcttttccctgttttggtagcattgctgaggtggcttttggctgacgggtggacccgtgggtgcagatgttttgatgcagaaggaatgattgccttttcacattcaggctccaactggcttttagcttgtgcgttcttaccctggggtgttcgaggtcaccggactcctattttatttgtgtttaactggaaaggcaggaactctgagaacgtatcaaataggcagttactgcaggatttctagaatttaaattgcttccaaaactgtatccacaagctaagaattatgtttaggttttaaaaggtgttggtttgcttcttacatgtttaaattcttgagggaaagaaatgcaaagaataataaagtttcatgatacaaaaatggtatgagaccgggcacaatggctcacacctgtcatcccagcactttgggaggctgaggcaggaggatgatttttgagcctgagtttgagatcagcctgggcaaacagcgagatcctgtgcctacaaaaataaaataaaaataggctgggtgtggtggctcatgcttgtaatacctgcactttgggaggctaagtcagtaggatcacttgaactcaggggtttgagaccagcctggtcaacatactgagaccttgtctctagtaacaataaaaaaattagctggacataaggtgtgcatttgtagtcccagttacacaggaggctgaggtgggaggatcacttgagccagggagttggaggctgcagtgaaatgtgatcgcaccactgcactccagcctgtgcaacaaggagagagatgctgtctctaaaaaaaaaaaaaaagccagacgtggtggcacacgtgtgtggtcacagctacttgggaggctgaggctgaaggatcgcttgagcccaaggaggctgaggctgccataaactacgatcatgccactgcactccaggctgggcaatagcctgggcgactgtctcaaccaaaataaatttaaaaagataggaaatttcaatgtgaaaatcagtgtcccccagaacgttccatttcttcccagctgggctatttttggagttccatggggagccggctcagtgcagtttgcatgtactcgggaggatgagccctgccatggtgtgtgttaggggacagcctgatctcaccaaccctcctgagcaggcccagccctccgagtaataactgggaacactcgccgctttgtgagacgacctcgtgtgctcactggaaggtcatctcttctggtccatgctgcagtgtggataccattttttttttttaagacagtttcactcttgttgcccaggctggagtgcaatggcacgatctcggctcacagaaacctccgcctcctgggttcaagccattctcctgtctcagcctcctgagtagctgggattacaggtgtctgccaccacagccagctaatttttatatttttcgtagagacggggtttcagtacattggtaaagctggtctggaactcctgacctcaggtgatccacccgcctcagcctcccaaagtgctgggatgacaggcgtgagccaccgcgaccagcccagtgtggatacaccttgagcacataactggaatcctttccttggaaacttggagccccttgtgtcatggtcatataaactgttgaattaagaggagacaccattaaatatgtcacagctgtcctcgaaactgggacttgttttgctttctgcctggaaatgcgagctatctttatagaattattttatagaaaataattgtatacatatataggaggtacgacgtgatgttttaatccgagtacacattgtgcaatgattaaatcaagctggttaccatattattaacctaattaacatatcaataatcaagctaattaacacattaacattcaagctaattaacatattaacaagctaattaacatattcacataatcctaactctgacctatatcacctcacctacttttttttgtggtgagaatgtgtaaaatctacttttagtcattttgaaaaacgcaatgtattattattaatgataatcactgtgtggtgtggtagaactttgaatttatttcttctatctaactggaaaaatttaattttaatgtaatttattttttttgagacagtctcaccctatcacccaggctggagtgcagcatcatgttcatagctcatggcagcctccaactcctggctcaggtgaccctcccaccacagcctcccaggtagctgggactacaggtgcacaccaccacacctggttaattttttaagttttttgcagagatggggtcttgctatgttgctcaggctggtcttgaattcctgggctgaagcgatcctcctgcctcagcctcccaagtagctgggactgcaggtgcatgctaccatacccagctaatttttttttttttttttaaagatgcggtttcattatgttgcccaggcttgtctcaaactcttggcctccagtgatcctccttcctcagccttccatagcattgtgattccagacatgagccaccgctcctggcctccaactgaaattttatgttctttgacaaacacttcatgaagcattcttccctggcaaccaccattgcactctctgcgtttatgcgttcagcttttttagattctacatacgagatgatacagtatttgtctctctgtgcctggttcatttcacttcacattgtatcttccagtcccatccatgttgctgcaaatggcaggatttcctttttcatggctgcatactattccattgtgtgtctatgccacatttgcttgatacgctcatctgttgattgacacatgggttgattctatatcttggaaactgttagtagtgttggcagtgcacagggggtgcaggtatcccattgatgggctgatttcctttcctttgggcacacaccaagcggtgggatgactggatcctgcacaacattctttcctttggtgtttcgcaggcccgtttctggactttagtgaacgtcttcccagtgtccatggcgtccgtcccttggccacatgcttagggaacatcttcagtgtgtacatggcgacagtcccatagccacattcttagggaatgtcttcagtgtgtacacggtggcagtccctttgctgcatgcttagggaacgtctacagtgtggtccattggccacattcttagagaacgtcttcagtgtgtacactgtggcggtcccttggccacattcttagggaatgtcttcagtgtgtacatggcggcagtcccttagccacatgcttagcgaacatcttcagtgtgcacagggcagtggtcccttgggccacatgcttagggaacgtcttaagtgccgtcccttggccgttttcttagggaatgtcttcagtgtgcacatgtggcggtcccctggtcgcattcttacggaatgtcttcagtgcgtacacggtggtcccgtagccacatgcttagggaatgtcttcagtgtgcacagggccatattcttacggaatgtcgtcagtgtgcacatggtggtggtcccttggccacattcttagggaatgtcttcagtgtgtacgtggcggaggtcccttagccacaagcttagggatcatcttcagtgtgcacagtgcgggagtcccttgggccacatgcttagggaatgtcttcagtgtgtacatggtggtggtcccttagccacatgcttagggatcatcttcagtgtgcacagggtgggagtcccttgggccacatgcttagggaacgtcttcagtgtgtacagggcagcagtcctttggctgcattgttagcgaacatcttcagtatgtacatggctgtggtcccttagccacaagcttagggaacatcttcagtgtgcacacggtggtggtcccttgggctacatgcttagggaatgacttcagtgtgtacatggtggccatcccttggccccatgcctagggaatgtcttcagtgccttgccttggctgcattcttagggaacgtcttcagtgcgtacatggcggtggtcccttagccacatacttagggaacgtcttcagtgtgtacaccgtggtggtcccttggccacattcttagggagcgtcttcacttcttacatggtggtggtccccgggccacattctaagggaacgtcgtcagtgcctacacaatggtggtcccttggccgcacgcttggggaacgtcttcagtcacagccctggttggtcccttggccacattcttagggaatatcttcagtgcatacacggtggcagtcccctggtgtcattcttagggaacgtcttcagtgcggtccctcaaccacatgcttagggaatgtcttcagtgctgtttcttagccatattcttagggaacctcttcaatgtgtacacactggtggtcccttggccgcatgcttagagaacatctttagtgcagtcccttggccacattcttagggaacgtcttcagtgtgatcccttggccacattcttagaaaacgtcttcagtttgtacaaggtgacagtccattggccagaatgtgtccctgccacattcttctgagtgtctgtgtctgtgttctttccaccctgtaagctgcttttgcttcttcactgggtgtctgtgactctcatgtggaatccctttcctctgtcaccgcccatcccaggcacagtgagagacgcagccagcctgctcctctctgcacctcgccatcccagacatcctccagccaccgtgctgaccgcattcattccttctcctgccctgtccgcatccttcttcccctacacgtttgataccaagaaatggtctgaatcacagccaaggcttcatttgctttctggaactgcagctccccagccccacccagatcagagattcagaacctgaatcttcggatttctggagatgcccccatcctatcagagacttctagtgtgtttctttatatccgtgtagacttgggaggatgacaggagagaaaccttagaaggtggtctgtgcatttcccgggcccggggtggaaggggcttgtgtcctggctgcctctgtgcacctttcattcttttttttttttttgagacggagtcttgctctgtcaccctgtcacccaggctggagtgcagtggagggatctcggctcactgtaacccctgcctcccaggttcgagcaattctcctgcctcagtctcctgagtagctgggaatacaggcatgtgccaccacgctcggctaattttatatttttagtagagatgggtgttcttcatgttggtcatgttggtctcgaactcctgacctcaggtgatccatccgcctcggcctcccaaagtgttgagatgacaggtgtgagcccccgcgcctggccgcacctttctttcttgatccacctggttttaaactcacagataaactgtttccacctgtgacaaatgagtcatccaccttccatgtggtctggactttgtccctgttacaatattcctgtctcttgtttctggttttttgcatcccacatgttgtccctgtaacagtcctgtctgttgtttctggggtcacccgtgtggcgagctgactgtgccacgttcctgaggctggtgaggatgctgtgggcaccttaatcacggctgtgaacaaactggctagagctaggtgccatggagctttgcagtggacactaagtcgtggtacccattctttgatcagtgacggagccaggtgtcttattaggtcttggggatttgtggaagcccagagcagggaaacagcttctacattgaaaggaatccttctcacactcatgttggcatcgtgaagtccctgatttcctaagacactaccctaatattttaaaagacttacaaaaaatttagtaaaatattcctaatagcagcacatgtggtgtttttttgtttgtttgtttgttttcgagatggagttttgctactgttgccaaggctggagtgcagtggtatgatctcggctcactgcagcctccgtctcccaggttcaagggattctcctgcctcagcctctcaagtagctgggattacaggcatgcactaccacacccggctaattttgtatttttagtagagacgggtttttccatgttggccaggctggtcttgaactcccgacctcaggtaatccgcctgctttggcctcccaaaatgctgggattacaggtgtgagtctccacacctggtcaatcccattctttttcaagaatgcatagtattctgtggtgtatgtacaccaccttttctttatccagtctacgtggcgttgttttgaggaatggatgaaatgatttgcataaaaacagtgaatgctttctattggaatggtgtttgcctcctgggaaactgtggagtcattgcaattgcaatttcctagtagatttgattaattaagagcattgggaatttttggggtgcctgatgcactattacagatatttttttcacagtgtagatatctcagcatgaatatgtctgttttcttttcttttctttcttttttttttttttgagatggagtttctctcttgttgccaaggctggagtgcaatggctcaatcttggctcactgcagccaacatctcctgggcttaagcagttctcctgcgttagcctctggagtagctgggattacaggcatctgccaccatgcctggctaatttttttttgtgtgtgtgtttttagtagagacagggtttcaccatgttggcctggccggtctcaaactcctggcctcaagtgatccacctgccttggactccgaaagtgctgggatgacaggcctgagccatggcggccagctgtctgttttctttccataagaggtgctggtctcaccgtggctctgtgctgtgatgaaatggcattgtccaagttttactcctcacagcctgattttgtatgttaaagacgtcttccttggtgtgaatcaagtgggctgggcagagttaagggagccatttatttagaaggcgattagatcgaattatgtcttggtaattactgcagttacaccaccccattctttccgtggctctcctagctgggtttgtggctagtcatggaggtgccctgaagagcctcattttcccacagctgtaggaagtgtgtggtacacccacaatgtcttagcttttgtattagggaaggtcttcagtgcattcccttggccacattcttagggaacatcttcagtgtgtacatggcggcggtcccttaaccacattcttagggaacgtgttcagtgtgtacacggtggcagtcccttggctgtatgcttagggaacgtcttcagtgagtgtgatcccttggccacatgcctagggaacatcttcattgtgtacctggcggcggtcccttagccacatgcttagggaatgtcttcagtgtgtacacggtggcagtctgttggccccatggttagggaacatcttcagtgtgcacagggcggcggtcccttgtgccacatgcttagggactgtcttcagtgtgtacatggtggcggtcccttggtcgcattcttagggaacctcttcagtgtgtacatgtcggcattcccttagccgcatgcttagggaacgtcttcattgtgttcttggtggcagtcccttagccacatgcttagggaacgtcttcagttgtatacagtggggtcccttggtcattatgcctaggggaacgtcttcagtgccagctgcattcttagggaatgtcttcagtgtgcacatggcggaggtcccttagccacatacttagggagtgtcttcactgcacacagcagtggtcccttggttgcattcttagggaacatcttcagtgtgcacatggtagcagtccctcacccacattcctagggaatgtcttcagtgtatacatggtggcagttctttggctgcatgcttagggaacatcttcagtgcattcccttggccacatgcctagggaacatctttagtgctgtcccttccctgcatttttagggaacgtcttcagtgtgtacatggtggcggtcccttggccgcattcttagggaacgtcttaagtgtgtacatggcggcggtcccttagccacaagcttagggaacgtcttcagtgtgtatatggtggcagtctcttggccacatgcttagggaacgtcttcagtgccatcttttagctgcattcttagggaacgtcttcagtgtgtacatggcagaggtcccttagccacacacttagggaacatcttcagtgtgtgcacagcagtggtcccttggcctcattgttagggaacgtctttggtgtgtagatggccgccgtcccttagccacaagcttagggatcgtcttcagtatgcacagcgtggcagtcccttgggccacatgcttaaggaatggcttcagtgtgtacaccgttgtggtcccttggccacattcttagggagcgtcttcagtgccgtcttttggctgcattcttagggaatgtcttcagtgcgtacatgggggcggtcccttagccacatacttagggaacgtcttcagtgtgtacatggcagtggtcccttggccccattcttagggaacatcttcagtgtgtacatggtggcagtcccttaatcacatgcttagggattgtcttgattgtgtacatggcgatggtcccttggccacatgctttgggaacctcttcagtgcatacggagtggcagtcccttgtccacattcttagaaaacgtcttcagttcgtacacggtggcgatcccttggccacattcttctgagtgtctgtgtctgtgtcctttccaccctgtaagctgcttttgtttcttcattgggtgtctctgactctcatgtggaatccctttcctctgtcaccgcccatcccaggcacagtgagagacgcagccagcctgctcctctctgcacctcgccatcccagacatcctccagccaccgtgctgaccgcattcattccttctcctgccctgtccgcatccttcttcccctacacgcttgataccaagaaatggtctgaatcacagccaaggcttcattatctttctggcactgcagctccccagccccacccagatcagagattcagaacctgaatctttggatttctggagatgcccccatcctatcagagacttctagtgtgtttctctatattcgtgtagacttgggaggatgacaggagagaaaccttagaaggtggtctgtgcatttccggggcccggggtggaaggggcttgtgtcctggctgcctctgtgcacctttcattcttttttttttttttgagacggagtcttgctctgtcaccctgtcacccaggctggagtgcagtggagggatctcggctcactgtaacccctgcctcccaggttcgagcaattctcctgcctcagtctcctgagtagctgggaatacaggcatgtgccaccacgcccggctaattttatatttttagtagagatgggttttcttcatgttggtcatgctggtctcgaactcctgacttcaggtgatccatccgcctcggcctcccaaaatgttaggatgacaggcgtgagcccccgcgcctggcggcgcctttcattcttgatccacctggtttcaaactcgcagataaactgtttccacctgtgacaaatgagtcatccaccttccgtgtggtctggactttgtccctgttacaatattcctgtctcttgtttctggtttttggcgtcccacgtgttgtccctgtaacagtcctgtctcttgtttctggggtcacccctgtggcgagctgactgtgccacgttcctgaggctggtgaggatgctgtgggcaccttaatcacggctgtgaacaaactggctagagctaggtgccatggagctttgcagtggacagtaagttgtggtacccattctttgatcagtgacggagccaggtgccttattaagtctcggggatttctggaagcacagagcaggcaagcaccttctacactgaaaggaatccttctcacactcatgttggcaacgtgaagtcctgcctttggaaatccctgatttcctaagacactaccctaacattttaaaggacttaaaaaaaattcagtaaaatattcccaatagcagcacatgtagtgttttatttatttatttatttttgagatgatttgcactcttgtcgcccaggctggagtgcaatggtatgatctgggttcactgcaacctccgtctcccgggttccaaggattctcccatctcagcctgtaaggtagctgagattataggcatgcgccaccatgctcggctgattttgtatttttagtagtgacagggtttcaccatattggtcagggtggtctcgaactcctggcctcaagtgatccacccatcttggcctcccaaagtgctgggattatgaatcactgctcctggcctactttttaaactttcaggttcaggggcacgtgtgcaggttcattacacgggtaaattgcatgtcctgggggtttagtgtacagattaattcatcaaccaggtagtaagcctactaccatctgataggtagttttttgatcctctcatttgtcccaccctccaccctccagcaggcccctgcagctgttcccttctttatatccaccagtgcccaatgtttagctgtcacttatcagtgggaacaggtggtatttggttttctgttcctgtgtaagtttgctaaggataatggcctccacctccgtgcatgttcctgcaaaggacatcatcccattttttttttttttttgagacagtttcctttttgttgcccaggctggagtgcaatggtgtgatctcggctcaccgctaccaccagctcccgggttcaagcagttgtcctgcctcagccttctgagtaactgagattacagacacatgccaccacgcccggctaattttgtatttttagtagagacggggtttctccatgttgcccaggctggttttgaactcctgacctcagttaatctgccctccacggcctcccaaagtgctgagattataggtgtgagccaccacacccaaccaatcccattctttttcatgggtatgtagtattccatagtgtatatgcaccaccctttgtttatccagtttacatggcgttgttttgagaaatggatgaagcgatgtgcatgaaaacactgaatgcttcctactggaggggtgttcacctttccgggaaactgtggagtgattgcaattgcaatttcctagtagatttgattggttaatagcattgggaatctttggggtgcctgatgccctattgcagatcttttttcacagtgtagaaatctcaacgtaaatgtctttttttttttttgagatggagttttgctcttgttgcccaggctgcagtgcaatggctcaatctcggctcactgcagccaacatctcccgggtttgagcaattctgcctcagtctcctgagtagctgggattgcaggtgcctgccaccacacccggctaatttttgaatttttagtagagaaggggtttcagcctattgttcaggctgctctcgaactcgtgacctcaggtgatccacccacctcggcctcccaaagcgctgggatgacaggcgtgaccgcgcccagcccagtgtggatacaccttgagcacataactggaatcctttccttggcaacttggagccccttgggtcatggtcatataaagggtgttgaattaagaggaaacactgttaaatatgtcacagctgtccttgaaactgggacttgttttgttttctgcctggaaatgcgagtcatttttctggaaaattcatttttcgttaaaaaaagtaattgtatacacgtatatgaggtacaacgtgatgttttaatccacgtacacatcatgcaatgattaaatcaagctagttaccatattaacaatcacattaactaacatattaataatcaggctaattaacatattaacattgaagctaattaacatattaacaatcaagctaatttacatattcacataattctaactctaacctatatcacctcacctacttttttttgtagtgagaatatgtaaaatctacttttagtcattttgaaagacgtgatgtattattaactatcatcactgtgtggtgtgatagaacttggaattcatttgttttatctaactgaaaaaaattaattttaatgtaatttatatgttttttgagacagtctcatcctatagccaggctggagtacagcatcatgttcatagctctcagcagcctccaactcatggctcaggtgaccctcccacctcagcctcccaggtagctgggactacaggtgcacaccaccacacctggttaatttttaaattttttgtagagatggggtcttgctatgttgctcaggctggtcttgaattcctgggctaaagcgatcctcctgcctcagcctcccaagtagctgggactacaggtgcatgccaccatatccagttaattttttcagttttttttttatttgtttagagatagggtttcattacgttacccaggcttgtctcaaactcctggcctccagtgatcctccttcctcagccttccatagcacagtgattccagacatgagccacagcgctcctggcctccaactgaaatgttatgttctttgacaaacacttcagcattcttccctggcaaccaccattgcactctctgcgtttatgcgttcagcttttttagattctacatacgagatgatacagtatttgtctctctgtgcctggttcatttcacttcacattgtatcttccagtcccatccatgttgcgcaaatggcaggatttcctttttcatggctgcatactattccactgtgtgtctatgccacatttgcttgatgtactcatctgttgattgacacatgggttgattgtatatcttggaacctgagtagtgctgcagggcacaggggatgcaggtatcccattgatgggctgatttcctttcctttgggtacacacccagtggtgggatgtctggatcctgcacaccattctttcctctgatgttttgcaggcctatggctggacctttggaacgtcttcactatgtacaaggtggcggtcccttggccacattcttagggaacgttttcagtgtgtacatggtgtcggtcccttggctatatgcttagggaacatcttcagtgggtacatggtggcggtcccttagtcatattcttagtgaatgtcttccgtgtgtacacggtggcagtcccttggctgcatccttaggcaacgtcatcagtgcagtcccttggccacatgcttagggaacgtcttcagtgcatacacggtggcggtcccttggccacattcttagggaatgtcttcagtgtgtacatggtcgcagtctgttagccacatgcttagggagcgtcttcagtgtgtatagggtggcggtcccttggccacatgcctagggagtgtcttcagtgccgtcgcttggctgcattctttgggaacgtcttcaatgtatacatggcggcggtcccttggctgcatttttagggaacgtcttcagtgtgtacatggcggcggtcccttatccacattcttagggaatgtcttcagcgtgtacacggtggcagtcccttggccgcatgcttaggggacttcttcagtgcggtcccttggccacatgcctagggaacgagtcttcagtgccgtcccttggctgcattcttagggaacgtcttcggtgtgtacatggtggtggtcccttgggcgcattgttagggaacgtcttcagtgtgtacatggcagtggtcccttagccacatgcttcggaatgccttcagtgtgtacatggcggaggcccctcagccacgtgcctagggaatgtcttcagtgctgtcttttagcggcattcttagggaacgtcttcagtgtgtacatggtggtggtccctgagccacatacttagggaacgtcttcagtgtgcaacggcagcggtcacttggccttattgctagggaacttcttcagtgtgtacatggcggtggtcccttagccacaagcttagggaacgtcttcagtgtgtacatggcagcagtcctttggaccacatgcttagggaatgtcttcagtgtgtacacggtggtggtcccttggccccatccctagggaaagtcttcagtgccgtcctttggctgcattctttgggagcgtcttcagtgtgtacatggtggaggtcccttggccacattcttagggaatgtcttcagtgtgtacatggcggcggtcccttggccgcatacttagggaacgtcttcagtgtgtacatggcagtagtcccgtggccgcattcttagggaacctcttcagtgcatacacagtggcggtcccttggccacattcttctgagtgtccgtgtctgtgtacttttcatcctgtaaactgcttttgtttcttcattgggtgtctctgactcttatgtggtatccgtttcctctgtcagcgaccatcccaggcacagtgagagacgcagccagcctgctcctctctgcaagtggccatctcagacattctccagccagcgtcctgaccgcattcattccttcccctgcccggtccacatccttcttcccctacacccttgctaccaagaaatggtctgaatcacatcacaggcttcctttgctttctggaactgcagctccccagcccacccagatcagaggttcagaacctgaatcttcggatttctggagatgcccccatcgcatcagagacttctagtgtgattctttatattcgtgtagacttgggaggatgacaggagagaaaccttagaaggtggcctgtgcagttccagggcccagggtggaaggggcttccatccctggctgcatttgtgcacctttcattcttggtccaacattttttttttttttttttgagacggagttttactgtgtcgcccaggctggagtgcagtggtgtgatctcagctccctgcaacctccccgcctcctgggttcaagcgattctcctgagtggctgggagtacgggcatgcaccaccatgcctggctaattttatatttttagtagagatgaggtttctccatgttggtcaggctggtctcaaacccctgacctcaggtgatccatccaccttggcctcccaaagtgctgggattacaggtgtgagccaccacgtccggctgcactttttattcttgatccacctggtttgcaactcacagataaactgtttccacctatgacacatgagtcttccaccttccatgtcctctggactttgtccctgttataatattcctgtctcttgttctggtttttggcatctcacacattgtccctgtttcagtccggtctcctgtttctggtgtttggtgtgccgcacgttgtccctgttacagtcctgtctcttgtttctggggtcacccgtgtggagagctgactgtgccgcgttcctgaggctggtgaggatgctgtgggcaccttaatcacggctgtgaacaaactgactagagctaactgccacggagctttgcagtggacgctaagctgttgtactcattgtttgatcagtgacggagccagatgtcttattaggtctcggggatttgtggaagcctagagcaggcatgcaccttctacgtagaaaggaatccttctcacactcaagttggcgtcgtgaagtcctgcctttggaaatccctgatttcctaagacactaccctaacattttaaagggcttaaaaaatttcaataaaatgttcccagtagctgttacatgtagtcatgtagcgtttttttttttttttttgagatggacttttgctcttgtctcccaggctggagtgcaatggcgcgatctcggctcactgcaatctctgtctcccgcattcaagggattctcccacctcagcctgtcaggtagctaggattataggtgtgcgctaccatgccctgctacttttgtatttttagtagtgacagggtttcagcatgttgatcagggtagtctggaactccttgcctcaggtgatccacccgccttggcctcccaaagggctgggattatgaatcaccgcccccagcctacttttttcactttgatttcaggttgagggggacgtgcgcaggtaaattgcatgtcttgggggcttagtgaacagattatttcatcatgcaggtaataagtccagtaccacctgataggtagtttttcgatcctctcatttctcccaccctccaccctccagcatgcccctgcagctgttcccttctttgtatccatgagtacccaatgtttagctgccgtttatgagtgagaacaggtgatatttggttttcttttcctacgtgagtttgctaaggataatggcctccacctccatgcatgttcctgcaaagggcatcatcccatgttttctttttttctttttcttttgagactgggtttccttcttgttgcccaggctggagtgcagtggtgtgatctcagctcaccacaacctcctgttcctgggttcaagtgattctcctgcctcaggctactgagtcgttgagattacaggcgcataccaccacgctgggctaattttgtatttttagtagagacggggcttctccatgttggccagtctggtcttgagctaccgacctcaggtaatctgcctgcctcggcctcccaaagtgctgggattacaggcatgcgccgccacgcccaaccaatcccattctttttcatgggtccatagtattccatagtgtatatgctccaccctttctttatccagtctacatggcgtcctgttgaggaatggatgtaacaggcgtcgtgttcaggaatggatgtaacaatgtgcataaaagcagtgaatgttttctattggaatggcgtttgcctttctgggaaactgtggagtcattcgaattgcaatttcctggtagatttgattagctaagagcattgggaatttttggggtgcgtgatgccctgttgcagatattttttcacagtgtagaaatctcagcatgaatatgtctgttttcttttctctttttttttttttttttgcgatggagttttgctcttgttgcccaggctagagtgcaatggctgaatctgggctcactgcagccatcatctcctgggttcaagcaattctcctgcctcagcctctggagtagctgggattgtaagtgcctgcccctacaccctgatttttctttttttttgtatttttagtagagacggggtttcacctgttgggcaggctggtttcgaactcctggcctcaagtgatccacctgcctcagcctcccaaagtgctcggatgacaggtgtcagccacggtgcctggccgtctgttttcttttcataagaggtgctggactcacagtggctctgtgctgtgatgaaatgacattgccaaagttttactcctcacagcttgattttgtatgctaaacaggtcttctttggcgtgattgaggagggatggggagacttaagggagccatgtatttagaaagcgattagatcctgttatgtcttggtaattactgcagttacaacacgccattctttccgtggctcacctagctgggttcgtggctagtcatggaggcgccctgaagagcctcattttcccacagctgtaggaagtgtgtggtacacccacaatgtcttagcttttgtattagggaacgtcttcagtttgttcccttggccacatgctttgggaatgtcttcagtgtgtacacggtggctgtccctgggccgcatgcttagggaacgtcttcagtgaggtcccttggccatatgcctagggaacgtcttcggtgccatcctgtgactgcattcttagggaacgtcttcagtgtgtacatggcgggggtcccttagccccattcttagggaatgtcttaagtatttacacagtggcagtctgttggcctatggttagggaacatcttcattgtgcacatggtatcagtcccttgcgccacatgcttagggaattcttcagtgtgtacatggtggccgttccttggctgcattgttacagaacgtcttcagtgtgtacatgtcagcggtcccttagccgtaagcttagggaacgtcttcagtgtgtataaggtggcggtcccttggccacatgcctagggaacgtcttcagtgccctcccttggctgcattcttagggaacgtcttcagtgtgtacatggctgccttcccttagccacatacttagggaacatcttcagtgtgcacacggcagctgtcccctggacgcattcttagggagcgtcttcagtgcgaacatggcgggggtcccttacccacattcttagggaacatcttcagtgtgcacacggcagcagtcccctggacgcattcttagggagcgtcttcagtgcgaacatggcggcggtcccttacccacattcttagggaacatcttcagtgtgtatatggtagcagtcccttagccacacacttagggaacgtcttcagtgtgtgcacatcagcggcccttggccggattgctagggaacctcttcagtgtgtacatggcagcggtcccttaacccaagcttagggatcgtcttcaatgtgcaaagggcaatggtcccttgggccacgtgcttagggaatgtcttaagtgtgtacacggcggtcccttagccacatgcctaggaaacgtctgccatctcttcgctgcattcttagggagcgtcttcagtgcgtacatggcggccgtcccttagccacgtacttagggaacatcttcagtgtgtacatggcggtggtcccttagccacatacttagggaacgtctccagtgtgtacaggtggccgtctcttagccatattcttagcgaatgtcttcagtgtgtacacagcagtggtcctttggccacatgctttccgaacgtcttcagtgcatacagtggcagtcccttggacccattcttagaaaacgtcttcagttcgtactcggtggcgatcccttggccacattcttctgcgtgtctgtgtctgtgtccttttcaccctgtaagctgcttttttttcttcattgggtgtctctgactctcatgtggaatccctttcctctgtcaccgcctgtcccaggcacagtgagagacgcagccagcctgctcctctctgcacgtcaccatcccagacattctccagccagcgtcctgaccgcattcattccttctctttcccttgtccacatccttcttcccctacacgcttgataccaagaaatggtctgaatcacagccaaggcttcctttgctttctggaattgcagctccccacccccacccagatcagaggttgagaacctgaatcttcggatttctggagatgcccccatcgcatcagagacctctagtgtgtttctttatatccgtgtagacttgggaggatgacaggagagcaaccttagaaggtggcctgtgcagttccagagcccagggtggaaggggcttccattcatcactgccttcgtgcacctttcattcttgatccaaccgttgttgttgttgttttgagacggagtcttgctgtgtcgcccaggccggagtgcagtggtgtgatctcaggtcactgcaacctccgcctcccatgttcaagcgattctcctgccacagcctctctgagtagggagctgctaaaataaaataccttcagttgggtaatttataaactagagacatttatcactcacagttctgaaggctggaggttcaagatcatggcagattcagtgtgtggtggggatgcactccctggttcatagacgacgcattttctctgcctgctcacatggtggaaagggcgagggagctctctggggctccttttataaggacagtgatcctattcatgaggcttgatccccatgaagtcatcacctcccaagtctcccacctcctgacaccattgtcttaggggtgaggatttcaatgcaggaatttgggggaggaacacaaactttcagattgtagcaaataccattctttaaaaaaatgcagtaatagttaagctttttttttttaatttgataaattttccaagaaggaggagacacagaaaccctccgtgttttgaaggttaatattagtgctgtaaaatacacgtgggacttgggcttataaaaaattcctggtcatggcaaaatataggtggtttgcagtacctggggaagcccacctttcctgtttctgacatgtaacttttgtggaaattgcctgaaagttgtttctagttacccttcagtcctgtgtccaacccagcatgtccgatactatctaacattgttttttttttgagatggagttttgctcttgttgcccaggctgcagtacagtggcacgatcttggctcgctgcaacctccacctcccaggttcaagcgattctcctgtctcagcctcctgagtagctgggattactaaattttatataaatgttgtgtcaagaaatattattgctcttttgcctttttttcccttaaccgttgagaaattcagaaaaaaacatttatgaacgtcaacactgtttttgacaagtaaacattgttcttggcaagtgggccttccaaaaataagggctggcgtttgtggaaactgctctactgttctttttttttcttgctacttttttctttttttttttttttgaggcactaattggaatccacttattcgtcctgggtggagaaagagttcagatctaacactgggggctctgtgtttccttaggtaatacatatgaagtttttgtcactgtaattcagtaatctgtgttaatattatcacaaaagagcagagtggcatttgtgtcttctcagaattgcttattaaaacagctgcatggccagccgcggtggctctcatgcctgtgatcccagcactttgggaggccgaggccggtggatcgcttgagcccaggagtttgagaccagcctgggtaacatggccaaacctcatctctactaaaaatacaaaaagtgagagcgtgcctgtagtcccagctactgaggaggcagaggtgggaggatcacttgagcgtgggagttggaggctgcagtgagctgtgatcacagcctgggaaaccaagcgagagatgctgtgtctaaaattataaaaataaaaattagccaaacatggtgccacgcgtgtgtggtcacagctacctgggtggctgaggtgggaggatcactggagcccacaaagtcgaggctgcagtgagctgagattgcatcactgtcgtgcagcctgggcaccagagtgagagacaccctgtctctaaataaataaataagttcatgattaagcagaagttgtgcttgttctgccgggatttcagttgggttctttgtgccctaatttacgtgagctagtaggttgtgcgttatcttagagggcttgcatgaaagaaagagggtagcctttcttttccctgttttggtagcattgctgaggtggcttttggctgacgggtggacccgtgggtgcagatgttttgatgcagaaggaacgattgccttttcacattcaggctccaactggcttttagcttgtgcgttcttaccctggggtgttcgaggtcaccggactcctattttatttgtgtttaactggaaaggcaggaactctgagaacgtatcaaatagccagtttactgcaggctttctagaatttaaatcgcttccaaaactggatccacaagctaggaattatgtttaagttttaaaaggtgttggtttgcttcttacatgtctaaattcttgggggaaaaactgcaaagaataataaagtttcatgattcaaaaatggtatgaggccgggcacaatggctcacacctgtcatcccagcactttgggaggctgaggcaggaggatgatttttgagaccaggagtttgagatcagcctgggcaaacagcgagatcctgtgcctacaaaaataaaataaaaataggctgggtgtggtggctcatgcttgtaatacctgcactttgggaggctaagtcagtaggatcacttgaactcaggggtttgagaccagcctggtcaacataatgagaccttgtctctagtaacaataaaaaaattagctggacataaggtgtgcatttgtagtcccagttacacaggaggctgaggtgggaggatcacttgagcctgggagttggaggctgctgtgaaacgtgatcgcaccactgcactccagcctgtgcaacaaggagagagatgctgtctctaaaaaaaaaaaaaaaagccagacgtggtggcacacgtgtgtggtcacagctacttgggaggctgaggctgaaggatcgcttgagcccaaggaggctgaggctgccataagctacgatcatgccactgcactccaggctgggcaatagcctgggcgactgtctcaaccaaaataaatttaaaaagataggaaatttcaatgtgaaaatcagtgtcccccagaacgttccatttcttcccagctgggctatttttggagttccatggggagccggctcagtgcaccttgcatgtactcaggaggatgagccctgccatggtgtgtgttaggggacagcctgatctcaccaaccctcctgagcaggcccggccctccgagtaataactgggaacactcgccgctttgtgagaggacctcgtgtgctcactggaaggtcatctcttctggtccacgctgcagtgtggatactttttttgtttgtttgtttgtttgagaaggattattgctctttttgcccaggctggagtgcaatggcatgatctcggctcactgcaacctccacctcctgggttcaagccattcttctgtctcaacctcctgagtagctgggattacagtcgcccgccaccacacccggctaatttttgtatttttagtagagacagggtttcagcatattggccttgctgttctcaaactcctgacctcaggtgatccacctgcctcagcctcccaaagtgctgggatgacaggcgtgagccaccgcgcccggcccagtgtagatacaccttgagcacataactggaatcctttccttgacaacttggagccccttggaacatagtcatataaactgtattgaattaagaggagacaccgttaaatatgtcatagctgtcctcaaaactgggtcttgttttgctttctgcctggaaatgggagtcacttttatagaaaatttattgttcgttaacaaaaaataattgtgtgtgtgtgtatatatatattgtatgtgtgtgtatatatatatatatatatatatatatatacacacagacacacattctctctctctctctctctatggtacaatatgatgttttaatccaagtacacattgtgcagtgattaaaccaagctagttaccatattagcaatgaagctaattaacattaataattaagtgaattaacatattaaccattgacctaattaacatattaacaatcaagctaattaacatattaacaagctaatttacatattcagataaccctaactctaacctatatcacctcacttcgtttttttggtgatgagaatatgtaaaatctagttttagtcattttgaaagatgcaatgtattattattaactataatcactgtgtggtatgatagaactttgaatttatttcttttatgtaactgaaaaaatttaattttaatgtaatttatgtttttgagacagtctcaccctctatcacccaggctggagtgcagcgtcatgttcatagctcatggcagcctccaactcctggcacaggtgaccctcccacctgagcctcccaggtagctgggactacaggtgcacaccaccacacctggttaatttttaaagttttgtagagatggggtcttgctatgttgctcaggctggtcttgaattcctgggcagaagtgatccttctgcctcagcctcccaagtagctgggactgcaggtgcatgccaccatatctagctaattttttcatttttttttatttttagagatggggtttcattatgttgcccaggcttctctcaaactcctggccttctgtgatcctccttcctcagccttccatagcattgtgattccagacatgagccaccgctcctggcctccaactgaaatgttatgttctttgccaaacacttcatgaagcattcttccctggcaaccaccattgcactctctgcgtttatgcgttcagcttttttagattctacctatgagatgatacgatatttgtctctctgtgcctggttcatttcacttcacattgtatctttcagtcccacccatgttgctgcaaatggtaggatttcctttttcatggctgcataccattccattgtgtgtctatgccacattcgcttgatgcacttatctgttgattgaacatgggttgattctatatcttggaaactattagtagtgctgcagtgcacagggggtgcaggtatgccattgatgggcagatttcctttcctttgggtacacaccgagcggtgggatgactggatcctgcacaacattctttgctctgatgttttgcaggccaatggctggaccttagggaacgtcttcactttgtacaaggtgggggtcccttggccacattcttagggaacgtctgcagtgtgtacacgatgttggtctcttgaccacatgcttaggaaacatcttcagtgtgtagctggcagcagtcccttagccacattcttcccgaatgtcttcagtgtgtacacggtggcagtccctagtcctaattcttcgggaatgtctttagtgtgtacatggcggcagtcccttggccgcattcttagggaacgtcttcagtgtgcacactgcggtggtcccttagccacaagcttagggaatgtcttcagtttgtacttggtggcggtcccttggctacatgcttacggaacatattccctgccgtctcttggctgctttcttagggaacgtcttcagtgtgtacatggtggtggtcccttagccacaagcttagggaacgtcttcagtgtgcacaccgtggctgtcccttgggccacatgcttagggaacgtcttcagtgtgtacatggtggcagtcccttggccacattcttagggaacgtcttcagtgtgtacagggcggcagtcctttaaccacatgcttaggggaaccatcttcagcatgtccacggtggcggttcttttgcggcattcttaggggatgtcttcagtgtgtacatggcggctgtcccttagccacaggcttagggaacgtcttcagtgtttacatggtggcggtcccttggccacatgcctagggaatgtcttgagtgctgtcccttggctgcatcttagggaatgtcttcagtgtgtaaatggtagcagtcccttagccacatgcttagggaacgtcttcagtgtgcacacagcagaggtcccttgcgccacatacttagggaacgtcttcagtgtgtacatggtggtggtcccttggccacatccttagggaacatcttcagtttctacacagtggccatcccgctgccacattcttagggaacgtcttcagtgcctacatggtggtggtcccttggccacattcttagggatcatcttcagtgtggacccttggccacattcttagaaaacgtcttcagttcatacatggggacgatcccttggccactttcttctgagtgtctgtgtcatttgctccctgtaagctgcttttatttcttcattgggtgtctctatcatgtggaatcccactcatctgtcaccacccatcccaggcacagtgagagacacagccagcctgctcctctctgcacgtggccatctcagacattctccagccactgtcctgaccccattcattccttctcctgcacggtccacatccttctttccctacacccttgctaccaagaaatggtctgaatcacagccaaagtttcatttgctttctggaacagcagctccccagccgcactcagatcagagattcagaacctgaatcttcggatttctggagatgcccccatcccatcagagacttctagtgtgtttctttatattcgtgtagacttgggaggatgacaggagagaaaccttagaaggtggcctgtgcagttccagggcccagggtggaaggggcttgcatccctggctgcctttgtgcacctttcattcttcatccagctgttttttttttttttttttgaagaggagtcttgctgtgtcccccaggctggagtgcagtgctgtgatgtcagctcactgcaacctccgcctcctgtgttcaagccattctcctgccacagcctcccgagtagctgggattacaggcacctgccaccacacatggctaatctttgtatttttagtagagatggggtttcatcatgttggccaggctggtcttgaactcctgacctcaggtgatccacctgcctcagcctcccaaagttctgggataacaggcatgagccactgcgcccggccgcacccttcattcttgattcacctggttacaaactcgcagataaactgtttctacctgtgacaaatgagtcatccatcttccatgtggtgtcgactttgtccctgttataatattcctgtctcttgttctggtttttggcgtcccgcacattgtccctgttacagtcgtgtctcttgtttctggggtcacccctgtggtgagttgactgtgccctgttcctgaggctggtgaggatgctgtggacaccttaatcacggctgtgaacaaactggctaaagctaggcaccatggagctttgcagtggatgctaagtcgtggtacccattctttgatcagtgacggagccaggtgtcttattaagtctcggggatttgtggaagcccagagcaggcatgcaccttctacattgaaaggaatccttttgacactcaacgttggtgtcgtgaagtcctgcctctggaaatccctgatttcctaagacactaatctaacattttaaaagagttaaaaaaaaatcagtaaaatgttccccatagaagcatgcagtgttttgtgtgtgctttttattgttttttttttttttttttttgagacgaagttttgttcttgtcgccaaggctggagtgcagtagcacaatctcggctcactgcaacctccgtctccagggttcacgggattctcccgcatcagcctgtcacgtagctgggattataggtgtgtgccaccatgcccgactaattttgtatttttagtagtgacagggtttcatcatgttggtcagggtggtctcgaactcctggcctcaagtgatccacccgccttgccctcccaaagtgctgggattaggaatcactgctcccggcctacttgtttttacttttatttcaggttgaggggcacatgcgcaggttcgttacacgggtaaattgcatgtcctgggggtttagtgtagagattatttcatcaaccaggtaataagcctactaccacctgataggtaatttttcaatcctctcgtttgtcccaccctccaccttccagcaggccccggagtctgatcccttctttatatccacgggtacccaatgcttacctaccacttatcagtgagaacaggaggtattttgtcttctgttgctgtgtaagtttgctaaggataatggcctccacctccatgcaggttcctgcaaaggacatcatcccgtttttttttttttgagatggggtttccctcttgttgcccaggctggagttcaattgtgtgatcttgactcaccgcaacctctggctcccgggttccagtgattctcctgccttagccttctgagtagctgagattacaggtgcatgccaccacgcccagctaattttgtgtttttagtagagacagggtttctccatgttggacaggctggtcttgaactccggacctcaggtaatccacccgcctcggcctcccaaatttctgagattacaggcgtgagccaccacgcccaaccaatcccattctttttcatgggtgcatagtattccatagtgtatatgctcccacctttctttatccagtctacatgacgtcgttttgaggtatggatgaaatgatttgcataaaaacagtgaatgctttctattagaatggtgttggcctttctgggaaaccgtggagtcattccaattgcaatttcctagtagatttgattggttaatagaattgggaatttttggggtgcctgatgcacactattggagatcttttttcacagtgtagaaatctcaacatgaatatgtctttttttttttttgagacggagtttctctcttgttgcccaggccggagtgcaatagctcaatctcggctcactgcagccaacatctcccgggttgaagcaattctcctgcctcagcctcctgagtagctgggattacaggtgcctgccaccacacctggctaatttttgtatttttagtagacacagcgtttcagcatattggtcaggctggtctggaactcctgacctcaggtgatccacccgcctcagcctcccaaagtgctgggatgacaggcgtgagtcacagcgcccggcccagtgtggatacaccttgagcacataactggaatcctttccttggaaacttggaaccccttgtgtcatggtcatataaactgtgttgaattaagaggagacactgttaaatatatcacagctgtcctcgaaactgggacttgttttgctttctgcctggaaatgcaagtcatttttatagaaaatttatttttcgttaacaaaaaataattgtatacatatatatggtacaatgtaatgttttaatccaagtacacattgtgcaatgattaaatcaagctagttaccatattaacaataaagttaattaacatattaaaataaagctaataacgtattaaccaagctaattaacatattaacaatcaagctaattaacatattcacataatcctaactctgacctatatcacctcacctagttttttttgtggggagaatatgtcaaatctacttttagtcattgtgaaagacgcgatgtattattaactatcatcactgtggtgtgatagatcttggaatttatttgttttatctaactgaaaaaaattaattttaatgtaatttatgtattttttgagacagtctcaccctatagccaggctggagtacagcatcatgttcatagctctcggcagcctccaagtcatggctcaggtgaccctcccacctcagcctcccaggtagctgggagtacaggtgcacaccaccacacctggttaatttttaaattttttgtagagatggtgtcttgctatgttgctcaggctggtcttgaattcctgggctgaagcgatcctcctgcctcagcctcccatgtagctgggagtacaggtgcatgccaccatacccagctaattttttgttttttttttttagagatggggtttcattctgttgcccaggcttatctcaaactcctggcctcaagtgatcctccttcctcagccttccatagcattgtgattccagacatgagccaccgcttttggccagcaactgaaattttgtgttctttgacaaacacttcagcattctttgctggcaacaaccattgtaccctctgcatttatgtgttcagcttttttatattctacatatgcgatgatatggtatttgtctctctgtgcctgtttcatttcacttcaccttgtatcttccagtcccatccatgttgctgcaaatgacaggatttcctttttcatggctccatactattccagtgtgtgtctatgccacatttgtttgatgcactcatctgttgattgacacatgggtttattccgtctcttggaaactgagtagtgctgcagtgcacagtggggcaggtatcccattgatgggtacacacccagtggtgggatgactagatcctgtacaccattctttcctctgatgtttcgcaggcccatgactggacctttggaacgtcttcactgtgtacaaggtggtggtcccttggccacattcttagggaacgtcttcaatgtgtacatgacggccgtcccttggccacatgctcagggaacatattcagtgtgtacttggcagtggtcccttagccacattattagggaatgtcttccgcgcgtacacagtggcagtccgttggccgcatgcgtagggaacgtcatcagtgcggtccattggccacatgcttagggaacatcttcagtgtgtacatggtggtctcttggccacattcttcgggaacgtcttcactgtgtacatggcggaggtcccttgggcgcatggttagggaacgtcttcagtgtgtacatggcggaggtcccttatccacattcgtagggaatgtcttcaatgtgtacacggtggcagtcccttggctacatgcttagggaacatcttcagtgcggtcccttgaccacatgcctagggaacgtcttcagtgccgtcccttggctgcattcttagggaacgtcttcagtgtgtacatggtggtggtcccttagccacctgcttagggaacgtcttcaatgtgcacatggcagcagtcccttggccacattttttgggaacatcttcagtgtgtacatggcggcggtcccttagccacattcttagggaatgtcttcagtgtgtacacggcggcagtcccttggccgtatgcttagtgaacgtcttcagtgagtacatggcggcgatcccttagtcacctgcttagtgaacatcttcagtgtgtatatggcggcagtcccttaaccacatacttagggaacgtcttcagtgtgtacatggcagtggtgccttagccacatacttagggaatgtcttcaatgtgtacatggcagtggtttcttagccacatgcctagggaacgtcttcagtgttgtcttttagttgcattcttagggagcgtcttcagtgtgtacacggcagcagtcccttggccgcattcttagggaaccttttcagttcatacacagtggcggtcccttggcaacattcttctgagtgtcagtgtctgtctgtgtccttttcaccctgtaagctgcttttgtttcttcactgggtgtctctgactctcatgtggaatcccatttctctgtcaccgcctgtcccaggcacagtgagagacgcagccagcctgctcctctctgcacgtggccgtctcagacattctccagccaccgtcctgaccgaattcattccttcccctgccccgtccacattcttcttcccctacacgcttgctaccaagaaatggtctgaatcacagccaaggcttcatttgctttctggaactgcagctcccagccccacccagatcagaggttcagaacctgaatcttcggatttctggagatgcccccatcctatcagaggcttctagtgtgtttctttatattcgtgtagacttgggaggatgacaggaaagaaacctttgaaggtggcctgtgcagttccagggcccagggtggaaggggcttgcatccctggctgcctttgtgcacctttcattcttgatgcaacttttttttttttttttttaaagatggagtcttgctgtattgcccaggctggagtgcagtgctgtgatctcagctcactgcaccctccgcctcccgggttcaagcgattctcctgccacagcctcctgagtagggagctgctaaaataaaataccttcagttgggtaatttataaactacagacatttgtcactcacagttctaaaggttggaggtttaagatcgtggcggattcagtgtctggtggggacccacttcctggttcatagatgatgcattttctctgcgtggaaggggcgagggagctctctggggtcccttttataaggacactgatcccattcatgaggctcgatccccatgatctcatcacctcccaagtctcccacctcctgactccattgtcttaggggtgaggatttcaatgcaggaatttgggggaggaatacaaactttcagactatatatagcaaataccattctttaaaaacatacagtaatagttaagctttttttttttttaatttgataaattttccaagaaggaggagacacagaaaccctccttgctttgaaggtgaatgttagtgctgtaaaatatacgtgggacttgggcttataaaatcttggtcacggtaaaatataggtggtacgcagaacctgggaaagcccacctttcctttttctgacatgtaacttttgtggaaattgcctaaaattgtttatagttagctcttcagtcctgtgtccaacccagcatgtccgatactatctaacattctttttttttgagacagagttttgctcttgttgccaagcctggagtacagtgacgcgatcttggctcgctgcaaccttcacctcccgggttcgagcgattctcctgtctcagcctcctgagtagtttggattactaaattttatataaatgttgtgtcaagaaataatattgctcttttgactttttttccctaagcattgagaaattcagaaaaaacatttataaacataaacactgttcttgacaagtgggccttccaaaaataagggctggagtttgttgaaactgctctactgtgttttatttatttatttatttattggtacttttttccttttttttttgaggcactaattggaatgcacttatttgtcctgggtggagaaacaattcagatctaacactgggggctctgtgtttccttaggtaacgcatgtgaggttttcgtcagtgtaattcggtaatctgtgttagtattattacaaaagagcaggggggcatttgtgtcttctcagaattgcttattaaaacagctgcatggccaggcgtggtggctcacgcccgtaatcccagcactttaggccggtggatcgcttgagtacaggagattgagaccagcctgggcaacatggccaaactccatctctactaaaaatagaaaaaattagtatgtgcttatattcccagctactcaggaggcagaggtgggaggatcacttgagtgtgggagttggaggctgcagtgagctgtgaccacagcctgggcaaccaagcgagaggtgctgtgtctaaaaatacaaacataaaaattagccaaatgtggtggcacgcgtgtgtggtcacagctacttgggaggctgaggctgaaggatcgcctgagcccaaggaggttgaggctgcagtgagctagcatcatgccactgcactccaggttgggcaatcgcctgggtgtgaccctgtctcaaccacaataaatttaaaaagataggaaatttcaatatgaaaatcagtgtcccccagaatgttccatttcttcccagctgggctatttttggagttctatggggagctgtctcagtgcaccttgcatgtactcaggaggatgagccctgccatggtgtgtgttaggggacagcctgatctcaccaaccctcctgagcaggcccggccctccgagtaataactgggaacactcgccgctttgtgagatgacctcgtgtgatcatttgaaggtcgtctcttctggtcagggtgcagagtggacacatttttttttttttttgagacagagttttactcttgttgcccaggctggagtgcagtggtgcgatcttagctcactgcaacctccacctcctgggttcaagccattctcctgtctcagcctcctgagtagctggcattacaggcgcccgccaccacacccagctaatttttgtatttttagtagagatggggtttcagcatattggtcaggccagtctggaactcctgacctcaggtgatccacccgcctcagcctcccaaagtgctgggatgacaggcgtgagccaccgcgcccggcccagtgtggatacaccttgagcacataactggaatcctttccttggaaacttggaaccccttgtgtcatggtcgtgtaaactgtgttgaattaagaagagacaccattaaatatgtcacagctgtcctcaaaactgggacttgttttgctttctgcctggaaatgcgagtcatttttatagaaaatgtattgttcattaacaaaaaataatcgtatacatatatatgaggtacgtgatgttttaatccaagtacacattgtgcggtgattaaatcaagctagatactatattaacaatcaagtcaattaacatattaataatcaagctaataaacacattaacaatcaagctaattaacatattaacaagctaattaacatattcacataaccttaactctaacctatatcacctcacctacttttttttgtggtcagaatatgtaaaatctacttttagtcattttgaaagatgcgatgtattattaactatgatcactgtggtgtgatagatctttgaatttatttcttttatgtaactgaaaaaatttaattttaatgtaatttatatttttttgagacagtctcaccctatcacccacggtggagtgcagcgtcatgttcatagctcactgcagcctccaactcctggctcaggtgaccctcctgagcctcccaggtagctgggactacaggtgcacaccaccacacctggttaatttttaaattttttatgtagatgggatcttgctatgttgctcaggctggtcttgaattcctgggctgaagtgatcctcctgcctcagcctcccaagtagctgggactacaggtgcatgccaccatacccagctaatttttttgtttttgttttttttttagagatggggtttcattacgttgcccaggcttgtctcaaacttctggccttcagtggtcctccttcctcagccttccatagcattgtgattccggacataagccaccgctcctggcctccaactgaaatgttatgttctttgacaaacacttcatgaagcattcttccctggcaaccaccattgcactctctgcttttatgcattcagcttttttagattctacatacgagatgatatggtattctctctgtgcctggtttatttcacttcacattgtattttccagtcccatccatgttgttgcaaatggcaggatttcctttttcatggctgcatactattccactgtgtgtctatgccacatttgcttgaggcactcatgtgttgattgacacatgggttgattctatatcttggaaactgtgagtagtgctgcagtgcacagggggtgcaggtatcccgttgatgggctgatttcctttcctttgggtacacaccttatggtggaataactggatcctgcacatcattctttcctgtgatgtttcacaggcccatgactgaaccttggggaatgtctttactgtgtacaaggtggcggtcccttggtcatattctttggaaacatcttcagtgtgtatacggcgttggtcccttggtcacatgcttgggaacatcttcagtgtgtacatggcagcagtcccttagccacattcttagtgaatgtcttcagtgtgtacacggtggcagtcccttggctgcatgcttagggaacgtcttcagtggtgttccttggccacattcttagggaatatcttcagtgtgtacacggtttgtgtacagggcggtggtcccttagccacaagcttagggaacgtcttcagtgctgttccttggccacattcttagggaatatcttcagtgtgtacacggtttgtgtacagggcggtggtcccttagccacatgcttagggaatgtcttcagtgtgtacccgtggcggtcccttggcctcatgcctagggaatgtcttcagtgccgtcccttggctgcattcttagggaatgtctttagtgcgtacatggcttcagtgcgtacatggcggcggcccctcagccacatacatagctaacatgttcagtgtgtacactgcaacggtcccttggccccattctttgggaacatcttccttgcggtcccttggctgctttcttagggaatgtcttcagtgcctacacagtggcagtcccttgtccacattcttagggaacgtcttcttctgtacatggtgtcgatcccttggccacattcttagggaacatcttcagtgagtacatggcggtggtcccttggccacatttttagggaacttcttcagtgtgtacatggctaccgtcccttagcccatgcttagggaatgtcttcagtgtgtacatggaggtggtcccttggccgcattcttagggaccgtcttcagtgtgtacatggcggtggtctcttggccgcattgttagggaccatcttcagtgtgtacatggcggtggtcccttagccacaagcctcgagaccgtcttcagtgtgtacacagctgtcgtcccttgggccacatgcttagggaacgtctgcagtgtgtacacggtggcggtcccttggccacattcttagggaacgtcttcagtgaggtcccttggccacatgcttagggaatgtcttcagtgcctacacagcggcagtcccctgtccacattcttagggaacgtcttcagtttgtacatggtgtgggtcccttggccacattcttagggaacatttttagtgtgtacatggcggcagtcccttagccacattcttagggaatgtctttagtgtgtacatggtggtagtcccttggccgcacacttctggaacgtcttcagtgcggtccctttgccacgttcttcgggaacatcttcagtgtgtacatgatggcggtcccttagccacaaacttagggaatgtctttagtgaatacacagcagcggtcccttggctgcattcttagggaacgtcttcagtgcggtcccttgaccacattcttaggaaatgtgttcagtgtgtacatggcgtcggtcccttggccacattcttagggaacatcttcagtgtgtacatggcggagtcccttagccacatgcttagggaacgtcctcagtgtgtacacggtggcagtcccttggccacatgcctagagaacatcttcagtgctgttcctttgctgcattcttagggaatgttttcagtgtgtacacggtggcagtcccttggctgcatgcttagggaacgtcttcagggtggtcccttggccacattgttagggaacatcttcagtgtgtacatggcggtggtcccttggccgcattcttagggaacctcttccttgtgtacagggcagcggtcccttggccgcattcttagggaaagtcttcagtgtgcccacggcagcggtcccttgggggtgaggatttcaacgcaggaatttgggggaggaacacaaactttcagatagtagcaaataccattctttaaaaaaatacagtaatggttaagcttttttttttcttgattgataaattttccaagaaggaggagtcaaagaaacgctccttgttttgaaggtgaaggttagtgctgtgaaatacacataggacgtgggcttatataaaaatcctggtcacggcaaaatataggtggtacgcagttcctgggaaagcccacctttcctttttctgacatgcaactttttcggaaattgcctaaaagttgtttatagttagcccttttcggccctgtgtccaacccagcgtgtccggtactatctaatgttctttgtttttgagacggaattccactcttgttgcccaggctggagtgcagtggtgcgatcttggctcactgtaacctctacctcctgggttcaagcaattcccccgcctcagcctcctgagtagctgggattaccggtgtccgccaccaggcccagctaatttttgtatttttagtagagacggggtttctccatgttggccaggctggtctcgaactcctgacctcaggtgatctgcccgcctcggcctcccaaagtgctgggattacaggtgtgagctactccgcccagcctaattttttattatttttaatttttaacattttttttttggagactgggtcttgctgtgtcccacaggctagagtgcagtggcatgatcatggctcactgcagctttgacctcctggactcaagccatgctcccacctcagcctcatgatagctgggactccaggtgtgtgccatcatgcccaggcaagtttttaaaaaaattatttgtagagatggcgtctcactatgtttcccaggttcgtctggaactctgggcctcaatggatcttcccacctgggcctcccagagtgctgggattacaggcatggggcacagtgcccagtccctcatgtgtgtaattgttcaacagctagagaaacccaaacacataccctcagacactgtcccgtctgccgcccaggtctcctcacctgcatggtttgctgttgccacttgatttaatggagggcataatgaatgacccttaaacacggcctctaagagtcctcgtaagtgccttcctcattaaaattcaagaggaatcaaatacctgttactgaatataaatgtttagaggagaaagcctgtgagctgagagtcatatcttaaggggtgtgtgcttgcagaattatcacattttcaatttcatgtgtgaataaattgttgtatttgggatcaccaagaaggcagaaacatgtatcaatgaaatttagtagacggctaaaaacaaacagtagcagcctactgaggggctgtggaataagcagattttagatttttagagggaaaacggtgatggtaggttatttccccaatggcttccaggcctccaactcaggcttggaattggccatggtcattggccctttttttttttttttttctttttgagacggagtctcgctctgtcgcccaggctggagtgcagggtgtgatctcagctcactgcaagctccacctcccgggttcacgccattctcctgcctcagcctcccgagtagctgggactacaggcttccgccaccacacccggctaattttttgtatttttagtagagatggggtttcactgtgttggccaggatggtctcgatatcctgacctcgtgatctgcccgcctcggcctcccaaagtgctgggattacaggcgtgagctaccgtgcccggcccattggctcttttttttaccatctcatcttctctcacacgagttattctcactgttggaaagaacttgtccttaaagcattgcttccaggtgagtgtaacggtgcccagcatgtgatacaagttaaaaataagagcagagcccaaatgctgtcattgcttgatccatcatttcccctgtcatgcagctcatttgagtaacagggtctcgtttcggggtgctgtgtccggagaggcagaactccccttggagaatgggtagagaatgtacatcacttgccaagtatggtggttttgcatgctgccttgactggacttgtttgcctttggttttctgtaagaatcttaggatatctgcccaggagttagacccctgggctaaagtaaggttgagggccagccacggtggctggtgcctgtaatccctggactttcggaggctgatgtgggaaaatcacttgagtccaggagtttaagaggagcatgggcaacgcagtgagacccccgtctatataaaatttaaaaaaaattagctggacatggtggtgtgcatctgctcccagctactttggaggctgaggtgggaggatcactggagcccaggaggtggaggctgcagtgagccatgatcacaccactgcactacagcttgggtgacagagccagaccctgtctctacgaaacacaaataaaaagtaaaatgaggttgagaaactccgcctccctcttgatttcaaggtaatactcagcttctagattgacacacacacaagtcattgtcttatcatagtgacatgtgacggaacacgcacgtgtctggtgacagatggtgcattgaggggaacattccttaagctgtgtttccttggggaaagaggcaatagcattctctgttagtacagaacccttcagtttgtacaaatgtcttcggaaagggaatattcctgagagcttctacgtggcagttaacaagtcacacttttcatctcagatgtctcaatttccagaagatggtacttgattacatttcctggggttcttgtttctaggaaatcgcggctgggtttttctagaaataatgcagtgatttggggacctgtggcactgggaagggtatgatctcaggcacaggactgcaaagacacgttgtttaccggccagcatgataactaggcgtgacgctgatggccagtgtgttgcatacgtactgggctttattatccatacctggatggaactgaatatatatatatacacacacacatagacacccataatatattatacaatgtaattatatatcatcatatatcatatatattataatatatacagttgacctttgaacaacacaggtgtaaactccataggtccatttatatgtggattttctgccacctctgccacccccgagacagcaagaacaaccctttttgttcctcctcctcctcctcagcttcttcagcatggagacgatgaggatggagacctttaggatgatccacttccactcgatgagtagtacatatgttttctcttccttaagattttcttaatagcattttcttttctctagcttactttactgtaagaatgcagtatataatacatagaaacacaaaataaatacaaacatgtgttgagaatgtagtatataatatatataaatacaaaatacatgttgattgacagtggcatgatctcagctcactgcaacctctgccttctgggttcaagcaattcttctgcctcagcctcccaaatagctgggcctacaggcgcacgccaccacacccagctaattttttttgtatttttagtaaagacggagtttcaccatgttggccaggctggtcttgaactcctgacctcgtgatccacctgcctcagcctcccaaagtgctgagattacaggcgtcaaccactgtgcccagccgtgtgagtctttatggtagaacaatttatattcctctgggtgtgtacccaataatgagattttcagtagactttgagtgaagccgatagctgttcataatgtgggtgggccttgcctaatcagtggaaggtcttaagaggtaaaaagagtccctcctccaaggaagagggaattctatctggaatccaccttcagacttgagctgcgacatcatgtctccatgggcatctggcctgctggtctaccctgcacattttggttttgcccctcccccacatcttgggagccagttctttaaaatctctttctctctatatatatatcctactggttgtttctctgcagaactgtcactcatgcagatctgtgtccacagatgacatcattgcaaagccactaagagagacatagcatccagggaatggaaggaccaggttcctttcagacttgaagacacgtcaaaacacattccaccgcgttgccttggagaacccagggaccaggcctcttcccctcctgtcaaatagtccttagcctttgttcttcttgctccttgtgaatttcacaggcttccttgactttgaattctgctccttggatgtctttgttggtgaacgtgatgagatagaattttggaaagctccgaggtgtgatcattgcaccctgggactgacacgtgctccgtcttcactgaagacagccggaagccgtggtgttccagaacttgaatgtggctgtggaaactagagtgtccatgcatcctgggcggtagctactggtgccgtctgcgtcgtctgtagctcctcattgctgattctcattcggctgcctcagtcaggacagggctggttacagcgttgctcttcatgctgttcaagtcagggtgatctacagggacagaacgaataggactgatgtgtatatgaaggggagtttactaggataattgactcacacgatcacaaggtgaagtcccacaataggccgtctgcaagctgaggagccaggaagccagtccaaggcccaaaacctcaaaagtaggcaagctgagagtgcggccttcagtctgtggtcgaaggtccaggagcccctggcaaatcactggtgtaggtccaacggtccaaaacccaaagaccctggggtcttgatgttcgagggcaggaagcatccagcatgggagaaagatgaaggctagagatcccgccactgcactccagcctgggtgacagagcgagactccgtttcaaaaaaaaaaagaaagaaagaaaaacatttaaaaagcagaaatgagctggatgcggcatcttctgcttgtaatcccagcattttgggaggccaaggtgggtggattgcttgagcctaggagctcgaaaccagcctgggcaacatacggagaccctgtctctacaaaaaaacacaaaaattatctggccatgctggtgcacacctgtagtcccagctactcaggaggctgagatgggaggtttggttgagcctgggaagttgaggctgcagtgagccatgattgccccactgcactccagcctgggtgaaagagtgagaccttgtctcaaaaaaaagaaaaagaaaaaagaacaaataagaagacagacacacctctcttctttgtgtgggtacagccgttggcaaactttgctgacagatgctactgaccttgttttcctttctgcattctgttcatttcaaaagtgggtaaatcagaagtgggactcactgtgaccttcagtgactcaatgctgaattcacaagattaattggagagtgtgaagaatgcagggcatccgtggacccattttaatgaattttagcatctcttgcatccttgtatccttgcatccagtaccggtccccagccttttagtaactgggctgtgcagcaggaggtgagtagcgtgtgagtgagcaaagcttcatctgtattgacagctgctccccatagctcatattacctcctgagctctgcctcctatgagatcagtggtggcattagagtctcataggagcatgaaccctactgtgaactgaacatgtgagggacctaggtggcgtgctccgtatgaaaatctaatgcctgatgatctgtcactggctctcatcacccgcacgcagatgggaccgtctagttgcaggaaaacaagctcagggcttccactgattctacacgatggtgagtttcataattacttcattctctattacagtgtaataataatagaaataaagtgcatgataaatagaatgcacttcaatcatccccaaaccatcccccaccccacatcagtggaaaaatggtcttccatgaaactggttcctggtgccaaaaagcttgaggaccactggacaaaggaacttgtcagagtatggattgaaggtctttattgatgctttgctgtcactcttactttaagatgaatgcgtatatatatgtatatacattctgtaatgtgtgaatatatgaagctccagctgctctctccctctctttcctctgcagtccaattctcgtagatcagtcttttcctgaaatgaatgacctcttaaattttattttatattttaagcttttatgttattttactttatttttaagctgtttttattttttaagcttttttttttttgagacaaaaaagtctcgctcttgtcacccaggctggagtgcaatggcatgatctgagctcactgcaacctccacctcctgggttcaaaaaattctcctgccccagcctcctgagtagctgggactacaggcgccagccaccacgctgggctaatttttgtgtttttagtagagacagggttttaccatgttggccaggctggtcttgaactcctgacctcatgatccacccacctcggcctctcaaagtgttgggattacaggtgtgagccaccacaactggccagtttgcaggtctttgttgatgctttgctgtcaatcttactttaagacgaatgcatatatatgtatgtgtatacattctgtaatgtgtgaatatatgaagctccacctgctctctccttccctctcctctgcagtccagtactctcctagatcattctgttcctgaaatgaacgaccattttttttttttttattttgagatggagtcttgctctgtcccccaggctggagtgcagtggcgtgatctcggctcaccgcaatgtccgcctcctgggttcaagcgattctcctgcctcaccctcctgaggcaggattacaggcgccagccatctcgcccggctaattttttaatttttagtagagatggggtttcaccatgttagtcaggctggtctcaaacttctgacctcaggtgatcagcccaccttagcctcccaaagtgctgggattacaggcgtgaagccactgcacgtggccggtttgcagtctttattgatgctttgctgtcaatcttactttaagatgaatgcatatatatgtgtgtgtgtgtgtgtgtgtatgcattctgtaatgtgtaactatatgaagctccagctgctctctccctccctctcctctgcagtccaatactcctagatcattctgttcctaaaatgaatgaccattcaggttttttttttttttttctgagatggagtctcgctctgtcacccaggctagagtgcagtggcatgatctcggctcactgcaatgcccacctcccgggttcaagcgattctcctgcctcggcctcccaaagtgctgggattacaggcatgagccaccgcgcccggccagaattcagttttttttttttccccatggttatccaatagcacacaggctcgtgaagccttcaaggtgcttcatctgaggttcgcttagaatggttgccacatattgttctgccggtgagttttcatgaattggactctgaaggttcttaattatggtggttgagtgacacggtctttcttctataagaacctaagttacactgcatatcaggaaaatgtgttcctgggaccagctttgttgggtttttggctgctggtcatcttcactttactctcccaaatttgaggactgtgacacacacacacacacacacacacacacacacacactctctctctctctctctctctctctctgtctctcttaggaaacaatggtatatcaacaatgaaatgatgcttttttttcttcttcttttttttttgagacagggtcttgctctgtcacctaggctggagtgcactgatatgaacatggctcactgcagccttgctctcccaggctcaagcaatcctcccacctcagcctcctgagtagctgggaccacatgggcacaccatcacacctggataatttttgtatttttagtagagacggggtttcactatgttggtcaggctggtcttgaacttctgacctagtgatttttctacctcggcctcccaaagtgctgggattacagacatgagccaccagactcggctgagcatcttttcaatatgaccttgtgtccgggcatggtggctcacacctgtaatcccagcactttgggaggctgaggtgggcggatcacgaggtcaggagatcgagaccatcctggctaacacggtgaaactccatctctactaaagatgcaaaaaaaattagtcaggtgtggtggcgggcacctgtaatcccagctactcgggaggctgaggcaagagaatggcatgaacccaggaggcagagcttgcagtgagccgagattgcaccactgcactccagcctgggcaacagagcgagactcggtctcaaaaaaagagaaaggattcaaggcagtgtataccaaacatgaaagtaaagttcaggaacctctttgatggaggagatgacggtggggtctgtagcctgttcatgcctataattgcaacacgtcgggaggccaaggtgggaggatcacttgaggccaggagtttgagatcagctcggccaacatagtgagaccccatctctacaaaaataaaaataaattagtggggcatggtggcacacacctgtagttccagctacttgggggactgaggcaggaggatcacttgaaaacaggagtttgagatcagcctgaacaatggagcaagaccctgtctctacaaaagattaaaaaaaaaactggcagatgtgctggcacgtgcctgtagtcccagctgcctaggaggctgaggcaggaggattgcttaagtctgggagtttgaggctgcagtgagctgtgttttcaccactgcactccagccggggtgacagagcaagaccctatcagtagtagtagtagtaataataataataataataataataataataataatatgttgctgcaaaagtaattgctgcttttgccattaacttttgcaccaacctcatgataaaacaacaaaaactcaacacctgtacctgccatgccctgaagctcatgacagtagacaaaactcactgtgtctccagccctcagtgttagatgaagggaccagggtgtgggaagatcagcagttcaaacgggaatcataaaacacatagtttttatttttttagttttgttttattatttatttatttatttttgttgttattatttttctgagatggagtctccctctgtcacccaggctggagtgcagtggtgtgatctcggctcactgctacctctgcctcccgggttcaagtgattctcctgcctcagcttcccgagtagctgggattacaggtgcgtgctaccatgcccggctaatttttgtacttttagtacagacggggtttcaccatgttgattgggctggtctcaaactcctgacctcgtgatccgcctgcctcggcctcccaaagtgctgggattacaggcgtgagccactgcgcccagcccccatgaaacatatagatattttcaaaacaactgtactaggatcaagaaggataggacttttgtttttcctgttttttaagaatgaaatatcatatggcgtaagcatagatttatttatttacttacttatctattcatttatttttagagacaggatcttgctctgttgcccaggctggagtgcagtaatgcaatcatagctcactgcagccttcaagtcctgggctcaaacaatcctcccatctcagcctcccacgtacctgggactacacatgcaagccaccatgcctggctaagttttaaatttctttgtagagatggggtcttgctatgttgcccaagctgatctcaaactcctggcctcaagtgattgtctcaccctgacctcctaaagtgttgggattacaggtgtgacccactgcttcctgcctagactttttttttttttttccaattaaggtttttactttgagatcattgtagatttataagcagttgtaagaaataataggaaagaatcttgtgtctacttcccccagtggtaacatcttggaaagcaataataccatgtcacaaggaggatattcacattcaggcaataatgcattgatcttatgttttactcgtatccgtgtgggtttttgtaccgagttctgtgcaatttcatagtgcgtgcaggtttgtgaagccagcattgtccgcaacacacagagcatttctttcaccaacaacccctcctgtttctctctctgcatcctacctcaacctcctctcccgtcctgaacccctgagaattactagtctgttctctatttctgtaccaacctgcatcctacctcaacctcctctcctgtcctgaacccctgagaattactagtctgttctctatttctgtaccttttctcatgtcaagaatgtcatataaatggagtcatacagagtgtaacccctttcaaatcacgtgtgtctttttttccttcactcaatagaattccctggagagccatccaagttgttgctaagaacaataagatgtttctttttaagtaacacctgcaaaaagtcttttataaaatggcgatgaaactaaatggtttttgattctaaacaaggcagccatgaatggttttctcgtatatcttagcatatgtgtgggagtgtatctgtgcaagtaattcttggaagtggaatagctgagccaaaaagaaaatgcatgtaaattttcttttctttattttaaagagacagcgtcttgctctgtcacccaggctggagtgcagtggtgcaatcatagcttgccgcagcctcgacctcctgggctccagtgatcctcccatttcagcctccagggtagctgggactacaggcgagcatcaccacgtctggctaatttatttttatttttgtagaggtagggtcttgctatgttgcccaggctgggcctcgtgctcctagcctccgctgatcctcccaccttggcctctcaaagtgttgggattacaggcataagctaccaggcctggctgcctgtcacctttcaggagtcattgtcaacttatctcctaagaaaatgcagtcttggtgggtacatttgaactgagtatgtaaacttctaacttctccaaggcatacgcattctggataacaaccctactttttaacctattccatgtgattgatgaaagctcacaattgctttattcattatttcattgtcagcgagactgaactttgtttcatatgcttatgttttatttcatatctccaaattgcatattcatttcctttacccatttgtggagggactggggtttggttagaagagctctttatagaccgggcgcggtggctcacgcctgtaatcccagcactttgggaggccgaggcgggcggatcacgagatcaggagatcgagaccatcctggctaacacagtgaaaccctgtctctactaaaaatacaaaaacaaaattagccgggcgtggtggcgggcgcctgtagtcccagctactcgggaggctgaggtgagagaacggcgtgaacccgggaggtggagcttgcattgagctgatattgcgccactgcattccagcctgggcgacagagcgagactccatctcaaaaaagaaaaggttagaaaaatacaccatggaatactacgcagccataaaaaggatgagttcatgtcctttgcagggacatggatgaagctggaaggcatcattctcagcctaataacgcaggaacagaaaaccaaacaccacatgttctcacttacaagtaggagctgaacagtgagaacacagggacgcagggagggggacatcacacaccagaacctgctgggggctggggaacaaggagagggagcgcattaggacaaatacctaatgcatgcagggcttaaaagctagatgatgggttgatgggtgcagcaaaccaccgtggcacatgtatacctatgtaacaaacctgcgcgttctacacatgtatcccagaactttaaaaaaaaaagaaatagtatttcaatatggtctgaattaggatgtctgttattagatataaaggagaacatatgtgttgagggccatttgagcctgttctgtatataaactcttatttttgcccttttctttgtagcatgtttggggtttttctggagttgaactttttagatatctgaaaaatagctgttaatatttctgatggaagttgcaaattttcttccagctcattatttattttttactttgcttatggagatttgttttgttttttaccatgtgattttttttttgagatagtgtcttgttcctcctggagtgcagtggcacgatcttggctcactgcaacctccatcccttgggctcaagtgatcctcccatctcagcctcccagcttgctggaactacaggcacgcaccgccacacccggttaattttttaaattttttgtagagatgaggcctctctctgtttcccaggctggtcctgagcttttggcctcaagcgatacccccacctcagccctcaaagtgctgggattacaggcatgagccactgcccggcctgttttttaaacaagtagttttttaaatagtgaaatctatctaaccatctttctgaattttcgtttaggaagcattttctttctgtggaggttaaactaatgattcctgctttcttgcaatcttctcatggtttaactttgtttttgccttggagttcactcatgcatgctatgaggtctggcactaattttatctgtttcctaatgtggcttcacgtgccccaacacggtttattaaaacgcccatcttttgccccttttgtcgtgtactcaatttccacatgcagttggcctatttttggaaattgtaccctgttccttcctccattaatgcctgtagtacctcccgtttaattatagaagcttctcaaatgttttaatctcctacagggccattgtgttctcaatctttgtacatatcagaattttcctctttgccgcctcatttggaattcttttccccacagcaattttcgaatcgattcgtccagtttgcctaaaagaaattctgtgaactatctttattggatcacatcaaatttgcatattgacttgggtcattctgacacctttaggattgtatcagtttagattttttttccccctccaacttctattttattttttaaattaaaaaaaattttttttttgagacggagtctggctctgtcgccctggctggagtgcactggcgtgatctcagctcactgcaagctccacctcccgggttcaagcgatcctcctgcctcagcctcccgagtcgctgggattacaggtggcacacaccaccacgcccagctaaattttgtatttttagtagagatgcggtttcaccatgttggccaggctggtcttgaactcctgacctcgtgatccacccgtctcggcctcccaaagtgctgggatgacaggtgtgagccaccgcatctggcctcaacttctattttaggttcgggggtacatgtgcaggtttgttccctgggtatattgtgtgatgttgaggtttggagcacaaggatcccgtcacccaggtagtcagcacagcactcaatagttttccaacccttgccccatcccttccttgccccattgaattgctcagtgtttattgttcccatctttatgtccatctgtacttgatgtttacctcccagtaagaagtgagaacgtctgatatttagtttcctggttctgtgttaattcacataggagaatggcctcctcttgcatctatattgctgcaaaggacatgatttcattctttttaatgggtgcatagtattccatggtatagatgcaccatgtcttcctaagaattgaattaacatttgagccagcaatcccattactgggtatctacccaagggaaagtaagtcattctaccaaaaagacacacgtactgtgtgttcatcgcagcactattcataaaagcaaagacatggaatcaaacttaggtgtctgtcaactccggattggacaaagtttgggggttttttttgtctttttttttttttttgtgagatggagtctagctctgtcgcccaggctggagtgcagtggcacaatctcggctcactgcaagctctacctcccaggttcacgccattctcctgcctcagccttccgagtagctgggactacaggcgcccgccaccacgccaggctaattttttgtatttttagtagagaccgggtttcaccgtgttagccaggatggtgtcgatctcctgacctcgtgatccacccgcctcggcctcccaaagtgctgggattacaggcatgagccaccgtgcccggccgtcttttttttgttttgttttgagacagtcttgctctgtcacccaggctggagtgcagtggtatgatcggagctcactacagcctcaacctcccagtcttgcgtgatcctctgaactcagcctcccgggtagctgagatgacagccgtgtgccaccatgcctggctaatttttttgtacctttttttttgttttgtagcaatggggcttcactatgttgcccaggctggtcttgaactcctgggctcaagcgatctgcctgccttggcttcccaaagtgctgggattacaggcatgagccactgcgcctgacccatttgggtctttggagaagcacacaccaagaaggaacatgatgggccagagatttactaggggaactgtgtgtgaagggtcaaacaggcgctggcagaagagtggaggaaggcttgcaggtgatggtgtaggtgcctcacacctgtgaagaaagagacggcgaggaattgggtagaaggagcgtccagccagttctctggtcatgccgagtcattggctgtgaaaacccaaaaccctgaggaagcccgatcttgcgaaacatgttccccatctgcagaggcaccgggtggctggtgtcaggcgattgttgcaacctgttgtgtgcgggggtgtctgtgtgggtacatacatacttctcagccccaatgccagcttcctggtccgtaaggaaaacactaaactcttctagctaaagttacaaatgcagcaagggtccattctgcaatctgtgatgcttttttttttttttttgagctggggtctcgctaccttgcccaggctgcggtgcagtggcacaatcacggctcactgtgcgttttcagggaagaccccacgggcacctccaaaaccatgtggcatgacatcctcaccgagacccgagggcatctttccatggcctcaactctacttttatgtctttaggtttcctgatataggttttgcacactctcgatgaccaagtctcatttcagtgttgctgttgtttctatattataagcaggactgtctcttcccctacctttttaacctgccaattgtttgtgtatgtatggaagctattgatatttgcttctgagttttctatctgactaccttcctgaattctcttcttggatttatttaatgttgattttgttagttttttcctggcataccatcatatcatctgcaaagtatattttgactctccctctgccgttcttgtgtctgttgtaattatttgtctgaccatgttggataagatctccagtagcatgttaaatgacagggtgcactcctggaatccagctctttgggaggccggggtgggaggatgacttgagccccggagatcaagaccggtctgggcaacacagcaagaccccatctttacaaaaaaaaaatagtaaaaaaaattagccaagtgtggtggctcacacctgtagtcccagctacttgggaggctgaggcaggaggatcatttgagtccaggaggtcgaggcttcagcgagccatgattgcaccactgcactgcagcctgggcaatgtagtaagaccccagctcaaaaaaaaaaaaaagcatcacagagaacaggatggatacttgctgcttttccaagtttagctggaagattttagagatttctttattgactaggaagttggcattggggctgagaaatatgtatgtacacacacagacacacccacacacagacacacatgtatacatacacagtatatatgcatactgtgtgtctgtaattacaatttaataatacattcctatttttaaaataaacttagtaaattaagaacatcaatacatctactgatactacatatagtatttgcaagtccctcagcttgggtcaggaacacgggaatgtcattgtacaggttctatcttcaggttacgagggatacaccagaaaacctaagcatatggaaaacttattcggcaattttctaagtgaacataccttttcatcgattcatgcgtgtatcaagaaaaacaaaatgaaagtcttacacaccaagaggattgttcgcacaatactgacaacgaaatgtacgggctgacaaataacagattatatgttgaagcctcctccacaggccccacctcctgataccatcaccctggcgattgtatgttctcaacataggaattattttggggggagaggagacacaacattttatacttggaaaggtgaaatggaaaagcagcataggctttattgttttattttattttattatactttaagttctggggtacatgtgcagaacgtgcaggtttgttacataggtatacacgtgccatggtggtttgctgcacccatcaacccatcatctacattaggtgtttgtcctaatgctctccctcccctagtccctcacctcctgacaggccctggtgtgtgatgttcccctccctgtttccatgtgttctcattgttcaactcccacttgtgagtgagaacatgtggtgtttggttttctgttcttgtgttagttcgctgagaaggatggtttccagcttcatccatgtccctgcaaaggacatgaacccatccttttttatggctgcatagtattccatggtgtccatgtgccacattttctttattcagtctatcgttgatgggcatttgggttggttccaagtctttactattgtgaacagtgctgcaataaacatacgtgtgtgtgtcgttatagtggaatgatttataaacctatttctatttaaattacctttgtatttttatagattttgtgggtatgagtacacttgtgttacatgaatatattgcatagtggtaatgtttgggctgttagtgaggccatcactcaaataacgtacatggtagccaataggtaatttctcatccctcatcccatcccaccctgtgagacttctgagtcctcgatgtctattttttatgctctatgtcgacgtgtacacattatttaattcccgcttataagggataacatgtggtacttgactttctgtttctgagccatttcacttaggataatggcctccagttcccttcgtgttgctgcaaaagacacaacatcattccttttcatggctgtgtagtattccatggtatatatgtgccatattttaaaaaatcaaattgtctgatggtggacacttaggctttatattttaataaagaacattccaaatatgttgaacaaaataatctcctaacttgaaaaagatcatatgtgcctataataattcacagaaagggactttcctgactacctgcctgcaaaatccacttttccctcagtctttctttctcaagggaattcatggaaattccctccttgaattttctcagcccccagtacaaggagtcattcttgcctcatcatgtccccctctctgtccttgtcttgtgatttctttttattttgaacgcgagaagtctgactcccaccagcacccctgtggccagtacctgtgagacatattctgaatccagcacctctcataccacctgtgctgaactgtggcggagctcccccgtcagtccctgcagctgcttcaggagacccttgatagccttgtcttcctccagctcaagtggattctccatgaatctattccttcctgtgaaacatatcacagattggctcagagccccgtgatgacgccctgtctgccagagagaagctcacgaactctggggtgcccctactccttcttccctcctctcttccctccttccatgtgcttggctccagctagccagccagccgccttcctcttcctggaatatcccaggcctgctagacttttgctctcaccgtcacaacatcagctcaggagcccctccttggaagattgttctctaaccctccgtccagaatcactgcttctccctttcctcttcttcctttgaagttcattcataactggaagatgtgagatctggaaagttctgcattattgccagacacatctgtgtatttagagtggttggtatctttcccaggggaaccaaatgtccttgaggcagacaacatgtttatctttgtctaattcatttccctgtatgctgggcacagagtgtgggctctacacatattttataaaagaaggagggaagggttagaagatggacagaaggaaggaggaagaaaggaaggaaagagggaggaaagaaaggaaagagggagggaaggaaagagggaaagaaggaaggaaagagtgagagaaggaagtaaagaggaaaggaagggaagggaaggaaggaaggaaaaagtgagagaaagaagtgaagaggaaaggatggaaggagaaaggaaggaaagggagggaaggaaaaaggaaaagaagaaagaaggagtgagacaaggaagtaaagaagaaaggagggaaagaggaaaggaaagaaggaaagagggagggaaggaaggaatgaagaaaagaaagagggaaggaaggaaggaaagaaggaaggaggaaggaaggaaaaagggagggaaggaaggaatgaagaaaggaaagagggagggaaggaaggaaggagggagggaaggaaagagggagggaaggaaagaatgaaggaaggaaggaatgaaggaagaaaggaaaaagagaaggaaggaggaaggaaggaaagagggaaggaaggaaggaaagatggagagaaggaagggaggacaagtggaaggaagaaaaagaaatacaaatctccctcaaaatgtggatcactcgtcttaaccagaaattcaagtgagatgctatctgcacgtgtgataccagcagctatgaagcaaactgtattaaccaagtcttttattttctgtgttctgatgcatgactttcatggccttgtcaaccctagagaccctgcccctcccatagctagcgaatccccagaggtggtgaagagcccacctatgaacctgtctttcatatgcaaacccatcaatccagaatccaccccccagccatctcctttattggggttgcatattccacgtcactctccacctgccctaaccaccccaaagccaggtaccagagagtcagggacagcccctatgccccagagcctgctgaaatcattcacactagccaactgtaagcctactcgcctgttccttcccttggaaaccacagtgagagctctggtctcctttgtcttcccacctgaccaaacttggtgcgcccctgtgtggtcctgagtggtgtcaacacgcccctcctcttgggacctgtgagtaacaaaccacttgcttaacggcagtctcctgatctgttggccccaccatacctacatcataataaagtctacattttacaacgcaaacgaacaaaaatgtcctgctcagtgctgccctgagagcagaggttattccaggattcttgctcgcctctgtaaagggtatccgttctgcagacctttctgccggtcacactgacggcatattgcagagcctgccagggactcacaggggatgacaggggatttatcaggtggttttttactgcactgtcattactgggggcgaatccactttaatacattcatgcctcctgagcctgtgggaattcaagaggaacagaaccagaaataaatgaaccataactccctttggcatcttgcctctctggaggcttaattcttacaaatatgtgctctgctttcaaatcttagtttgatgattttctcttcttctttttcagttttccccccacgacctgaccgtgtcgctatagtgacgggagggacagatggcattggctattctacagcgaagcatctggcgagacttggcatgcatgttatcataggtgatgacttttacagttacttgtgttttttgttttttcggtttttttttttttctgagacaggatcgcagtccgtcaacccgtgctggactgcagtggtgcaatcttggctcactgcagcctccacctcctgggttaaagtgattctcctacctcagcctcccgagtagctgggtttacagacatgcaccaccacgcctggataatttttgtatttttagtagagacagagtttccatatgctggccaggctggtcttgaactcctgagctcaagccatccgcctgccgtggcctcccaaagtgctaggattacaggtgtgagccactgcgcctggcagagttagttgtgtcttatacctaatgtgagctacttaggtgtcgattcagacatgtatgcaaatgttgatgtgcatatagaaaattcagtcagatccagaaagctcatgaaggtgatattcacaacctagaaaacacagaaaattgttgtacccttttggaagtagatatatattctgcttaaatattgatcctgtgtttctttcacatggtttactggaaaaaaataaccatatatctttatgactttactagggctgttataacaaagtatctcaaggagactggaggttgcttaaaaagccaaaatttatttttcacaattccagaggctggaagttcaatatcacagtgtaagtagggctggttcctcccaattccagaggctggaggttcaatatcacagtgtgagtaaggctggttcctcccgacacctcactccttggcttgtagacaccatcttctccctgtgtcctcacagggtcgtccctctgtgtgttttcatctcctcttctcctgagatgtcttagtccatttcaggcgctataacagaattaccatagaatgggcagcttatatacaacagacattgagtttcccacagtcctggaggctggatgtctgagatccaggtgtgggcagggctggttcctcctgaggcctctctccttggtttctctctgtgtcctcacagggtcatccctctgtgtgtgtccgtgtcctcatatgctctccttataaggacaccagttcaattagatcggggcccactctggtgacctcattttaccttaatcaccactttaaagaccttatttccaaacacagtcacattctgaggccctgggctttaggacttcaatttatgaattttgttcaaacacaagctcctaacagaatctgaacaatgttgcgggatacttgtttcttctgcaaccatgacctatagacactcacggtttgatttctgctcttctttttgaaaatttctctaaaagcttatcgtgatctctgactcctcttcctctgtgacctcttcaggtctcccttcaactgggaatatgaggacagttcaaattaacccattccactactgccaatggagacggagtggggggcggggaggaggggagagagtctattgcatacctggggaagtctaaatcagctagcttaaatgatgtgtggagacgagcttggaaaaataaaagccttaatgtgtattatgcccactcttgacactatctgcatttaattaattattttcagacaggatcctactctgtcagcccagactgcagtgcagtgacataatcatagctcactgcaacctcaaactcctgggctccagcaatcctcctgactcagcctcatgagtcgctgatatgacaggcgtgcaccaccatgccaagctcattttatttatttatttattattgttttttttgagacagaatcttgctctgtcacccaggtggaatgcagtgacacgacctcggctcacggcatcccctgcctcctgggttcaagcgactctcctgcctcagcctccagagtagctgggattacaggcgcccgccaccatgccctgctaatttttgtatttttagtagagatggggttttgctttgttggccaggctggtcttgaactcctgacctcacgtgatctgcccacctccgcctcccaaagcgctgggattacagtcatgaaccaccgtgcctggccctggctcatttaaaaaagttattttggcggctgggcgtggtggcttatgcctgtaatcccagcactttgggaggtcaaggtgggcagatcacttgaggttaagagttcaagaccagcctggccaacatggtgaagccctgactgtcctaaaaacacaaaaattagctgggcttgggggtgagtgcctgcgtggtggtgggcgcctgtagtcccagctactcgggaggctgaggcaggtgaattgcttgaacctgagaggcggaggttgcagtgagctgagatcacgccactgcactccagcctgggtgacagagcgagactcagtctcaaaaaaataaacaaaatgttttggagatactgggtcttgctatgttgcccaggctggtcttgaactcctgggttgaagtgatcctcccaccttggcctcccaaagtgctgggattacaagtgtgagccactaggcctgggcaccctttgcttttaataacttttatggtgtctgcttttataaacatcatactgtaggtctggtttgagatatgcaggatcgtattgacttaacactttccaggacgggagcagtggctcatgcctgtaatcccagcactttaggaagccgaggcgggcagatcacgaggtcaggagatcgagaccatcctggctaacatggtgaaaccccgtctctactaaaaatacaaaaagtagctcggcatggtggcgtatgcctgtaatcccagctgctcgggaggctgaggcgggagcatcgcttgagccagggagccggaggttgcagtgaaccgagatcgcgccactgcactccagcctgggtgacagagtgagactctgtctcaaaaaaagactttccaaaaccaatgcccattattgattgacttcttcctctccgccattctctgtccttctttcccttgttgtcattatggaaagatgatcatggatcataaacaatgcttagggctggagatttcaacatgaatttgtctcagttcttccttatctttgaggagctctgtccaggacagacacttttctgggccttgaatgcctttgcgatagcccaaaaggctcaagcataagagcatgagtctgatctggtgaccagggctcagcaaagagtctttccaggccttgaacctctggacatctgttggtgctcattggacaggctaaaagtcatcatgttacgaatcgatgaagttgacatgcagataaaaggtataaggaaaaaatgaactctccacatcattgtatgcattacatctatacgataaaaactgtgatatactcatgcgtttaaatagctgctctggtcctgggcctcatgcgtttcaatagctgctagcgttctgagcctcgatggccatccacttggctttgagttagctctctccaaaaatctccatggcagtttctgctggggcaaatgcacggctgctgcccacacctctgtgttttctcatcttcatttacaaaagaagaaaatgctaaccttgctgatgctaacctcctgaatttcatgcaggaatccccaggagtctttgactcagatggggaaaccccatgttcagcccatgtggccttctggtctccctggagatgcgtggtccatgtcagcgcacatggctccttgctccgtccttcacttaagtttgagcctttttggcttttgcaaaacatgaatgcaaaacttgaaatttttctatgtcatggctcttcccaactttcacatttttgagacagcgtctcactctgtcacccaggctggagtgcaatggcgtgatctcagcccactacaacctctgcctcctgggctcaagcgatcctcccacctcagcctcccaagtagctgggaccacaggcgtgcaccaccaggcttggataattttttgtagttttagtagagatggggcctcaccatgttgcttggacttgtctcaaacacctgagttcaagcgatctgcctgcctcggcttcccaaagtgctgggattacaggtgtgagccactgtgcccagagtcttttaaaataataattttgtacacgcagttccattcctcatataaccatctttctctgatgcacttcagggtttgtaaaatagtatacagagatgtgtactgtttcacatgatgaagcttagttgtattagataatgataacatcgtgtttggctatgtcataatgaggcaattgagtagaatataatgaaatcttgttggattagttaatgacttgttgagcttcggaagcaggtgagcactttttggtctatatcagtctctttctttccatcaagcagttattttcctcaaagttgtgcctaactcccacttgagcattttttttatccattctttttttttttactttgacatgaagtctcactctgttgcccaggctggagtgcagtggcgcgatctcagctcacttcaacctccgcctcccgggttcaagcgattctgctgcctcagcctcctgagtagctgggactacaggagcacaccaccacacccagctaatttttgtatttttagtagagacggggtttcaccatgttggccaagatggtctcgatctcttgaccttgtgatccacctgcctcagcctcccaaaatgctggtattacaggcgtgagccactgtgcccggccccattctctttattttattttattattttattattattattattattattttttgagatggagtttcgctgttattgcccaggctggagtgcagtggcgcgatctcagctcaccgcaaactctgcctcccgggttgaagcgattctcctgcctcagcctcccaagtagctgggattacaggcgcgtgccagcacaccaagctaattttttgtatttttagtagagggggggtttcaccatgtaggtcaggatggtcttgatctcttgacctcgtaatttgcctgcctcggcctcccaaagtgctgggattacaggcgtgagccactgcgcccggcctcattctcttaatagactgggacaagttaaaactttatgacaatttcttgaaattgtcaagttcatccatgtccctaactctcctgtcttggtgtgtttgggctgctgtagcctgagtgccttgcaaaccatagaaactttttttttaaaattttattattatactttaagttttagggtacatgtgcacaacgtgcaggtttgttacatatgtatacatgtgccatgctggtgtgctgcacctattaactcgtcatttagcattaggtatatctcctaatgctatccctcccccctccccccaccccacaacagtccccggtgtgtgatgttccccttcctgtgtccatgtgttctcattgttcagttcccacctatgagtgagaacatgcggtgtttggttttttgtccttgcgatagtttgctgagaatgatggtttccagcttcatccatgtccctacgaaggacatgaactcatcatttttgatggctgcatagtattctgtggtgtatatgtgccacattttcttaatccagtctatcgttgttggacatttaggttggttccaagtctttgctattgtgaatagtgctgctataaacatacgtgtgcgtgtgtctttatagcagcatgatttataatcctttgggtatatacccagtaatgggatggctgggtcaaatggtatttctagttctagatccctgaggaatcgccacactgacttccacaataaaccatagaaacttattgtcctacagttctcaaggctggaagtcccaagaccagggggtcagtgtggtcagattctggtgtagtctgtcttctaggttgtggatggccactttctcctgtgtcctcacatggtggaacctggatggggtctcttttataagggtactaattccattcattgtgctccaccctcgtgacctaatcatcccgcaaagcctccgcctcccaacagaatcactggggatgttagaatttcaacataggaactttggagggatacaaacattcagtttattgcgccccctctagatgcaaaaggattgggtttagatgaggagaccccaggggagagggtgcccatctgagagtgtatttctagaacttcttatgaacttgagcacctccatgatctgtttacatctccctgggacctgagtaaattagagacaagatgtagggcagggggggttctgagatttagcttggagactgtgaggtggtgatggatggcaacccttggttttgaccatccatgctaggtggatatctgctgtatcattaacaacatgacaaactttccaggactttctatatctcagacttctgccaatatttgagatgactgggtcaaaatgatgctgattttttgaacagggagagcaataggtattctctgaaggttggctggatgtgagcctagtggcttcaatgatggtggagtaggatgaagagagaccctcaaggttgaacaaagatgggagggctcacatccattactggttatatttgatcttttgtctcctccagtgcaatgatctttttcatcttcttaattcttaatttagctaggcaatgtttaattattagtttaattcttaatcaaactaggaaaggaagaaaacaccccatttctttgtgcttttttgcctcattgtggtggtttaggtcatgatgaggtctagttgggcaggtcatgatgaagtctagttgtattaggttctgatgatgtctggttgagttagatcatgctgaggtacagtttggtttggtcatgatgaagtctagttgtattagatcatgataacgtctcctttggttatgtcatgatgaagtagttgagtagaatgtaatgaagtcttgttcgattagatcatgatgactggttgagttaggtcattatgaggtatggtttgattaggtcttaatgaagtctagttcagtaacagcatgatgagatctagttggattagacttgatgatgtgtgacttatttaggtgatgatgaaatcttgttgggctaggtcactttgagatctaattgggtaggtcatgatgaggtcttgttgagttaggtcctgatgaaatgtagttgagttaggtcacattgaggtctagttgggtaggccatgatgaggtctatttgtattaagtcatgatgaggtttggttgtattagatcatggtaaggtacagtttggttaggtcatgatgaagtctagttgtattagttcatcataatgtttagtttggctatgtcatgatgaggtagttgagtagaatgtgatgaaatcttgttggattagattaggatgactggttgagttagatcattatgaggtgtgatttaattaggtcttaatgaagtctacttcagtaatagcatgatgagatctagctggatcagatcatggtgatgtgtggtttggctaggtcatgatgaagtctagttgggttaagactcaatgagttctagttgggtcaggtcacattgacgtctagttgggtaggtcatgatgacgtctaattgggttagatcatgaggagatctagttaggaaggtcatgatgaggcctagtggatagatcatgatgaggtctagttgggttaggtcatgataaggtctagttggattaggtcatgataaggtccagctgggttatgtcatcatgaggtagttgaatagaacacaataaagtcctcttggattagatcatgatgacaggttgagttagatcatgatgatgtgtggtttggttaggtcacagtgaggtctagttgactgaggactttgtaggcacaaagcaatgaagacatgtgagcaagcttcttgttcatgtgcatgggaatctcaagtgttaccacttcatttagatgatgtttactgagcatcaggagcagtatatgtcagcaccaatgtgccttttttcttgagataaacagaaagtaaacaccacatctgcaccccacctgtgtctcctatcccacagagctcctgatgtcagtgtttaattttcactgtgagttacagttttgacccttcaggtcaatccaatcaattatgcagtcttatttcccctgtgtgactttgaggataattggatatattctgagagaggcattttttcattttgtatggcagtttgattcaaagtcaattaatgaaaaaatatcattgaacacaatgaattttatattaaatacaaaataagagatgggaaatttaacttcaaaattttaattaaaaatttattaatatttaaagaataatcaattacttgtaaaataattcagattataacctgggtccaactgaagcacattaatattactagacacatatatcagttgttcaaattcccatctgtccacaagatcttagttctcattgtttcaaaatattattttggtgggggatcattttttttcataatgctcaatggactgtcatctaagatgaaagtggggtgggtaaactttttctgtaaagagacagataataaatgtgttcatatgtttctctcataactatgagctctgccctagtagtgagtaaccacccataggtaatacttaaaacaacaggaaagtctatgttgctgtaaaactttttgtacaatatccagctgcaggccaggtttagccgcagattggtgactctggtttgggctcaaaatctttttatttagtaagaggaaattatactgcttttttccaatataagaaatctcttgtacagtcctcaggaagggtagataatgatgaggtctagttgggttataatgaagtttagttgggttatgatgaagtctacttgggttggtcatgatgagatctagttgtattagatcctgatgagatccagttgggtaaggttctgatgaggtctagttgattggtcatgatgagacttagttaggctataatgaggactagttgtgttggtcaggatgagatcaagttgtattaggtcatgacgagatctagttgggtcaggttgtgatgagatctggttggttggtcatgacgagatctagttaggttatgaggaggtccggttgggttggtcatgaggagaactaattgtattaggtcttgatgagatctagttgggttaggttatgatgaggtctagttgggttggtcatgatgagaactagttgtattaggtcatgatgagatctagttaggttctgatgaggtctagttagattggtcatgaggagatctagttgtattaggttatgatgtgatctaattgggtgaagttattatgaggtctagttgggttggtcatgatgagatctggttgggttaggttatgatgcgatctagttggttggtcatgatgagatctaattaggttatgatgaggtctatttgggttggttgtgatgagatctagtcatattcagtcatgatgaggtctagttgggttagattatgatgaggtttagttgggttaggtcatgatgaggtctagttgggttagggtatgaggagatttaattgagttaggttatgatgaggtctagttgggctggtctttatgagatctagttgtattaggtcatgatgagatctaattgaattatattacgatgatatctagttggttggtcatgatgagatctagttgtattaggtcatgatgtgatgtagttggggtaagttatgatgaggtctcattgagtttgtcatgatgagagctagttgtactagatcatgatgagttatagttgggttaggttatgatgagatctagttggttggtcatgttgagatccagttaggttatgatgaggtccagatgcggtggtcataatgaaatctagttgtattaggtcatgatgagatctagttgtggtaggatatgatgaggtctagtgcattggtcatgatgagatctagttgtattaggttatgatgagatctagttggattaggtcatgatgagatctagttgtggtaggatatgatgaggtctagtgcattggtcatgatgagatctagttgtattaggttatgatgagatctagttggattaagttataatgggatctgtttggttggtcacgatgtgatctagttaggtcgtgatgagttctagttgggtaggtcgtgatgagatctagttgtctcatgtcatgatgaggtctagttgggttaggttatgatgaagtccagtttggttaggtcatgatgaggtctagtgggattggtcattatgagaattagttgtattaggtcataatgaaatctagttggcctaggctatgatgagctctggtaggttgttcatgatgagatctacttgtattgggtcatgatgagacccaggtgtgttaggttatgataagatctagttcgttgtcataatgagatgtaatttgtttatgatgcagtctagttgtgttgctcatgatgggatctagttgtattaggtcatgatgagacctagttgggttaggttatgatgaggtctagttggtttggttatgatgaaatcttgttggattatgtcatgaggagatctagttggatggtcatgatgagatataattaggtcatgataaggtctagttgggttggtcttgatgagatatagttgtattaggtcgtgatgaggtctagtttggttaggttatgatgaagtctagtttggttaggtcatgatgagttctagttgggttagggtatgaggagatttacttggataaggttgtgatgaggtctatttgggttggtcatgatgagattttgttaggtcatgatgaggactagttttgttggccttgatgagatgtagttgtattaggtcataatgaagtcttgttgagttaggttatgatgtagttaagttgggttaagttatgatgaggtatagttgggttggtcatgatgagagttagttaggtcacgatgaggtagttgggttggtcatgatgaaatctagtcatagtcagtcatgattagttcttgttgggcttgtttataatgagatttagctgtgtcaggtcatgatgaggtctagttgagttggtcatgatgtgatctagttgtattaggtcatgatgaggtctagtttggttaggttatgaggtctagtgtcgttggttgtgatgagattcagttaagttatgatgaggtgtatttgggttggtcataaagatacctgtttgtattaggtcatgttgaggtttatttgggctaggttataatgagatttagttgggttaggtcatgatgaggtctagttgggttagggtataatcagatctatttgggttaagttatgatgaggtgtattttggttagtcctaatgagatttagttgggttagagtatgatgaggtgtagttgcgttggtcatcataaaatctagttttgtaggtcacaggaagtctagttggttaggttatctaaattgcaactgtcttttaaaaatgacttgtgccacatatactttgtattgtccatgaatagtacatgtgaaacgtgtaaaatatttaaacttgtatttaattatctatttacttattttaatagacaaaaacaagttacatatttttatggtgtacaaaatgtggttttgatatatgtttccatctggaatggccaattcaagctaattcacatatccattaccttacatgtttctttttgtgtgtgtttttggaaacacttaaaatctactctctttgcaattttcaaatattaattatagtcactgtgactaattatagtcaggttcaagattatagtcactaatttagtcaccttaagtacaatagatctcttgaacttataccttctgtcaaactgacatttggtgtcatttgaacaaaatctcagcaacccacccccctagcacctggtaatcaccataattctttttcttttctttctttcttttttttgagatggagtctcactctgtcaccaggctggagtgcagtggcgcaatctcggctcactgcaacctccacctcctgggttcaagcgattctcctgcctcagcctcctgagtagctgggactacaggtgcatgccaccgtacccggctaatttttgtatttttagtagagacaggcttttgccaggttggccaggatggtctcgatctcttgaccttgtgatccacctgccttggcctcccaaagtgctgggattacaggcatgagataccacgcctggccaataatcatcataatactttttcttgtgagttcaacttctggagactctacatatgggtgagatcatgtgggatttggttttatgtggcttattttacttaacatgatgtactcctggttgatccatgttgtatcacaggatagggtcctctggttttcaaagactgaatggtattccatggtgtagctatcccacattttatttatctacccatccttagatggacacttaggttggtttcatatcttggctcttgtgaatcatgctgcaacgaacatgggggtgtagatatctctataaggggctgatttcatttcctttggatctatacagaggagtgagattgctagatcctatggtaggcataatgatcattttttgaggaactcttaaaaaaaaaaaggccacccctttagacacaccttaaaatccaacctttctggtcaaagacatttgaaaaaaatgacgacaacatcaaactatagtctcctgtccaagcacgttcacttcctaagatgtgaaaaaaaccaggccgggtgcagtggctcatgtctgtcatcccagcactttgggaggcaaaggcaaacgggtcacccgaggtcaggcgttcaagaccagcctggccaacatagtgaaaccccatctccactgttttccataatggctataccaatttccattgcacatataacatgtaacgccctcccctgcccccccaaatacaaaggatgaagcagaaggcagatgcactgtgtttgggacgtgtgcggtgtttctgcatatgcagtacttgctcagcaaatgtaggaaccactccagcaaatgcatatgaggccaaatgtcccacgtccagttccttaaagcagctccctccaggtctgaggagacaattgctgaaggtgacattggccaaagaagataccgcacgtgccacctcaccttctccattcctccagtgtggtgcttctgtcctatgccagcgttgacggtgccaccatggaaaatggcctgcccatgaaggtggtcttcccaaataatcacttcacctggctttttttgatgctcccagctttttctggtcacttttgtctttcttgagaaggtggaggctcccatcttacttcgtcccagcttccggcatgtttccctttgtttttttttgttttgttttgttttgttttctttttgagatggagtctcgctgtgttgcccaggctggagtgcagtggcgcaatctcatctcactgcaacctctgcctactgggttcaagcaattcttctgccttagcctccagagtagctgggattacaggtgcctgctaccatgtctggctaacttttttttttttttttttttttgggacagagttgggctctgtcgcccaggctggagtgcagtggtgtgatctcagttcatggcaacctctgcttcccgggtcctggttcaagcaattctcctgcctccgcttccctagtagctgggattacaggcacacatcaccatgcccatctaatttttgtgtttttagtagagatggggtttcctcatgttggccaggctggtcttgaactcctgacctcgtgatccgcttgcctcggcttcccaaatcccaaagggctgagattacaggcatgagccaccgcacccggccgcaccctttgatcttgagatggctgatacggcagagcagcccagcagtggatgagtgcttacatttaaaaagttcatgggatttcataaataagctcatgaatgtacaagtccccagtgtaaaggttaccttgactttgaatttttttatcctttctttttttgttttgtgtttgatgcataggacatttatagatggaatatacctttcaggctatttcttcctctccctcccgtcgaaacccacctccctgaaatgcctgctgcctcctcagtgccaaaggactgtcaaagcaaaaatgtaataatggtatcatgttctgtttctttaaggaagtcaaaggtgcaaattacctttgcagcttcagtcttctgatgtctgcaactttgaattccttcaaggaagtgacaatttagatattccatttactctgccccaaaggatggactttgcactatttatcttagccgtctcccactggagccaaaaacatttccaacttcataagtttcactgcttctcctcttttatatattttttcactctttgctgaaaacattttcattgttttttgaaaagtgcattctaatagttaatttgggagcccatggccttaacacagaagaaagaataccgaatacaatgataggatatcaaacagcatggtctcttccttgtgttagagtgtgtaaattcaatacgccgtgttgactcagtattcaggaatgccaaagagagggattatttggtaatgtattttcatggagacccggggacggtgctgtactacagaacacctcactggcccgggctgggtgcaggtaggatggagatagaccggccccacccccttggtaactgctccttgcagatcagctgtttgaagctctccgggcacccaagacgttcttgttcaagcctgtgcgcttcccctgctagttctcatctcccttctctcaacactttttccgtgaccctccctgaaagggagttttgggcttggctcaccctggaaagcagctaatcccacatgttgccaacaggttaatgaaggatgaggctgaaggaggaaaaatttgccaaactcctttcccctaaagagccgccccttcagaaacaccttaaaatccaacctcccgggtcaaagacatttgaaaaaatgacgaagacaacatcaaactatagtctcctgttcaacgcatgttcacttcctaagacattaaagaaaccaggccgggtgtggtggctcatacctgtcatcccagcactgtggaggccgaggcgggaggatcacctgagatcaggagttcaagaccagccttgccaacatggtgaaaccccctctctactaaagatacgaaaaaattagctgggcatagtggcagtcacctctaatcccagctactcaggaggctgaggcagcagaatcacttgaatcagagaggtggaggttgcagtgagctgagatcgcaccactgcactccagcctgggcaacagagcaagattctgtctcaaaaaaaaaacaaaacaaaaaaacaaaacaaaaaaacccaattaacattctttcaccccggatttcctagtctttattttagctataacaagcaaaacacctctttccatccttctaaaggcgtgttcctgaaacctcacttggagagttttacggaagtgcagtgagaggagtaagaaatcctgagcacacagccaactaacgcaggaacagaaaaccaaagaccccatgttctccttcataagtgggagttgaacaatgagaacgcatggacacagggaggggaacatcccacaccagggcctgtcgaggggttgagggggcagggcagggagagcattaggagaaatacctaatgtagatgatgggttgatgggtgcagcaaactgccatggcacgtgtatacctatgtaaccaacctgcacattccgcacatgtgccccagaacttaaagtagaattaaaaaaaagaaacagaaagaaatcctgagcacgtagtaggaaccacggtctgtgatcacgtgcatcgtgcagtctgtgtgtgcacactgggatgtttccagcataaaagctccttcgaaaattcgtttccatcctgacattttaatgcacattttttatgcttatgctattctcagctctcacgtgcaaattacaccagcaggtgccccgggtccctgtcactattgaaaagtagaatgtcaaatgcatttgtactttttgccaatgcaggctaaagaaaatgactcttaaatggatagctttagtctgccaaaatggctgtcaagttagacgctaggataaagggaaagtccatcaaaggcacatttcagatttgtgttatacttctcttaaaacctctttttttttttgcagttaatagtttctggataatcctacaagtcaccgtatcttttttttctttttccttttagctggaaataatgacagcaaagccaaacaagttgtaagcaaaataaaagaagaaaccttgaacgacaaaggtaccgagagatactccaatggcttttttttgtttttttttttccttgggacaggtcgtttgcgtggttcatggctgagcttcagtcacgtgccaggtggcatttgggagagatggctctgatttttgcactcttcttttggggatttctggccccatcctagagcaggagatggtcaaggcaaggcgaagatagcatcactcagctctgacatctgctaggaaaggcatgcagatgtgctggtagcttgcactcttactcaaatgtgtgttccccagggaacaggagccattgtcctttcctgttgacctccagggcacatgccaggaggtgcctctgctggttgggagttcttgacttaagataaatcaggccgggcgcagtggctcgcgcctgtaatcccagcactttgggaggctgaggcgggtggatcacgaggtcaggagttggagaccagcctggccaacatggtgaaacccaatctctactaaaaatacaaaaattagccaggcatggtggcatgtgcctgtaatcccaatgacccaggaggctgaggcaggagaatcgcttgaatctgggactgcctgggagagagagcaagactccgtctcaaaaaaaaaaaagaaagaaagaaaaaaagataaatcaaacaggaatatgcttgcccttaagattttcgaccaggtgctagaccaaattctggtgtgctctttctgtctgttcacactaaggaaggtgtgcacacaactttctaatatccatctagattctcaatgctctgtccttttatttatttattattttatttttcatttgtatacaggtagggagtgcaagtacagttttgttaacatggatgaatggcgtagtggtgaggtctgggcttttagtatagctaacacctgaatcacgtacattgtacccgagaggtaatttctcatcccttgctcctcttccacctcccacccttctgagtctccagtctctgttattccactctttccatgtggacacattatttagctcctgcttataagtaagaatgtaggaggtcggtcagggtggtaggaaaaattgtagaagatgcaaaccttcttgggaggccagaaggttttgcaaatgctcccgaataagatttggctgaaggcagccagattctcttatccagtgcctgaaagcttaggttagataacgaggggatgtaaagaaactgatctagataagttagtttgcttaggcctcagaacctggcctttaatcatccacgcacagaactactctctccctctctccgggttgcgggggacgaccatatgaattgcccacgaatgtgttgactcaaggcctttgtcattaaatgtatactaaataaaggcccacagcagcagcttgtcaaagccgtggctgctgactctttaaaacaccctcctcagtgtctgtgagtggccccatcccctagcccacgctttcactggaaatctgtgtctgagtgcatttgttcatccgtcgctcagccaaagtctgcgagtcggacccagcaaattggactcgacctaagaagaatggtatttgactttcggtttctgagttatgtcccttagggtaatggcctccagttccatctgtgttgctgcaggagataggatttcctcctttttcatggctgcatagtattccatcaggtatagatatatattttctttatgctttcgtgtgttgttggacacctaggttgtttccatatcttggctcctgtgaatagtgctgcaatgcacataggaatgcaggcatctctttgatacactgatttcatttgctttgagtctgtgcctagcagtggaattgctgaattatgtggtgcttttatttttaatgatttgaggaacttctgtactgtttttcatagtgactgtactaattgacattcccaccagtggtgtacaagggcccccttttctctacaccctccccaacacttgtaattaactgtagaaatcatcattctggccagcgtggtggctggcacctgtaatcccagcactttgggaggccgaggcgggtggatcacctgaggtcaggagttcgagaccagcctggctaacatggtgaaacctcgagtctactaaaaatacaaaaattagccgagcgtggtggcaggggcctgtaaccccagctactcaggaggctgaggcaggagaattgcttgaacctgggagttggaggttgcagtgagctgagatcacacctttgcactccagcctgggtgacagagcaagactctgtctcaaagaaaaaaaaaaacaaaaaacaaaaaaacacaaacaaaaacacccttctgacaatatccattttagctggtgtgagatagtagctcatggtggttttcatttgcatttccctgatgattagtgatgttgagtaccttttctttgtttatttttttgtttctttttgagacggagtctcactctgtcacctaggctggaatgcagtggtgcgatctcggctcactgcaacctccggctcccaggttcaagcgattcttctgcctcagcctcctgagtagctgagattacaggcattggcgaccatgcccagctaatttttgtatttttaatagagacggggtttcgccatgttggccaggctggtctcgaactcctgacctcgtgatccgttcgcctcagcctcccaaagtgttgggattacaggcgtgagccactgcacccggccgactaccttttcctataagcaccttttcatatacctgttggccatccaaatgctaagtgcttttctcggccatgtttatgtgtggtaccttattttttttttttttttaaatgcacatcccttccttggctgtttgaatttgagatggtgttttgagaattcccccaagtgggggatgggtgtattttgattctttatttgtttgtttgttttttgatacagggtctcactctgttgcccaggctggagtacagtggtgttatctcggctcactgcaacctccgcctcccaggcccaagtgtttctcctgcctcagcctccccagtagctgggaatacaggtgtgcagcaccacacccagctactctttgtagagttggggttttgccttgttgcccaggttcatcttgaactactgggttcaagcggtccattcacctcggcctcccaaagtgctgggattataggtgtgagccactgtgcctggcctattttgatgatgatgacgattattattaatattttgagacagagtctcactctatcacccaggctggagtgcagcaatgtgatctcggctcactgcaacctctgtggcccgggttcaagcgattctcctgcctcagcctcccgagtagctgggattacaggcgcccacccaccaagcccggctaatttttgtatttttagtagagacggggtttcaccatcttggccaggctggtcttgaactcctgacctcatgatccacccgcctcagcctcccaaagtgctgagatgaccggtgtgagccaccgcgcccggccttgattctttttaaagccatgagagtgaaatgaacgctacacagagctgagcctggtcactgcctatgcccctatctcctcctttctaccctaagctgctgtgaaacaccttgttattacctctgccaagggctggggtatgttgaaatttcatagccggcattgcaggatccctgtgattttcaggaacacactcccacaggggctcccgctcagccagagccaagcccagtgtacaatgtcacagagtggcagcagcctggccagatcttttctcctcattaggatctgccttggggcaaaaggattggtttctgtgtagagggataattaaggaattagagacaccgaggggttgaggaggaattatttaattatttatttgtaccgaccccgtcggattaacatttaaaggaccgagttttgaacaaagagtttggttattttttaagtattttctggggcggggggagctctgtgtagggggaagtatatcatagaagtgagaaacaaagacagttgtttaattgacacatgcattatattattttttattttttaaggaataatatgttttatgatttgagattatttgcctagtgactttgtagctgtatagctagagaagcagagtttttataatgcttgggaaaggaagagacaaggcttattagccgcagaaaaacaggcagttaatttttaatggacttcaactctttctcttcctcagggagaactgggttttcttacatacaactgagtttttgcttatacatttttaaattttttaaaattcctgtttcatctgtgacagggggtcctattccctgccaccttggcccttcctcatttgcagcaggttttcaaaggagtggcattttctaacacaatgaatccaaaagtgccttctccgggcctgtcacatcagcatttccggggagtaaacaagaaatgcaggtgcccagggcccatctgtgaatcggggcctctgggggtgggggcggggccctggaatctgcattcttatgaggccgttaaatgatccccacgcaccttcaaatggtacacttgctgctgtcctgaaggcattcaaccatcaatctggagcccaaagagaagtttctggaaactgacaagtgaggcattcttttctcatgactttttgcttttaatctgaacggcttaaaaactatatatagttccccaaaattcacatatgtgatccacctaaccaaaatgacagccaagaaacaatgatttataatcaccaacttaattttattagattctgaaaatgtttcagatttagacaacatgaattttgaccaataattttttttttttttttttgagacagagtttcactcttgttgcccacgttagaatgcagtggtgtgatctcggctcactgcaacctccgcctcccgggttcaagcgattctcctgcctcagcctcccgagtaactgggatcacagacacccaccaccaggcccggctaattttttgtatttttagtagagatggggtttcaccgtgttagccaggcttgtctcaaactcttgacctcagatatccacccacctcagcctcccaaattgctgggattacaggcgtgagccactgcatctgaccacaataacaaatcattgctgttttcttggaaaagtttgtgtaggatattcgatcatcagtttttaaagtgcagtgttttgtggacaagtagcatgacgaatacatgatttgtccccaccattaaaaaatgttagtttacttgtggcatataaataccgatggcctttaagccaatcttacagaaaagaagaaaagaatcgtttgcactttctgtggctgtttaaaagctttaccatcttgtaagagggtgggaagatggggtgtgccgtggagatggttaatgggcacaaaaatatactttagatagaatgagtaaggtctcgtatttgatagcacaaaagggtgactacagtcaacaatccttcatggtccatttaaaaataactaaaagttgctggacatggtggctcacccctgaatcccagcactttggaaagccgaggcaggtggatgacttgaggtcaggagttcgagaccagcctggccaacatggtgaaaccccgtctctactaaaaacacaaaaattagccgggcgtggtggtgcacacctgtagtcccagctacttgggaggctgaagcaggagaattgcttgaatctgggaggcggaggttgctgtgagctgagattgtgccaccgcactccaacctggactacagagactccatctcaaaaaaaaaaaaaaaaaaaaagaaaccaattaaaggtgtaattggaatgttagtgacacaaacaagtgatgaatgctcgaggggatggataccctatttgccctgatgtgagtattacacattgcatgcctgtatcaaaatacctcattatcccataaatatatacacctactatgtgtgcatgcaatttttttttttaaaagaaaaaagtttaaaatctgaacaggtttggacattcatcagtggtggccctggtatgtccactgctgggggactctccagtccttgatagatgatgctgaggcccagctgggtggggacatttcggctgtggccattgagcctttacctcgactgagtctgcctccaggctcaggagcccccagatccgtggtccagccacacggcagggtctgccctctgcctgtgagtggtatctgctgcccacaacatcttatggacgaccacagctcctacaggcatcccttccctcctcagctgagacctgggcacacctccaccaaacccgtacgaaccttgctctaaattgtgcttctctctggactggcctgcacctgctggaactctgattcttgtccccacaacctccagttgcccagcgagggacagagggagctgaatgtgctgtttcgttcttgctctgctgggatcccggcatcgggtaaccccggttcagccatgtggatttatttttaagcaagtcggctcacgtcctgactccaggagcacagattgctgtggagtgtcagtcacacaattatttcaacatgctgggcgcctgtctagcctgctttcccctcctgcctttcctgctctcaattctctctccttagttcttgggttaatactctggcctgcgtactttgttgtactttctgtctttgaagtcgtgctcctctgagatcccacgctgggcagggcatgggaagctacgtgcccacagaaggacggctaattgagctctcggaattataaatgcgcgattgttttcaggaatctgggcgagatggctcatttcccaagctagggattttccagggaagcgttttcactccttatcatcacttagccattgtgcccacacctttgtggctcctgggtaattatgtgctgatgaaagctgtcttacttagaacaaatagtctcattcacttaccgaaactcctccaaatataaataaatcaaaccccagcggctccatgaaagcaaacacagaaaggcatagccgtgttcaaatgaactcagatggggagagataaccagttaaacactcttaaaagcactgaaggcaggcccattctcttttgcagctcgtacatgccatggtggaacccctgtaatcctaaatcctaagagagatcagactagacacgtgctgtgtatcctctttggaaggtgcacggtgtcctcattttctataatgattgtgtaactttaatcacaaacagcatcttctgattcatttagcttcctggctaggcacgatggctcacgcctgtcatcccagctctttgggaggcctaggcgggcagatagcttgaggtcaggagtttgaaaccagcctggccaacacggtgaaaccccatctctactaaaaatataaatgttagtcaggtatggtggcgggtgcctgtaattccagctactcaggaggctgaggcaggagaatggcttggacccgggaggcggaggtttgcggtgagccgagatcatgccactgcactccggcctgggcgacagagaaaaacttcatctaaaaaaaaaaaaaaaaaaaagcttcccaaatattattcttccagtagcttgtgccgtcttcatcagaagagggactagctgtttggttcatgtgcttccacccagttattagaccaagtttgttttcaataaaagaaatcactggtcaatgccttctgtaattgatgggtgtcaagaaggtaaattttgcacgccgccttgggaggcacttctactttgaaaatagatctttgtgaaccatcattttggcctatccaatgacctataaaatacttgaatttatcatgaaaacagaatactgtgaaatcaggatgaaggttgataacaggtcatcaacgtaattgagtagattgaaaatacaagagtcagtgaagtgtaggatgaatgcttgttgtcagtaagagagctctttgtgacccgttccacgtgcaagagatgagggttgttgttttgggaatactcaccctcctcatcgcctgtccctgctaaaatcagagctttgtgagggcagagatggattctgtgcacaggtatcttctgagtctctgattcagtgcctgaaacacagtggctcccgagacaatctacctcagtgcctgttttacaggctcacctgtgacacatgactgggacatatgttattcatgatgacatgcaagagtctctgtgtaggtgtctactggtcttcatcatcaaacagagcgagaactccaagtcaggaggcagacatatcttggggcaagaagacacctagaatttttcttcaacctgtagactttcggattgggtagaaggattgttaaggaggttgcgaaacttggaaaaaggatgatgtgagtgttgatggcatggaattctccccacacccctgggtatccatttttaatgtacagaattcttgtgacatgattttagggcatagaatccttgagagatcatgtctgtgctgaagttggaatcacagcactttatgtgaatgtgttcgccaacgattaattatgtttattcccgagaagttttaaccagattgtggatgtgtattctggttcagcatatattcacaattacctttgttttttgttttgttgttttggagacaaggtcttgctctgtcacccaggttggagtgcagtggtgtgatcatagctcactgcagcctcaaactcctcagtaggaaacttcctaccccagcctcccgagtagctgggactagtagcatgcaccactacacatggctaattttgttttttaaattttttctagagacggggtctcattatgtcgcccaggctggtctcaaactcctggcctcaggcgatcctcccaccttccaaagtgctgggattacaggtgtaagacaccaagctcagcccctgtgtttttttgtttttttttttttttttgctttttgtttgtttgttttgagacggagtcttgctctgttgcccaggctggagtgcagtggtgcgatcttggctcactgcaacctctgactccctggttcaagccattctcctgcctcagcctcccaagatgctgggattacaggcgtgcaccatcacacccagctaattttttgtatttttagtagagacagggattcaccgtgttagccaggatggtcttgatctcctgactttgtgatctgcctgccttggcctcccgaagtgctgggattacaggcgtgagctatcacgcctggcctgtgttttttttttttttaaacataaaatggcccttattgactgttttccttttcatagtgagtccttttgtttctttcatgttttcgagaagtgtcccgagtcaggctgtagacaggcatatgcgtagataaacagatagactcatgcgttcctgttggtaatttttccttgaggtcaccgtatgtgttctcatgcgtgggcatagatgtcccacactctctgaaagtttaattggtcctcgcaggtctcattgtgttccttctcttcagggctcttcatatctcagggtggtaataaccttccaaatctctatggccgaggcgggcagatcacgagatcaggagatcgagaccatcctggctaacacagtgaaaccccgtctctactaaaagtacaaaaaaaattagctgggcttggtggcgggtgcctgtagtcccagctactcgggaggctgaggtgggagaatggcgtgaacccgggagggggagcttgcagtgagccgagatcgcgccactgcactccagcctgggcgacagagcgagacaccgtctccaaataaataaacaaataaatagaaatacaaaaattagccaggcatggtggcgcatgcctgtaatcccagctactcaggaggctgatgcaggagaattgcttgaacctgggaggcggagttttcagtgagccgagatcgcaccactgcacttcagcctaggtgacacagcgagagtccatctcaaaaaaaaaaaaaaaaaggaatatgcatttaacgtttctttgcgtcttttcgtggctcgatagagcccagtatatattttcactaaagagcaaaagcgcctttccatgggcctttaaatacttaagaataagcacatccacacatgggcctcccagatagtcggtgcgtttccagaaatgacggtgtgttgtggttcacagcctctttgggttttggtctccaactcccagcctcaggcgatcctcctacctgagcctcccaaagtgctgggatgacaggcacagtgagccaccatacccagctattttttgaaaactcatagtctcatatttccctaatatttagggttagggctagagttaggtagaggttagaggtgctctgacgagtgtttcccaagtcttggagcccacctctggccaaatcaccgcctgcagttggaagcaaggctgtttctgagatgagtcatactgacatattttgctattgaatgcacggttgccctgatccattcagagatacttctgcagcaccatgagctccttaatccctgcccctgttcacctacaagggtctgcaagcgagcccccttccgcaactcatctctttgtgtaatccttctccagaccctgaatatatcagcctgttggcatatgtatctatgtgtgtgagatcagcctgttggcatatgtatctatgtgtgtgagatcagcctgttggcatatgtatctatgtgtgtgtgtgtgtgtgtgtgtgcgcgctctgaggatattggcactttttaatcttcttccattagacgacaaggctgagggcttccacttgccgccgacttgccggcacacctggggcatgtttaataagtaattgtgtatggtctgctttgcaaatgcgctacttcacatttttccatcccgcccgtaacgaggactggggttgttttacaagttaattacccaaaagattatcgagtgggtttagaggcacaaattctacgcgctatttaacagataagaattaatgagtgttgttaaaatgggaaaaaaaaaatgtctctgtcagtggagggagttatctctaccctgcctggctgtgttactgttgtttttttttttgtctgtgaatgagaaccgaggtagagaaacaaggcgagtgttctcattgctcttctcccaccagagcacaggcggcacgtgtgaaaataactattcacagtttctttcccaccgtgtctcaagaggggtgaatgccagggtcgggcccggtggctcacgcttggaattccagcactttgggaggctgaggcaagaagattgcttgaggccaggagttcgacagcagtcagggtggcgtagagagactccgtctctacaaaatattaacaaatcagtctggcttggtggggtgcactgtggtcccagctactcgggaggcagaggcaggaggatcgcttgagcccaggacttcaagaccagcctgggcaacatggcaagaccttgtctctacaactaaataaaaaaattagtcaggcgtggtgtgcgtgcctggagtctcagctactcaggaggctgaggcaggaggatcgtttgagcctggaggtcaaggctgtggtgagccatgatcgcgaccctgtactttagcttgggcgacagagcaagacccttttctctaaataaaaatggaataatagtaaaaagaagctgaatttcagctgttttcagccattctctttattccttcaaatgcctctgtattctgcagtatcctttaaaatattaagagcaattttagctaatcaggaggctgagacaggagaatcgcttgaacccaggaggcggaggttgtggtgagccgagatcgtggtattgcgctccggcctgggcaacaagagtgaaactccatctcaaaaaaaaaaaaaaaagggagacacagataaggccatgtggagacagagactggagtgatgcggccatcaacttagggataccaggagctggaagaggcaggaaggatgccccctagagtcttcagaaagtatcagacacctttgggaggccaaggcgggtggattgcttgaggccaggagttcgagaccagcctggccaacatggtgaaacctcatctctactaaaaatacaaaaattagccaggcgtggtggcgggagcctgtcatcccagctcctcgggaggctgaggctggagaatggcttgaacccgggaggctgaggttgcagtgagctgagatattgccaatgcactccagcctgggagacagagcatgattctgtctcaaaaaaaaaaaaaaaaaaaagaaaaagaaagaaagcatcaaacacaattgcaaggggttgaatgctgatctccaaaagatatgtccatgtcctaatccccagaacctgtgaacaggaacttatttggaaatagggtctttgcagatgtaattagttaaggatctcaagatgagatcattctggattagggtgagtcttaaatccaatgatagctgtccttgtaggagacaggagaggagacacagacacagaggagaaggccttgtggagacagaggcagagactggagcgatgcggccacaaacccagggactcctggagcccccaggaactaggagaggcagggaggccccttcctgagagcccccggagggagcatggtcctgagacacctgatctcagacttttggtctccagagccagtagaggatgaattcctgttgaattaagttccccaggtgtggtcatttgtcacagcagcctcgggagacgagtagagacatagatcgggcaggaatagaatatctagttgcattgctgatagaggcatactacagctgtgtgacatggtgtgacatcagcacactgtgtcctgaccccaggtcatgggacaagaacttggggagacatagtcacccccctggctcatcagggaaatgcatggcttccggtaaggtgaccctgaacatgcgtgtgtcactctgaagtgttggcctcagactctgcctccaaattccaagtcccctgggggttccgctggaggtggacacgcccccatccatgccttccttgcagtcacgggaacatcccttactcagtcctctctggtcaccgatggggcatgacaggaggcgctacatgtttccaagcagccggggttccagatgcttggaaattctgcgtgcggcctctctatgggaaaaagggaggtctgccaggagtggaaccccagtgagaaagtaaactcaaaacagaaatgaaaggtttctagacacagtacaagccccctttgtggtgcgcgcagggacttacgtagctcggcccctccaccccctggctggccccagtggccgaggtgtgttgggtgctgatctgtgacaccctcctgcttcacacgggcagggaggggttctggagagagtgcaggtgggctggagagctgagctccctgcagcaggtgagtgtgagtcctgaacagactcgttccaaggaaacaggtgcaggaaagaacacaggtcttggaggaatcagggttgagccagccctgtgacctcgggctgtccttggccccagtgatggcttatctttacctggaacttcaacctcttatcatcacctataacgctgaccactgatcctcacctgggactcgaacctctccccatcacctgtaactcggaccacttgtcctcacctaggactccaacctccctccatcacctgtaatgctgaccactcattgtcacctggaagtccaacctctcatcactacctggaactccaactccaactcttttttttttttttcatgagacggagtctcactgtgttgcccaggctggagtgcagtggcacaatctcggctcacggcaacttccgcctcccaggttcacgccattctcccgcctcagcctactgagtagctgggactacaggcacgtgccaccacgcccatctaatttatgtatttttagtagagatggggtttcaccatgttggccaggacggtctcgatctcttgaccttgtgatctgcccgcctcagcctcccaaagtgctgggattacaggcgtgagccactgtgcccggccccaactccaactcttatcctcatctgtagctctaacctgttatcctcacgtgtaaatgtgatgtcatcctcacctgtagctgtaatctcatcttcacctggcattctgacctcttaccctcacctgtagctctaaccggctatcctcaccgatagctctgacatcatatcacctgtagctgtaacctcgtcctcacctggaactctgacctggctgacgtgcttgcagcatgtgggtggggccgatttccctcctgccccagctccctgctgctgccaagtccaggtctctcctgtggggcaggtatacccctccctgggtctcagctgggcccactggccttcacagggagcctgctgtctgcactcccattcttgtcctgccctctcctccggcgccctgtctgctcagatgtcctcatggcctaggcacctgcagccgccaggacagtgagcccggacacaagcagccttccatccggttccccctgcatctgccaacccatcttgcccacagccaagcttctgtgaaaaatcatagcagtcatgaaactcatgagtgctcgggcaaatcagaaaaattgccagggatcctaccatggacacgcgtccctgaaccccgaatggtccctgtgtgttgtgtgtgcgcaggagacgggcaggtcactgtgtgtcgtgtgtgcaggagacagggaggtccctgggtgttgtgtgcccaggagatggggaggtccctgtgtgtcgtgtgtgcaggagacggggaggtccctgtgtgtcgtgtgtgcaggagacagggaggtccctgggtgttgtgtgcccaggagatggggaggtccctgtgtgtcgtgtgtgcaggagacggggaggtccctgtgtgtcgtgtgtgcgcaggagacagggaggtccctgtgtgtcgtgtgtgcggaggagacggggaggtccctgtgtgtcgtgtgtgcaggagacggggaggtccctgtgtgtcgtgtgtgcagaggagatggggaggtccctgggtgtcctgtgtgcgccggagacagggaggtccctgtgtgtcgtgtgtgcggaggagacggggaggtccctgtgtgtcatgtgtgtgcaggagatggggaggtccctgtgtgtcatgtgtgtgcacaggagatggggaggtccctgtgtgtcatgtgtgcgcaggagatggggaggtcgctgtgtcttgtgtgtgcacaggagatgggaggcgtcaacacacatttcatgctcacatttccattcactgtccacactgcacacttgtacatggtcaatgtctagacatttatagtttgtttatgtgttatattcatctactttatatatattcatattttaggttcatatatttattgtatacacatttatatatttgatctatattaatattttaggtttatatacttactatatatttattattataaagcatatacattaaattataatgtattattatatatgatgtattatgttcaatgtatatattaaatacataatgacataatatgaatttatattataatgtatatacatatgaattcacattcatatgtatgttacattttgtaatgtatatatattttgtaacatatatttgtaatataaaattatatacaagatatactttgatatattttatttatatatttatatataaaacataatataatatgcacaatacattttgtgtatatataaaatatatattacataaatatataatgataactataaattatatttgtgtcattataaataatttatattaaatatttatgctattctataaatagtatatatatttagtatatatttttatatcatactttataataaacacgaatttataatatataagtataaactatagttattggatgtttaattttatgtatatattattttatatatatcatactatgtaacacataatatataataaatataatatataataagcatatatcataatatataatataaataaacattgtaacatataatatataatacatatatatcagtatacaaaatataaaattaatatatacataaaattatatacctacttattttattttattttttaagagacgtgagtcttgctgtgttgcccgggctggctttgcctctggaactcaagcgatcctcccacctcagcctctcgaggagctgggactacaggcgtgcaccatcatttcctcctaaaattgtatgtgctgcatatataaaatgataaatgctttacatatactttatgaaattatatatgctttagataaaagcagaggtttcataaaactgaactgtaacatgcatggcatttaaatcccattgaagtgaagggctgggcttgagggtagcgtcaccctccctgaccgtcatacccatttccatttccccaggaaggaccaggatgctttgtttaagcagcacgtttgaattgctggcattgcctgtggcctccctgtggcgagggatggtgaacgacagcgttttccctcctccttcctcaccttgcaaacctcacttcgttggatgcataattgctgactcatccccatggatcgccttggactgtgtagcaatcactgctcttttcacagtccctcttgaatttctttcctttttttttcttttagtcggaatttcgctctgtcacccaggctggagtgcagtggtgcaatcttggcccactgcaaccttcacctcctggattcaagcaattctcctgcctcagtctccccagtagctgggattacaggtgtgtcccaccacacccagctaatttttgtatttttagtagagatgggaatttcaccatgttggtcaggctggtctcgaactcctgacctcaggtgatctgcccacctcggcctcccaaagtgctgggattacaggagtcctcttgaatttcacttaagatgggctgggtgcttcgtggcaggcttttcacatcagcctttgcatttctgggtgtgacccctgtgtctgctgccttctatattcctctcttacttggcaggattccacccctaggtgggtttattttttcccccagtcccctgcctgcctgagaattcctacctatggctcctcctgggaaagggctcttggctgcgtcttaaatcttgggttatgccttggtgcatactggtgttgcaccagtggtgcaacgttgccggcatcccttttgcctgagggcaggtcacttgtattctgtcttgaaggaacctgacttttaaggagggacgacctggagagtttctttattattgaacttcactgactccctgaggatagactgatcctgccaaattcttgggtccccaataaaacagcattccatgaaataaaaagtaagaacagatggcaccaggaattccactgctgggtatatacctcaaagaattggaaacagggtctccaacagatatttgcacaaaccacgtttgcagcagcagtattacttacaataacccgaaggtggagagaaactgtgtccttccagaagcaaatggataagcagaatgtggtatatccaaacggtggaatattacgcagccataaaaaaggaagggtattcagatgcatgctgcgatgtgggctaaccttgaggacattaatgctaagtgaaataatccaatcctaaaaggtggagagaaactgtgtccctccacaggcagatggataagcaaaatgtggtgtatccaaatgatggaatattacacagccataaaaaaggaaggatattcagatgcatgctgcaatgtgggctaaccttgaggacattaatgctaagtgaaataaaccaatccccaaaggacaaatactgtaggattccactcctatgaggtacacagagtacctttaaatttttagagacagaaagtagaatggggtagttataggggttgggcgaggaaaaggtggggacttaatgtttaatgggaacagagtttccatttggcaagatgaaaatattttggagatgcatggcagtgatggctacataacaatatgaatgtatttaataccactttactgtgtacgtaaaaatggttaaaatgctaaactttatgtgatgtgtatttttccacaattcaaaattataaaaaaaaaaaatgcagctgggcatggtgactcatgcccgtaatcccagcactttgggaggccgaggcgggtggatcacctgaggtcaggagtttgagacgagcctgaccaacatggagaaacctcctactaaaaatacaaaattagccgagtgtggtggtgggcgcctataatcccagctatttgggaggctgagcaggagaatcgcttgaatccgggaggcagaggttgtggtgagctgagatcgcgctattacactccaggatgggcaacaagagcaaagctccattaaaaaaaaaaaaaaaaaaggttaaaatgctaaactttatgttatgtgtatttttccacaattaaaaattattttaaaaatgaggccgggcacggtggttcatgcctgtaatcccagcaatttgggaggctgaggcgggtggatcacttgaggtcgggagttcgagaccaccgtggccgacatggcgaaaccccttctctactaaaaatacaaaaactagcctggcatggtggctcaagcctgtaatcccagctcctcgggaggctgaggcagcagaatcacttgatccccggaggcggaggtcgcagtgagccgagctcatgccactgcactccagcctgggtgacacggcaagaatccatctaaaacaataaaaaaaaaataaaataagtaattgcccttaaattggaaatgctcaacaacccacgtgattctgaatctgaaaaggccagatcagggagatacagagaagaataaataaaacacaaggcaagagaagatttatctctggagcatccttgtgcagctgttggtgagtgactcgtgtgtgtcaattgatcatacactcatgagtggataaaagtacccatgttttaggtcaagaaagactgtgacacacgtgtccagcacgccaagcacacagcccgtggggtgtcatccatgtgctgtgccctccctgtctccctctcccaagctcctgcatggaaacagaggtggacacgaaacctacctacccaccccctcccaggttaccgccatcactttcatcacaaaacagagtctggattcagggattcagcccagggcaggagctcaggtcatcttcctctttcagaagggagatttctgctgcctctggcccagcctttccctctctttccccccatgagctgccattggagcacccacctgggtgcaggtgagagagaggaggaaggagaccaggtgaccccttcctggctggttaccctatgtcccggtaacagacggttagagctgattctcatggcagaagcgtgactgccagagaccacctgcggcgcttctaatgctctggtccgtgtattcgtcttgtagcgttgccgagtgttacagagatccacagaccaggtggtttaaacaaaagatacttattctctcacagctgtagaggctacatgtctgaggtcaccgtgtcggtaggcttgctttctctctggcttgtagacgccgtcttctccctgtgtcctcacagagtccttcctctgtgtgtgtctgtgtcctcatctcttcttatgaaatgtcttagtctatttcaggctgctgtcacagaataccataggctggatgacttacaaacaagacatttattctcccacagtcctggaggctggatgtctgagatcagggtatgggcaaggctgattcctcctgaggtctctctcctggacttggagatgctgtcttctccctgtgtcctcacagagtccttcctctgtctgtgtctgtgtcctcatctcctcttcttatgagatatcttagtccatttcaggctgctatcacagaataccataggctgggtggcttagaaacaatagacattgattctcccacagtactggaggctggacatctgagatcagggtatgggcagggctggttcctcctgaggtctctctgctggacttggagtcaccgtcttctccctgtgtcctcacagggttgtccctctgtgtgtgtctgtgtcctcatctcctcttcttataaggagccagtcccattggatcagcctccccccaaccccctgaaacctcattttaccttaattgcctctttaaagaccccatatccaaatatgatcacattctgaagtcctaggggtgaggatctcaatgtatgaatttgagggggacaaaattcagcccatgacaaccagtgtttctttccaaggggctacctgaaaacgtttctgcaacccccagcaagctggcatcgtctcagcatcttgccatggggttccctccatgcctcccaatggctcctttgagtaagaccaaggacaaacccataccactcccttctcctgttttctctgccctcattgtcccctcaagccctgaggctgatcagtccccacaggaccacagctaccctgtagctatgagcagtggcttcctcaggagtgagccaggctcctgtaccccatgcctccctggcacagaacaagatttaggttctgggggtacctgagggaatcccgttttttttttttttttttttgcaggggagggtggaggctcagagtagggaatttttttttttttccgcctgctgtgaggaaattcacccctgttatctgatccatgcacactctggagctggctgaggtcctaactatttcctctgtaaacttctgcccttggaatgggttctgcgatgattaatacttagagtaaacttgattggattgaaggatgcaaagtattgatcctgggtgtgtctgtgagggtgttgccaaaggacattaacatttgagtccgtgggctgggaaaggcagacccacccttaatcatctgggtggccaccatgtcatcagcaggccagcgaggctagactataagcaggcagaaaaacatgaaaagactagactggtctagcctcccagcctgcatctttctctgtgctggatacttcctgccctggaaaactggactccaagttcttcagctttgggacttgggctggcttccttgcccctcagcctgcagacagtctattgtgggaccttgtgatcgtgtgagttaataccgaataaatgcccctttctatatatctatcctgttagttctgtccctctagagaaccctgaccaatacagggtccgttccttaccccctacatctataaccctgctgcctcagttgatagggaagcagaaagagccgcttttttaatgtttaattttattaagtttgcagtttcccagtgcccaaactcatgttgatttcaaaaactgtccttttaaagcatgtgggcagggtgacaattcatagcaggtgacaaaaatgttttataaataatatccatggaaatggaagctgtcactgtctgcagaatgcagccaaaatattcagaagatttgtatcactctaagttctcgtgctagtaagaaataaaaaagcaaatgatgactgggcctctaagaaataaagtaaaattaggaagcaggagtatgaaaataatgacattgtgcagaaataaatacaaaaggaaagtagcagagaagcaaaaaaaaaaaaaaacaaaaccatcaatagtagtttccttaagaaaaatgaaagaataatatcccaccatttattcatccttcattccacacacaaaagaagcaaggacagattagcatgaattggaacaagaaagaggaaataacatgtaataaaaatatgatttaaacttatgcaaaaaaagtaatttattcttaactcaactaacatatttgattacctcctcctgggcaaaggatgaaaggctgtcttattgcaaaaaattagaattttgctaaattcatgcaaatggaattacagatcacagataaaacaacatgctgaaatttcaaccgtcagaactttccaccaagtgttcctaatgaattcttgaatatctggttgggtgcagtggctcacgcctgtaatcccagcactttgggaggctgagttgggcgggtcacctgaggtccagagttcgagaccagcctggccaacatggtaaaaccctgtctctactaaaaatacaaaaattagctgggtgtggtggcacaggcctgtaatcccagctacttgggaggctgaggcaggagaattgcttgaacctgggaggtggaggttgtagtgagctgaaatcatgccactgcactctagcctggtgacagagcaagactccgtctctctgtctctctctttctttctctctctctctcacacacaaaataaataaataaataaataaataaataaataaataaataattgattatctatatactttttccaaaccatcaaggacaatctagatcaagaatctggaaactgttgaccctggaacatatctgacccttaacttgtttttctcattaaagttttcttgaaacacagccatatacattcatttacttattgcctgtgactgtttttgccttaggtacacaggtttgaagagttgcaacagagaccttatggcccacaaatcctaaggtgtgtagtatttggccatttatccaaaaatctactggctgtactcttcaaagtgaccagagccaccaacctgtgtctgagtaaaccgttttactcccaaatgaacacttttcaaagaagcatcatcggctggttctacttaccaacctaaataaagaaaatctagtttaatcttatccactgaatagacttccaggttaaaaaaaaaattactcctgacttagttgcaactcatccacctgtagaccaaaggatgcttctcattaggtaacagggaagcatttgggataattcaacatccattaattagtaaacctctgaaggaattaatctcataacagcagccggaatgcaggagatgctctacacccgaatcacaaattgaatggatggcaagtggattttccctcctaaggctgattgattggttctggctgccagcaccctgagataagaatgatcctgcagcaaggaatagtcatcaattagtgatgcctgctgtggctatggaatgagaattacggtctgtgtgctacattctttccattcttggtggttctctcataaaccacaataaagcatgcatcttttaaagcaaccatgaccatcactagccaccaccatagccctctggctgattcatggatgaatttccaaattcaaatgtgaatttccagtgtcacatttgtgttcctttccctaaatgatgatgatggtgatgatggtgatggtaatgatggtacttgttggatgtgtgtatgtatgtatacacacacacacatatatatacacatacacacacacacacacacacacacacatatatatttgagatggagtctcactctgtcgccaggctggagtgcagtggcacaatcttggctcactacaacctccgccttccaggctcaagcgattctcctgcctcagcctcccgagcagctgggactacaggtgcgcagcaaatgtatatatatatatttttttttctttttttttttaaatttatttattttttattattatactttaagttttagggtacatgtgcacattgtgcaggttagttacatacgtatacatgtgccatgccggtgtgctgcacccaccaactggtcatccagcattaggtatatctcccaatgccatcccccccctccccccaccccacaacagtccgcagagtgtgatgttccccttcctgtgtccacgtgatcccattgttcaattttaaatacaaccaaataagcttgcttcttgcctgtgtggaatttatagtccagctggagtgaggaattaaataatcatccacttatctgagtgagcaaaattatgataaacactcttaaaaagtgtcctttaacagctgtcttgaaagattcaattccatcctctcatgaggttccaccctctgggtttgctttctccaagacctaccctcctgtgtggcttctttcttgactgtttcttttatgctgcctttcctcagcgtttcctcgtagcatctcacactacacacctttccttaggtcttgcaaccacgtccgtgttctccaaaactctgctctgctagttctcaccaatatatttgtttccaaactcctgcctcctacacctccctgcttccacagcaagtgcaggaatgtatttgacattttccttctctctgtgtaagtcagtggactaccatcctctcagctgcctacagtcgatcctagagtgtctgagatgcttttctccaccttggcattcctctccctggtggcaactgagagctctgtagaccacctacatgcttatcaaaaacactccgtcattttcggtatcactccctacagcaggtcacacctatcccttacctgcttcataactctgcttcctggctagtctctcggcttccaggtttccctccctgaactgtctacactgcagtcagagagatcctgctgagtcacactgttgtcttaacctgcttaaacccatatgggcagaatgcccttcatgcctccacctgtttgctgtagctgtgcacatgtggttcctggttcttgagaattcttcccctcctctgcctcctgaccatccaagtccctttcatgctagtcttctcagcttttatagcatgctgtaaagcagttgtcctgaagccaggtgccttacaactccctgctcccttgggacacttaatcccttctatcgccaacctcacacattgtatcgttggttgtttaattgtgtcactgatttccccagccccatgatggtccatggaacatcactgggatataaaaagtactggccaaaggaataaaatacaggaaaatattttgtgcattgtgggatctcatgaatgacagctgccacaatgatgatgttgatgataatggtgattctgatggtgatgatggttgtgatgatggtggtagtgatgatggcaatgatgatgacagtggtaatggtgatgatggtgataattatggtgatggtgatatagtaatgactgtgatgatggtgatgatgatgatgatggtgatgatcatgacgatggtgatgatggtgatgataatgattatgctgctgctgctgatgtgataatgatgatggtgatggtgatgatggtgtttatgatggtgatgatagtgatgatgaaaatattggtgttgatgatgctgatgctgatggtgatgatgatggggtgatagaaatgataatgatgatggtgatgaggatggtgatagtgatggtcatggtcatgtgatgatgatgatggtcagtgatgatgatggtcatgatggtgatgacaatggtggtggtgatagaaataatgatgatggtgatggtggtgatgctgctgctgctgatgatggtgatggtggtgatgatgatgatggtgatagtggtggtaatagaaatgataatgatgttggtgatggtgatgatgctgctgatgatggtgatgatggtgatggtgatgatagaaatgataatgatggtgatgatggtcatgctgctgctgctgctaatgatggtgatgatggtgatggtggtgatgatgatgatgatagtgatgatgatggtgataatgatgatggcgatgatgatggtgatgatggtggtgatgacggtgatggtgatgatgatggtgatgatggtgatggtgatgatgatgatgatgatagtgatgatgatggcgatgatgatggtgatgatggtggtgatgatggtgatggtgatgatggtgatgatggtgatggtgatgatgatggtgatgatggtggtgatgatggtgatggtgatgatggtgatgatggtggtgatgatggtgatggtgatgatggtgatgatgatggtgatggtgatgatgatgatggtgatggtgatgatgatgatggtgatgatggtagtgatgatggtggtgatggtgatgatggtaatgatgatggtggtggctatgatgttggtgatggtggtgatagtgatgattatgaaaatggtaatgattgctgttcatggattctgtgaaagaaccaaccccttttcctgaaacaatcttgctctacttgactatctgtggactgttctgtgtccttcctcccaagtctctgtggcttgcatgtcctccttctggtgggtaggttggccaagtctgacaccctcaactctgccctccttccatagctaacaacagccctaatatccgaagactcagggattctgctgtcagctcccttggctcagccaagcaaagactgtgcttgtgggagcccagaaagagggaatggaatacttctccagagagtaggtgttgcatttctgaatattgtaattaagccagatgagtctaggcaggcccacaggacctcttcaggcatcttcttgtccatgttttgcactatgcaggagaagtgatgctgtcagccatgcaagccatggccccccatacagcagactctcctacgaagccatgtagcttgcaaacaatgccatgttttagtttcatgttacccctcctgcagatttgcacatctaggctctgcttttaaaataatcatgcacctgtcaggctggaagttttcaggaaaatccttctcacctcatgtgtgttgctggctttttttttttttttttttttttggttgtggcttcctgagaacggggatgctacagcctgccactgttggaacaaaggtgcttttagtcactctacctgtcgctcttagggaacgtacgtgccctcaggggaaataggcggatgcacattttgcttctggctcttttgcctctttatttttttcatttttatttttttgaggcagagtttccctcttgttgcccaggctggagtgcaatggtgtgatctcggctcaccacaacctctgccctctgggttcaagcgattctcctgcctcagcctcctgagtagctgggattacaggcatgcgccaccatgcccagctaattttgtatttttagtatagacggggtttctccctgttggtcaggctcacacttctggaggctagaagtccaagatcaaagcatgccacgttcagtgtctggtgaggacctgcttcctggttcacagacggtgccttctcactcttgtcatcacgtggcagaagggtcgagggagctctctggggtcccttttagaaggacactcatctcattcctgaggccccaccctcatgacctcatcacgtcttaaagggctccacctcttaacactatcaccttgtaggttatgtctcaagacagggatctggggccgggtgtggtggctcacgcctgtaatcccagcactttaggaggctgaggcaggcggatcacctgaggtcaggagttcgaggccagcctggccaacatggtgaaaccctgtctctactaaaaatacaaaaattagccgggtgtggtggtgcacacctgtaatcccaagctactcaggaagctgaggcaggagaatcgcttgaacctcggaggcggaggttgcagtgagccgagatcacaccactgcactccagcctggcgactgtgtgagactccgtctcaaaaaacaaaacaaaacaaaaaagcaaaagcaaaaacaaaacaaaacaataaccaaaaaatggggatttcgagaggacacagacattgaaaccatagcacatggcgaccttgagtctttgagtttacgtgtgcagcatgaatgctcggtggtgatggatgaagagagagcaaggggggaatgccacacacttctaaactgtcagacctcgtgagaactcactcactatcatgagaacagcaagggggaaatccgccaccatgatccaatcacctcccaccaggtccctccctcaacgctgggaattacaattcaacgtgagatttggatggggacacagagccaaaccataacagcagcaatagtaaactcatacatcatatctatacatctctcctgaaccatccctgctagactcagtaggacctgtagagaccatctttccctgtattccttcaacatcctgcttccttatcatatgtttctaaggttgtatagttccatgagagattacagctacttttttttttttaagacatctcatcctgcaatgcagtcttttttttttttttttttttttttttgagacggagtcttgctctgtagcccaggctggagtgcagtggcatgatctcagctcactgcaacctccgcctcctgggtcccggttcaagcaattctcctgcctcagcctcccgagtagctgggattatggggacgtgccaccatgcacagctaagctctgtatttttagtagagacagggtttcaccatgttggccaggctggtcttggactcctgacctcatggtttgcccgcctcggcctcccgaagtgctgggattacaggtgtgagcgaatgggcccggccaatgcaatcttttagcaggaaatccatccaggattttggaatcaacagaaaagaaaaaccttgggttttggagtctcagattctggcggtcctgctagatgtgttgacgagtgtgttgggccagttaattaccctcataattgttctaattgcttttatcctgcaaatatccctctgtgttcattagctttgccattacgactgagcccaagtggattaaagaaagcctgtgatgccaccagacatcatttttgtttcggcaaaacagctttctctaggaatctggccttaatgtgttttggatgccccccacactgacagggtccttcatgagctctcctggatagaataacacaaaaaactcaaagcccattttaagaaacagcagcatcattaaaaaaaaaaaaaaaaaaaaaaaacctccactgccagcccacaggtcgctcattttcttcctagaaataaattccagttgagtggacacgtcttttacgggggaatttcagtcgtgattgatcatccgttgacctgtttaaaatgattgtcaagtgactgggctatcctcattcacagataactcaggcaggctcagattaattaacccttcgtttgtttgccatgtaggactaattagtcatcatccatctactgggaatcagacgtcattggcacagttatcaaggacagggactttgccggcttatcatgtagaaggaagaattaatggtgttggtgatatatggtcttgtgtagtggtagggtattcctctccctcttttcttcatgttcttctttctttgcttgccacacattcatttacaggggactctgaagccacgtgagggttaggggcacgtgaagaccttgtgtaactcttcactcccccaaaacttaactaatagcttgctgttggctggaagcctttcctgcaactagacggtcccatctaggggtaatgggagacagtgacagatcatgaggcaggtcattattgcaccagacacaaataatatagtaatattcttacaataaagtaagccaaaggccgggcgcggtggctcacgcctgtaatcctaacactttgggaggttgaggcaggcgaatcacctgaggttgggagttcgtgaccagcctgaccatcatggggctaccccgtctgtactaaaaatacaaaaaagtagccaggcgtggtggtgcgcacctgcaatcccagctactcggggggctgaggtaggagaatcacttgaacctgggaggtggaggttgcagtgagccgagatcgcaccactgcactccagcctgggtgacaagagcacaactctgtctcaaaaaaaaaattaatcaagagaaaaaaatatagtatgtattatatactatattcttacaatgaagtaacctagagaaaaatatagtaaatattctatattatattcttacaataaagtaagctgtgattttccttaagaaaatcgtaaggatgagaaaatatctttactgtttatcaggtggaagtggctcatgataaatgtcttcatcctcgtcatcttgacgttgaggaggaggaggaagagaagggggtgtctcgggtggcagaggcagaagaaaatccacatataaggggacacccattcaattcaagcccgtggtgttcaagggtccactgtcataggggaggctcaatattttagtttcctggagctgctgcgacacaattctacaaaccagctggctgaaagccacagaagtcaaatctctgacagctctgaacaccagaagtccacagccaaggcaggctgaccacctggtcatccaagggcagagcccgtgtcaaaggacattcctggagcagaaagccaacacatccgggtggaaatacaaccttccagtcactaagtatatttgcaaatctccagcaggtcactattgcaccagacacaaagaataagcgttcagtaagttgaagtattgtgtgcacacggccgggcgcagtggctcatgcctgttatcccagcactttgggaggccgaggcaggcggatcacgaggtcaagagatcgaggccatcctggccaacatggtgaaactccatctctactaaacatacaaaaaattagccgggtgtggtggcacgcacctgtagtcccagctactcaggaggctgaggcaggagaatcacttgaacccgggaggcggaggttgcagtgagctgagatcatgccactgcactccagcctggcgacagagcaagactctgtctcaaaaaaaaaaaaaaagtattgtgtgcacactgcaattatgaaatgcatttcattctggagtattaaggcagggctgtgccccttgcggaggctctggaggaggatcctccgctatctcttctggcttccttcgctagctagcaatcctggttgtttcttgtcctgtagaacagaggactccaaccccctggctgtggactggtactgagcaaagcttcatgtgtgttcacagccacttcccactgcacgcattaccgcctgaggtcacctcctgtcagatcagcagtggcattagattatcagaagattgagaaccctattgggaagtgggcagaccagggatctgggttgcatgcttcttatgagaatctaatgcctgatgatctgccactgtctcccatcaccccccggatgggaccatctagttgcaggaaaacaagtttggggctcccactgagtctacatggcaatgagttgtattgtagaattacttcatttaacgtatcatcatagaaataaagtgcacaataaatgtcatacgctcaaatcatccccagatccttccccctgcactcacagtgactgtctttctatgaagacagtttttgtgtgtgtgtggaaaaattgtgttccatgaaactagtctctgtgccagaaaggctggggacggctggtgtagaagcatcaatacagtatctgcctttgtcgtggccatctctgtgtctctatgccacagtgttcctcttctccttttttttttttgagatagagtttttgctcttgtcacccaggctggagtgcagtggtgtgatctcggctcactgcaacttctgcctcccgggttcaagtgattctcctgccttagcctcctgagtagctgggactacaggtgtgcaccaccgtgcccggctaatttttgtatttttagtagagacagggtttcaccatgttgggcaggatggtctcagtctcctgacctcaagatctgcctgcctcagcctcccaaagtgctgggatgacaggcgtgagccactatacccggcctccaatgttccttttcttataaggacaccagttattcagttaacagcgtacactactctaatgcaacctaattgtatgcaatgacaacctagttgtatgcaatgacactactctagtgcaacctaattgtatgcaaagatctgatatccaagtgagctttcattcctaggttctgggtggacacatcttggtgaggtcacagttaaacccacgtcacccaaggctaggggcagaatcagagtggatgttagatctccaggctcttgttctgggagtgtcattcaaagcctttcttcatggccacctgaatgacgatgtcatcctctgtgggtaacagacaccagcattgtgaatgatgctggcttcctttgctggtttctttctgacatttcccttttgtgctttcgtttatggcaagtgtagacatacatgcacactcagacacatacacacacgcacacatgcactcttgccatctacaatgcctcagatccgtactgcaattggccccagccaccctgtagaatttagatttagcgaaaaaagacttcacgtgttcgccaaattctgcgtttcctcctgagtcagaggcacctgcaatgcaggcagcgggaagttgttcttctaccagaacaagagcccctaggaaaattgccccttttattactgttttggtcaaaatatggcaacaacattggtgactccaggcgagttagtaaaaatcacagagaggcacattttgtgtccggggaatgctgggatgctcctaaaacccactgagccggccgggtgcagtggctccagcctgtcatcccagcactttgggaggccgaggcaggtggatcacgaggtcaggagatcgagaccagcttggccaacatggtgaaaccccgtctctactaaaaatacaaaaattagccaggcgtgggggtgcacgcctgtagtcgtagctactgaggaggctgaggcaggagaatcacttgaacctaggaggcggacgttgcagtgagccgagatcgcactactgccctccagcttggcgacagagtgagactctgtctcaaaaaccaaccaaccagccaaccaaccaaccaaccgaccaaccaaccaaccatcccatcgagccgttctcttgctgactcaagagagaataaatcaagaaacaaacacacaaggaaaccaaaacaaccctgtagctgaggattctcccctaggaggaagaaaacgggcatccacacggcgtgtgcccagctaaatataaactgcgaggggaagggaggagacagtgatgacaagccccagccttttccacaagaagaaaaaggtttaagttttcaatgctgcccatgatatccaagaacgaaccgcatttcacagccgcggtgtgcataccatactttcacttatcggaagctcattcattgtgtgatgtgcactaattacccgctggagatttgagaacgcacctgctgactgggagggcgtattcccacctgatgtggttgctttctgcactccagaaattccctttgagatgggctccatccttccatgacagcgtgaccgcttgtcctgtagtcacagtgttgtctgaagaatgcaggatagtttattttcatttttgtttatttatgtttctgttttagaggcaggttcttgctctgttgcccaggctggagtgtagtggtgctatctggctcactgcagcctctacctcttggactcaagcgatcctcccacctcagcctcctatgtagctgagactacacatacatgccaccaacacccagctatttttattttttatagagacagggtctcactatcttgccctgggtggtcttgaactccagggctcaagggatccttccaccacggcctcccaaagtgctgggattacaggactgaacctggccttgctgtggtctgtttcgagaagactttgtttttcgttttttgttttttggtttttttgagatggagtctcgctgttgtcacccgggctagagtgcaatggcgtgatctcggctcactgcaacctccgcctcccgggttccagcaattctcctgccttagcctcccaagtagctgggattacaggcatgtaccactatgcctggctaatttttgtatttttagtagagatggggtttctccatgttggtcaggctggcctcgaactcccgacctcaggtgatttgcctgcctcggcctcccaaagtgctgggattacaggcgtgagtcactgtgcccggctgctcacccagctatttttattttttggatggggtctcactatgttgccctgggtggtcttgaactcctgagctcaaggaatcttcccaccacggcctcccaaagtgctgggattacagccctgagcctggcctcactgtggtctgttttgagaagcctttgtttttaaacagaaccacatgttggtatttcagagccaactcttctgtcaagaatccaaatcagccaggcacggtggcatgcctgtgtagtcccagcaattccagaggctgagacagaaggatcatatgagcccaggagtttgagatcagactgggcaacatagtgagactccatttctttagaacaatactaatcacatgagggtggtaggccattgcctgggctggacaggtgagtagagggcaggtgtgcaggtgcagaggtctttttttgtcctcattccatgcacgactgtttctcaaacttgctatgctaagatgctacaggaacttactttacgtcacaatatcattgaccttttttcttccttcctgtggcttcctcttcccccactctctcacctgtgtgccctattttggataaccctcctcctgggttcctttctcaccatctcctgctgtcaacatctcacctctatttcctggccggatgatgcctcctccaggaagcctgcctaggtttcctgttggcttgcaaactctatgtgggtgcgaactgtccacaccgcgtcaggtacgcaggggcccttgaagtatcacacgttggcagctcagccctgaaaacttcagctccagatacaacaaccccttccccttttctccaacctgataatttataactccagggtgactcggttcagcggcactgcagtccctcagctcttccttgcagcagccgtggtttccatgggatgtagagggttatcctgcttggaaagcattagagctgggggactagagaccccctaattctggcgtggggagaatggaggccccagaggaaatggagcaggtgttttagtggaaaagctggttttgaaattccagcctcgcctcagaacacagcatagcttccctagatgatgtttcttttgaaaggtctcctctgaaaagagtgtgaggattctggcaaacttgcaacaatctctgtaacgatgggatggctgtgtccccacccacatggcacctggaattgtaatgattcccacctgtgaagggtggggccaggtggaggaaattgaatcatgggcgcggtgacccgcatactgttctcgtggtagtgagtgtgttctcacgagatctgatgttttataaatggaagttcccctacaggagccattttgcctgccgccgtggaagatatggttttcgtcttccgtcgtgattgtgaggcctccccaaccccgtggaactgtgagtccattaaagctctttttctttataaattaccccgtctcgggtatgtctatcagcagcgtgagaatgaactaatacagatgcaaagtagagccgcggtttatgagccacaagaaataccaacccccagccaggcgcggtggctgacgcctgtaatcccagcactttgggaggccgagaccggcggatcacctgaggttaggggttcgagaccagcctcgccaacatgatgaaaccccgtctctctactaaaaatacaaaaaattagccgggcagggtggcgggtgcctgtaatcccagctactcgggaggctgaggcaggagcatcgcttgaacccgggaggcggaggttgcagtgagccgaggttgcgccattgcactccagcctgggcaacaagaggaaaactccgtctcaaaaaaaaaaaaacaaagaaggaaaagaaaagaaataccaacctctccctttcaaacctaaaaccccaacatgctggatgctctagggggtctctggggcttcgctgcttacgtttgcccttgttgggtcctgggtttttatactcaacgggatcctggaatttatgtttcatttgtgattcggttccaatttgacacaactgcctgccttcccccagcggttcgtgtgatagacacactcacgctgtcaatcatggagctgtggggcgcgtctgggagatctatagcaaaactccatccactccggttcccttgtataatacaaaagggttttatcagtcatgtatttcgcctcaaaactagaagcatggatttcccaacccgattcaccattaaaattgtgaatttttctggttctggtaaggatacgttgactgtataatggattacataacagtgtgttttcttcaccttagtaagtagccctgggagtttgtagcaaagaaagaagaaacccgagcctcaagaaaatttctccgacgatggtgcccagaacaggggtcaggggtcacgtgtgatgcgcgaaaattaaataagtgataattaagggaaaagaaaaactcagtgcctcattgcactaactgtctggcaagcgcccagtgtccagctgtggacagcacagttgtctggggcagggaagatatggactttcctgcagagagtgctactctgcagcagtgaggtacacctttcagggatgtcccatgatggtgacagagacaccagatacacaggtagcaacagtttcatttgaaaagatcattcccacagatgggagcttttgcaataagaggaggagggactactgtaatgggaggaggaggggctgtgataatgggaggaggaggggctgtgataatgggaggaggaggggcggtgataatgggaggaggagggactatggtaaggggaggagtgtggactatggtaacgggaggaggaaggactggtaacagaaggagggactctgctaatgggaggaggtactatggtaatggaaggagggactatggtaacagaaggacggactatggtaacggaggaggggctgtggtaacggggagggtctacggtaacgggaggaggagggtctatggtaacgaggagggactatagtaacgaaaggagggtctgtggtaacagaaggagggactatggtaatgtgagaaggggggactgtggtaacggagggtctatagtaatgggaggagggactatggtaacggaaggagggactatagtaacgggaggagggtctatggtaatggaggagggactatggtaacagaagtagaagggtctatggtaatggaggagggactatggtaatggggagggactacggtaacgggagaagggactgtggtaacggaggagggtctatggtaacggaaggagggactacggtaatggaggaggggggactatggtaatggcggggagggattatggtaataggggaggaactattgtaacaagaggaggagggactaatgcaaccactggtggacgctgcctatagcaccatgaagcacacccgagcagtgacatctgggagcctcttggagcgcaggcagcataccattttcttttctagggacaggcacgtgatgctcggaacaaccgtgattggggtcgttcgatgtggggttcagtcatggataaaagctgccaaaccctgtggctgcatagctaattttgagcaggtcctaaggaagcgttgcttgatcctctgacgtttgctccaggtgaggctggcccaacatcccggggcctgataggaggagagaaacccaaccaaaatgtgatcacgttagatgggaattttgttcaggtcaaggaagacgaggaattcagtccatccctgaaggggcaaataaagaatgtgaatttggaggatgtggccagccttgtcctaggctgacttggaagcatctgtgagtaatgaggaagggaattttttttttttttttttcagtaaaaccattttctggaagacaaaggcagtggggaattcttaaccttcacagattcccaacagcacagttgtgtggaatgatggactgattgtgtctccgtaaaatacaaagccctcagctgggcgcggtggctcagactgtcatcccagcactttgggatgccgaggcgggtggatcacctgaggtcaggactttgagaccagcctgaccaacatggtgaaaccccatctctactaaaactacaaaaattagccgggcatggtggcgggtgcctgtaatcccagctactggggaggctgaggcaggagaatcgcttgaacccaggaggcggaggttgcagtgagccgagattgcgccactgcactccagcctgggagacagagtgagactctgtttcaaaaaaaaagacgaactgggactcctcaaactgggggaatggtgcatttgtagacaaaactcatggtgtgccatctgcaggtgtcattgtcaggaaggtgagcttggttcatctgtgcccacttgcaagctctttggagagtgaggagcaggttgggaagcatctatcctcagtcatgaacccggagctcctgctggaaaagacagccttggggtctctgtcatgcacatttcagtaggggagtccgggccgggcacaggggctcatgcctgtaatcccagcactttggaaggctaaggcgggcagatcacttgatgtcaggagtttgagaccagcctgaccaacatggtgaaacccgtctctactaaaatacaaaaaatagctggggctgggtgctgtggcttaggcctgtaatcccagcacttggggaggccgaagtgggtggattacttgaggtcaggtgttcgagaccagcctggccaacatggtgaaaccccgtctctactaaaaatagaaaaaattagccccggctaattttggtggtgtgagcctgtagtcccagctacttaggaggctgaggcaggggaatcgtttgaacctgggagatggaggttgcagtgagctgagatcgtgccactgcactccagcctgggtgacagggcgagactctgtctccaaaaagaaaaacaaacaaaaaaaaacaaaaactaaacacataggagagtcccttagcccctcacgaatactccacacacacatctagtccagctgcatcttgttgactcacaagacatcaagataagcctgattcaatgaagttcttcaaaatcagagttcatttgctcattttcttttcttctctccaccaattagtggtgagagtttcgcctgaatcacagtacctgctgtctccagttctgatgttggtatcacccatcttcagacaagatttcttgtgttatttccacatcagcttagccactgtctctcaacatgaaatgctggctggggggaagtttcaaccgcagaagcaaagctcttaaactcattgaaaagacaagctctttcccccttggtagggtcacgaaggctcctcagtgaagggtgtggtaggtttgcttctatagggtagaaatgagacaccctgaaaatcaggaggctttcattggcttttaatttacacagaaggcaatgtgtagtttcaaaatattcttttttatttacttatttacttttatttatttatttgagatggagtcttgctctttcgcccaggctggagtgcagtggtgcgatctcggctcactgcaagctccacctcccgggttatttatttttttgagacagagtcttgttctgttgcccaggctggagttcagtggcacaatcttggctcactgcaacctccgcctcccaggttcaagtgattctcctgcctcagcctcctgagtagctgggattacaggcacctgtcaccatgcctggctaatttttgtatttttagtagagacggggttttgacatgttggccaggctggtcttgaactcctgacctcaagtgatccgccctccttggcctcccaaactgctgggattacaggcgtgagcttccgcgcctggcctcaaaatattcttaatgagtaaatacccgtaagcatttgaatacaaccatttatgttttttgttgtttagcaattgtttgaacttcaatgtgcctcataaaaatgtttcattataaaacatttcacacatttgaaagacgcagagaataatttgaacagcatttgtgtacccaccatccagttgtatcaaatcgtaatgttttgccaaattagttataaattacgtatgtgacttgggtacccctctccaattattttgttattacataaaaaatgactttataacatgggtcaataggagaccttttttcttttttttttttttgagacagagtcttattctgttgcccaggctggagttcagtgccacaatcttggctcactgcaacctctgcctcccaggttcaagtgattctcctgcctcagcctcctgagtagctgggattacaggcacacggcaccacgcccggctaatttttgtatttttagtagagatggggttttgacatgttggccaggctggtcttgaactcctgacctcaagtgatccaccctcctcggcctcccaaagtgctgggattacaggtgtgagcctccgtgcctggcctcaaaatattcttaatgagtaaatacccgtaagcatttgaatacaaccatttatctttttcattgtttagcagttgtttgaacttcaatgtgccttctaaaaatgtttcattataaaacatttcacacatttgaaagacgcagagaataatttgaacagcatttgtgtacccaccatccagttgtatcaaatcataatgttttgctaaattagttataaattatgtatgtgtctttgtgtgcctgagtgtacatgaaataagacatttcagagactattgtgctcttgggtacgcctctccaattattttgttattacataaaaaatgactttataacttaggtcaataggagacatttaaaatattattttccatgcatctttgtccttgtttattttctctagaaaagaaaaatgtatttccctgttcttattttcaattcccaaatgaagcttcaatgtaaaactaattttctgagaatgtagcatcgttcttttttttttttcttttttctttttttttttgagacagtcttgctctatctcccaggctggagtgcagtggcacaagcttggctcactgcatcctctgcctcccaggttcaagcgattctcttgcctcagcctcctgagttgctgggattacaggcacctaccaccacgcgtggctaatttttgtatttttagtagagacgggatttcaccatgttggtcaggctggtcttgaactcctgactttgtgatccgcccacctcagcctcccaaagtgctgggattataggtgtgagccactgcgcccggctagcatctctctgtatttgctgaagccatgtgtgctgtgaagattgtagttttagccattgtggttcctcttgaaagggggccctatatcttcctgatggggaatggcttaactgaagcctggggaatggctggtgttcgtgaaatggctgcattcagatgagaaaccgcacatacacatcctcacaaagtctcagagtcagctttccagggggctgggttttattccggtgcaaaggagtgagaatattgtacacacgaatgatccatggtggctcctgcctgtaatcccagcacttttgggaggccaaggcgggagcatcacttgagcccaggaatttgagactagcctgggcaacatagcaagatctcgtctctacaggaaaaaaaaaaaaaattatccgggtatgatggcatatgcttctggtctccctctcaagatgctgaggcaggaggattgcttgagcccaggaggtggaggctgcagtgagctgtgactgctccactgctcttcagcctggctgatggaatgagacagtgtcacagaaaaagaatgagaaaaataagcccaggatgcagcaaagaatgctatcctttatttattaaccccctaccctggttgtatattgatggtcatttaaatattagagggtataaaaatacaatttccaagaattacctgaactattttctttttcttttcttttctttttttttttgagactgagtttcgctcttgttgcccaggctggagtgcagtggcgtggtctcggctcaccgtagcctccacctctgggttcaagtaattcttctgtgtcagcctcccgagtagctgggattacagccatgcccaaccactcctggctagttttgtatttttagtagagatggggttttactaggttggccaggctggtctcaaattcctgacctcagatgatccacctgcctcggcctcccaaagtgctgggattaaaggtgtgtgccaccacacccggcctattttcttagaattaatattttatcctctgccatcagccgtcgtaggggtatgagcagtttcctgcctattgtaagggtttagagaagggtttgtgataaattggccgtgtggtgaagagattcccattcgggaaagacattgggcagagggtaggatgtcatgtgaagacagcattcatttcaggcagggagagggggttcatagaacgctagtgttcagtgaactgttcctagaactagttcatatgtatacatgtgccatggtggtttgctacacctatcaacccgtcatctaggttttaagcccagcatgcattaggtatttgtcctaatgctctccctccccttgccccccacctcccgacaggccccggtgttcacagagctctagtatccacccaaggctcaccaaaggcagtcaccctttgctatggtggagtatcctgggagccataggtatccctgagctacctcaggttaaagactgcatacctgtgaaagcatgtgaggatttacccatttctgtgtattttgaggaaatctcacttccatcttcagagcttggtagccccaaggtaaaattttaagaagtaaagagattgtaagtttgcatattctgggaggtgatatgaggacaagctcttaggatgaactctctaggcatacaggagaaagaagtaaaggtcaaagcaaagtggcatcaaaaaggccaaaacctggccaggcacggtggctcacacctgtaatcccagcactttgggaggccgagatgggtggatcatttgtggtcaggagttcgagaccagcctggccaacatggtgaaaccctgcctctactaaaaatacaaaaatcagccaggcgtggtggtggctgcctgtagtcacagctaccagggaggctgaggcaggagaatttatttaagttccttgtagattctggacattagacctttgtcagatgaatagattgcaaaaattttctcccattctgtaggttacctgtttgctctgatgatagtttcttttgctgtgcagaagctctttagtttaatgagatctcatttgtcaatttttgaggcaggcattgttattaccccaatttcataaatgaggaaatgacagacagatagatagatagatagatatgccagttgtccctgaggaggcgaaattttgctcagttgaaaaccactgtgatatagatagatgatggatacatagatagatattagttagacagaaaatagctagatagataatagctagatagatagtaatggtcaatgatagattgtgatcaatgataggtaatagatgacaggtagataaatgatcgatggtcaatagatgataggtagatgatagacagtagatagagagtaaacagatgctatataatgatcaaagatagataaatgatagataaatatgtacttgatagataataaatggtaaatagataaatgatggtagataagtagatgatagatgataaatggtaaatagataaatgatggtagatagataagtagatgcttgattgtaaatggtaaatagataaatgatagacggtagataagtaggtgataggtggtaaataggtcgatagatattctataaatagttgatagataaatggtaggtgatagatgataggaagtgagttggatgataggcacacagacaaatggatcacatatgcatacaatctgtcatgctaaggcaggctttgtcaaccttggcagtatgtccatctggagctggatgattctctgtggtgaggccatgctgtggactgtagcgtgttgagcaggatccctgggctccacccacttgacatggatgtacccactataccccccaccgcagttataacaaccaaaaatacctccagacatttctatatgttcctgggggagggggaaacaaaaaggcctccaatggaaaaccactgatgtagatccctacagatgccagcccagttctgtggggatgtgcctactaccattcaatggcagtaacctggacctaagaccagtatgctctctgaggctctggaaagggactcccagcctcgcatcttgaggagagcttagacatcctacgtagcattatgattcccctccaaacatggctgtgctgtgtggatcaggggtctcctcccttatctcctccatcccacccagccgtctcctttcacctcagtccctgtgtgttgagtgtggaaatatctctgtgcccaggatcctgggccggttttgtggcggggattcttctcccacagctccatcatgcatgttccctcatctccttcgatgctgatgtgttattattcgtagaacagtgatgaaatggcagcatgataccatagaacggtgataaaatggcagcatgatatcatagaacggtgataaaatggaagcatgataccatagaacggtgataaaatggaggcatgataccatagaacggtgataaaatggcagcatgataccatagaacggtgataaaatggcggcatgataccatagaacagtgataaaatggaggcatgataccatagaacagtgatgaaatggcagcatgataccatagaacagtgataaaatggcggcatgatatcatagaacggtgataaaatggaggcatgataccatagaacggtgataaaatggcggcatgataccatagaacagtgataaaatggaggcatgttaccatagaacagtgataaaatggcggcatgataccatagaacagtgataaaatggcggcatgacaccatagaacagtgataaaatggaggcatgatatagaacagtgataaaatggaggcatgataccatagaacggtgataaaatggcatgataccatagaacggtgataaaatggcagcatgataccatagaaaggtgataaaatggcatgataccatagaacggtgataaaatggcggcatgataccatagaacggtgataaaatggcggcatgataccatagaacggtgataaaatggcggcatgataccatagaacggtgataaaatggcggcatgataccatagaacggtgataaaatggcatgataccatagaacggtgataaaatggcggcatgataccatagaacggtgataaaatggcggcatgatatcatagaacggtgataaaatggcggcatgataccatagaacggtgataaaatggcatgataccatagaacggtgataaaatggtggcatgataccatagaacggtgataaaatggcggcatgatatcatagaacggtgataaaatggcggcatgataccatagaacggtgataaaatggaggcatgataccatagaacggtgataaaatggcggcatgataccatagaacggtgataaaatggcggcatgataccatagaacggtgataaaatggcggcatgatctcaagggttgggattagacacccagaaatgggagcacctgtggttgggtggagttattgatccatccttctccagtgttcaactcctccacctatgctcatatcacttataaggcagacctggccaggcatggtggcttatgccggcaatcctagcactttgggaggctgtggtgggcggatcacgaggtcaggatttcgaggccagtctggccaacatggtgaaaccccatctctactaaaaatacaaaaattagtggcatatggtggtgggcgcctgtaatcccagctacttgggaggctgaggcagaagaattgcttgaacccgggaggcggaggttgcagtgagccaagatcacaccactgcattccaacctggtcaacagagtgagactctgtgtttcaaaaacaaacaaacaaaaacaaggtagaccttatgggtctttccctgggagccttctacagagtggttgttgctacagacagcagtgatatgagacaaaccatctaaggccctgaaatatgagtcttgaaaatggctgtggacaaggaaaatcaatgaaataacagtgacaccagcaccccactctctctagggctcttaaaagttcttagcctgtagcctcttttccaatccactccagccttccttttctttgaatttgaaaatgaactttgaaatttctttcagtgacaagaaaatgtcactgtgttacgtgttgtatatccatgtgtctccttgggaagaaaattaaaggactaattgaagaaagaattagaaacactgaatccacagaaacgcagccacactctgtaattaatttttgaagaaaagaaaatgaaatgcttgccgatggtgaacctctccagcatgttcattagatatttgcattttctgcctattccattaaaagtacctctaatcagacagtcaatcaaaagtgcttatccagacatcttctttttagaatttgaatcatgccatgttctgtataggagtgagaccttaccacataaacagggtagggcttgctgtgtgctcagaaacgacacattaaccaggctgaactgatggaactccagctctctgtatccttctttgtccctctaatacttgggcagattctgccccaccattaaaaattcaatcattaataccaagaagaaaattgaggggtttcaaagaacctcaataaaccacagatttaggtctttataagaccttggtaagcagttgtggattctatagtttgtacctaccataagttatgatgatcattatagcattactgataacattttaaaaacttttattgagctgggtgcggtagctcacacctgtaatcctggcactttgggaggctgaggcaggtgtatcacgaagtcaggagtttgagactagcctgaccaacatggtgaaatcccatctctactaaaaatacaaaaattgggtgtggtggtgggcgcctgtagtcccagctactcaggaggctgaggcaggagaatcgcttgaacccgggaggtggaggttgcagtgagccgagatcgcaccactgcactccagcctggcgacagagtgaaaactccatctcacaaacaaacttttatgataatgtgtatggaaagtgtctcctcttgaaatgttccattttctctaaccaaagccaacgctccagccagccagtaggtagcagccagtaggagctgtcagaactgattgctcttatcatcactaaacacacaaagagggaaaagccatttcctcattccccaaattccagctccatccttcctctgaaagcatcatgccatttctcgctccggatatgtatttggtgtttagtcattcaaccgtgacatatctaacgttggcagagagggggcagaattcgaagttcttgccattccaggaagaggaagccatgttccctgtctaagcatctgcccacatcgggccgtgtctcggtaccaactccaccaagagagcagtgagtgacaaaggcaaggatgttcttaccaaacttggcgataacctggctccattaccatcctagattaataacccttcagtcattccagaggtggatgttgatacccaagaaatggtgggtgatgtgtatttttttgttgttgttgttgaaacagagtctcactctgttgcccaggctggagtgcagtggcgcgatcttggctcactgcaatctccgcctcccgggttcaagcgattctcctgcctcagcctcccaagtagctgggattacaggcacgcaccaccacacctggctcatttttgtatttttagtagagacagggtttcaccatgttggtcaggctggtcttgaactcctgccctcgtgatccgcccaccttggcctcccaaagtgctgggattacaggcgtgagccaccacgcctggccccattataaccctcttgcatagtctatccttcactcttgcgaaatgtttaatgagatgttgaataaatgttactatgctttgtatctttttttttgcttctatgtcacttttctttttgccgtgggtggcaatggtgagttcttttgcactcagggaagcttcatgcctcatcaccccaaccttctggaaattttgattcttatagttcaaacttccataatttttaaaaaccatttttaagttcagggatacaggtgcaggtttgttacataggtaaactcgtgtcatgggggtttgttgtatgattatttcatcacccaggtattaagcccagtacccattagttattttcctgatcctgtccctcctcccaccttctgataggcctcaatgaatgctattcccctctctgtgtccatatgttctcatcatttagctctcacttataagtgagaacatgtagtaatttggttttgctgttcctacatagtttgctgaggataatcgcctccagctccatccatgtttctgcaaaggacatgatcttgttcttatttatggctgcatagtattccatggtgtctatgtaccatattttctttttctttctttctttttttttgatatggagtctcgctgtgtcacccaggctgctggagtgcagtacccttgaaaattcctctgcctcagctcactgcacccttgaaaattcctctgcctcagcctcccaagtagctgggattacaggtgcacgcccccacgcccagctaatttttttgtatttttagtagagacggggtttcaccatgtgttggccagactggtctcgaactcctgacctcgcgatccacccgccttggcctcccaaagtgctggaattacaggcgtgagccaccgcacctggcctatgtaccatattttctttattctgtctaccactgatgggcattcagattgatcccatgtctttgctattgtgaaaggtgctgccacgaacatacacgtgcatgtgtctttatgacagaatgattgatgttcctttgggtatatacccaggcatgggattgctgagtggaatgatatttctgtttttaggtctttgaggaatggccacactgtcttacacaatgttggaactaatttacactcccgccaacagtgtttaggtgttcctttttgtctgccaccttgccagcatctgttgttttttgatgttttagtaatagcctttatgactggtgtgagatggtatctcattctggttttgatttgcgtgtctctaatgagcagtgatgttgaatgtttttgcataggcttgtcggctggatgtatgtcttttttttttttttttccgagacagagtctcactctgtcgcccaggctggagtgcggtggcgcgatctcggctcactgcaacctctgctccccgggttcacgccattctcctgcctcagcctcgcaagtagctttggtttttgactttagttacatgcactttttcagaaatcaaggtatgcataagcaaagcacatctgtctttccaaactggatttaaattcgccatttactaactaaggaatattgtgcaatttagttaacttctctaagcctcattttcctcgtctatgaaatgggaagaatagtaagatctacctcaaaagaatgttgtaaaggttaaacaaggtaatcaaattgtttagtaatatgcctcccacatatcaagccctcaaccccgccaccatgcctggctaattttttttgtattcttagtagaggcagggtttcaccgtgttagccaggatggtcttgatctcctgaccttgtgatccacccgcctcggcctcccaaagtgctgggatgacaggtgtgagccaccgcgcccggccagctgcatgtgtatcttcttttgaaaagtgtctgttcatgtcctttgcctgacgtggcaaagggtgtgctttcaatgggattttttttgtttttatttttgttttgttttgtaaatttgtttaagttccttataaattctggatattaaacctttatcagatgcatagttggcagatactttctctcattctgtaggttgtctgttcacgctgttgatagtttcctgggctgtgcagaagctctttgaaactttcgtaactttaaaccaagtgttagctaactccgtttctcaactgagtaacttcagaaattaaattagaacaacaggttctgccttttgaagacaaagtagcataaccctagccatccaccacatgctatcacttgattctgattgctgttttgaggattctttttgtcccaatctctaattagttttttaaaataagcgttttgtagagaggatgtttttctcaagagttaccctgttttgactatggtagccacaccccagtgatgtacatgtgtttctctattttccatttcataaccaccgttatgtaggtgaatccttgatctgacacacagtgcctgtctttccctatgaatggcttagtgatttgcctggaaatcttagcttgctgtagtgtgtgtgtgtgtctgggcacagttttagagaaacaagcaatgattcttttttttttttttttttttaatttcctgagtcccaaagtgtttgagacaaatctcgttttcccatatcgggtctagggttatttgttcagatcctttgtcattcaggactctgtagctctttctttattccttactgaaatctcacattgacgaagagctctttccacctgatttgcttttccattggcagatgtcctttttgttcctcccttgatgcttttaggattttctcttgatctttaaagctccacggtttcatcaggatgaggttgatggacatatgggcatttaaaaataaatcgtatggcttactatacatcttataatggcagatctgggtttttatctcagggattttttttttctttgcacgaaacctttccatttacaattgacccttgaaaaacatgggggttagggacaccaacccctcacacagtcaaaaatccatgtgtaactttttttttctttttcgagacagagtttcactgttactgcccaggccagagtgcaatggtgtgatcttagctcactgcaatctccgcctcctgggttcaagcgattctcctgcctcagcctcctgagtagctggcattacaggcgcacgccaccatgcctggctaatttttgtattttcagtagagacggggttttaccatcttggtcaggctggtcttgaacttgtgacctcaggtgatccacccactttggcctcccaaagtgctgggattacagatgtgagcccctacgcctggcccatgtgcaccttttgattctccaaaaacttaattattaatagcctactgtttacaggaacccttgccaataacataaacaggtgattcactcattcatattttctatgttctatgtattgcatactttatgcttagactaaagtaagctagagaaaagaaaacgttaccaagagaatcatgagaaagagaaactacatttactattcatcaaatggaaagggatcatccccgaggtcttcatcctcatcatcttcacatggaggaggctgaggaggagaaggaggaagagggaggttggtctggctttctcaggggtggcagaggcagaagaaaatccacatataactgacctgtacagtccaaacctgtgaaggatcaactatgtttctgtgtctctttctcccagttcttgtcttcagagataccaacattggatgttgcctctcaactggtttccttctctttcatgttcttttctccaatcacttcatgtcatcatctttttcttctacattctacacgcttccacaagcctgccctctgcacccctgacatgattctccacattcattttttttctttttttgagacagagtcttgctttgtcacccaggctggagtgcagtggcacgatcacggctcactgcaacctctgcctcctgggttgaagcaattctcctgcctcagcctcgtgagtagctgggattacaggtgcccaccaccacacccagctgtattttgtatttttagtatgacagtgtttcaccatgttggcctgcctggtctcgaactcccgacttcagttgatctgcctgcctcggcctcccaaagtgctgggattacaggtgcacaccaccagacccggctaattattgtatttttttttttttttttgagacggagtctcgcacttgttgcccagggtggagtgcaatggcgcaatctcggctcactgcaaactccacctcctgggttcaagtgattctcctgccttagcctcccgagtagctggaactacatatacctgccaccacacctggctacattttgtatttttagtagagatggggttttaccatgttggcctgggtggtctcaaactcccgactttagatgatctgcccacctcaacctcccaaagtactgggattacagggtgagccaccatacccagctgagtctcctcattcttgattttgatcttccctctgtctactattgtccgggcttctctaggatgtgatgttatatctcctactcgtttccggcacccttcttattatgttaccgcattaacccttttgttaaacgtttaatatttttgtgctctgaatttattattttttatctgatatgaatatattaggttggtgcaaaagtaattgctgtttttgccattaaaagtaatgatagtcttttttttttttttttttttttttttttttttttagatggggtctcgctcttgtcacccaggcaggagtgcagtggcaccatcttggttcactgcaacctttgcgtcccaggctgaagacatcgtcccacctcagcctcccgagtagctgggactacaggcatgcgccacaacgcatagctaatttttgtattttttgtagaaacaggctctcactatgttgctcaggctagtctcaaactcctgagctcaagcaatccgtcgtcctcggcttcgcaaaatgcagggattccaggtgcgagccattgtgcccggcctgataatattttgactctgactttcttttcgtttctatttacctttaaatctcttttatgttccacctgaattactcctctgtgggtatcttttataggctgtatatttgtgttttccttccaacctatttcttgctataattgagatagtgaaggattagtggtctcaggtccttctgcctcgccccacataaatcttcatttcaactgatgctcttcatttcttttttatggaatattactttcctgttttttgtgtttgcctgtttttcccatgagtcccaagatggatattttccctccatacgggcatttattttaatgcccagtcttcacccctggaggatgcgtgagttggttcttttttcctccttgccccgtggacctcagacatggacacacgtgtctgtggttttgagggctttgttttatccgttcagttcttcagctgcttaagatggacggacagaggccgagcgcagtggcttacacctgtagtcccagcactttgggaggctgaggcgggcagaccacaaggtcaggagttcgagaccagcctggccaatatggggaaaccccatctctactaaaaatacaaaagttagccaggcgtggtggtgggtgcctgtggtcccagctattcgggaggctgaggcaggagaatggtgtgaacccgggagacagaggttccagtgagccgagattgcgccactgcactccagcctggctgacagagcgagattccatctcaaaaacaaaaacaaaaaagatggatgggcagggagtggaggctgtgggtagtgattgctgtccatgacccctgtctgtgagcacctgctctctaagctgagggaatccctggtgtcatcccagcagtggcgtgttccatgctgctgtaggccaggaacatggtgcagccgaagtggacggccatccagtgatgacttggccccagtggacagctgcccagtgatgggacatctggagtagatggccgtccaacaacagttcattattgttgtgctacgtctggtgtttccagtggctggaaccactagagctccgctccattgggttggagccattccagggtgggaatggccaccaggagacgatgcctacccttctcttcttgcaccaagtcagcacccatactcaggcgaggccctgtgtctcctcctcctccccagcatagtcttgctggagtcatgtagaaaagtcatggaaaggggcttgtgaagggatacgctgccttcttcctgggctctcctggtatcccactggtactcagtcattctccttccaaactgaggtgtgtgcatacatataatttgctggcccttaaaaaccacgtgtaggcctggctcctgtaatcccagcaatttgggaggccaaggcaggaggatcacctgaggtcaggagttcgagaccagcctgaccaacgtggagagaccccatctctactaaaaaaaaacaaaattagctgggtgtggtggtgcatgcctgtagtcccacctactcagggggctgaggcaggagaatcgcttgaacccgggaggcggagattgaggtgagccgagatcgcgccattgcactccagcctgggcaacaagagtgaaactccatctcaaaaaaaaaaaaaaaatgcaatcagctataatccttccctaaactactggtgtgactgtcttctgactccttcaactattacccaaaagatgaatgacttcttagtgaccctttgtcctaggaattatttcataggcttctgtagcaaatggaaccttgggtctcactaggataataagcatgttctgaattcctggacgcttttttctttttttcctgcacaacttcatttcggggtaaatgaggacagcacctgagttccccactcccctttggattctctagggggttgaaggtttcttctactgacatacacatggcttcaggaagatggtgttggacgctttttctttttttgagacagggtctggctctgtcgcccaggctgaagtgtaatagtgcagtcttggctcactgcaatttctgcctccgggctcaagcaatcttcccacctcagtctctcgagtagctacgactgtaggcacgtgctaccatgccctgctaatatttgtatttttttttgtaaagatgaggttttgccatttgtcccaggctggtctcaaactcccgagctcaagccatcttgcctgccatggcttcccaaagttctgggactacaggcaggagccactgcgtccagcctggttttggactcttggtcttgggtttggccaaaactttggtggttcagatggactcttgtagattttaaggagaattgaagttttgtggcttaagctgaactgctgttctcaatgcccgtgctggtccgaatgcccatgctggtccctatagcccttcatctactgtggctggtcttgtaggtctgttttatttgctgtaggagcctttgcctgtgcttgtagctatcaccgtagcattcaacacacctctgctgtatcccctgaagacgccgaaacgtggtattctcaccccaaagagtttccaccctgataagttccagcaaggcagcccagcagctacgcctgcagacacttgttggtaggaagaagtgtcagatgatctgtaacactgtgcgttgatcctgcatgtctgaagaacttcacagaattgtcgcatggtgagcagtgatactaagcaaagctgagtcacccgtaagctcccaggccctcagcccggcaagtaggacggtattttcacacctctgttgatgaagcacctcagatagctcaagtttttggagacagcctcgtaggagttttagtttaaccataatctgcttgcggatcactgatgtttccatgagtcattccctgagattgtagtgaagaaaacagatactatcccattcgcttctttgcaaaatacccacaaagccacatgcattttcatactgaacatcttgggataccatttattttcctgcaggattatatcatagtttagggttgagtgtgcctccaggagtcatcagctaagcttcctgttttgtggatagagaatacgggaggacatctgatcccctatgactgccagcatcaggcctgggattgtggttgtccaatggtgcttttagggggcaaaaatgcacagctgtttattgaaacaacaaatgttccaggctgggcacggtgactcacgcctgtaaccccagcactttgggaggccgaggcgggtggatcacctgaggtcaggagtttgagaccagcctggctgttatggtggaaccctgtctctactaaaaatacaaaaattagccgggtgtagtgttgggcatctgtaattccagctactcaggaggctgaggctggagaatcgcttgaatcgaggaggtggaggttgcagtgagttgggattgcgccactgcactccagcctgggcgacagagtaagggcagggagggctctcagtctggtagtctcacccaggtggtccagggttccagcactgagagccaggatgccaactcccaatgcatcatcagcctcctcttcagccatgcaggaagtcagggctggtcccagtggttaatccagacaccagagtgcatagcatggccctccccatgtccagcacactggcctttcactgtaccatgtcctctttctcccattgggtggcctgtgttgctttctcaatctccaagtctgtgtcagcaaggaagtgttccatcctttactgagtcatgacctgtctgaggctgacaagtgccagagctcatgttattcaggcatatttataagcaggtgtttttatttaaagacttagtccacatattacaagtattctgatggactcatcaaagcagatagggaaagttggccagtctcattttgaatgttacgatgtagccgaacatttacaaaactgtctttgactttctttctttttaattttactctaagttctgggatacatgtgcagaacgtgcaggttcgttacataggtgtgcgtgtgccatggtggtttgctgcgcctatcaaccaatcttctacgttttaagccctgcatgcattaagtatttgccctgatgccctccctccccttgcccccagctccctgacaggccccggtgtgtgatgttcccttccctgtgtccatgtgttctcattgttcaactcccacttatgagtgaaaacaggcagtgtttggttttctgttcctctgttagtttgctgagaataacagtttccagcttcatccatgtccctgcagaggagatgaactcatccttttttatggctgcatagtattccatagtgtctacataccacattttctttatccagtcttatcattgatggacatttgggttggttccaagtctttgctgttataaatagtattgcaataaacatacgtgttgaaatttttattttatcacggtcaaacgcttaccatgagagccaccctcttgacaaagtgttacatgtataatacggtcttgttaactctaggcacaactgctgtggtgtgcacagttgtacccagactgcagaactgattcatgttatataccaaaaccttatacttgtggaacagcatctccctacgtccctctctcctcatcttctgaaaaccatcattctactgtctgcttctgtgaatttgactattttagattctacatgtcagtgacatcatgcggtatttgtctctctgtgtctggtgtatttcacgttaacatcccccaggttcatccatgttgtggcaaatgacagaattcccttctttttaaggctgcgtggtattccattgtctgtatgtactgcattttctttctttttttgagatggagtcttgctctgtcacccaggctgcagtgcagtggcgtgatctcggctcactgcaacctccgcctcccaagttcaaatgattctcctgcctcagcctctggagtagctgagactacaggcacccgccaccatgcccggctaatttttgtacttcttagtagagacggtgtttccccatgttggccaggctggtctcaaactcctaactaactgcaagtgatctgcctgcctcagcctcccaaagtgctgggataccaggcgtgggccactgcacctggccaattacgttctttttttattttttttcttgagacagagtctctgtcgcccaggctggagtgcagtggcgcgatctcggcttactgcaagctccacctcccaggttcacgccattctcctgcttcagcctcctgagtagctgggactgcaggcgcctgccaccacgcctggctaatttttttgtatttttagtggaaacggggtttcaccctgttagccaggatggtctcgatctgacctcgtgatccgcccgcctcggcctcccaaagtgctggaattacaggcgtgagccaccttgctcagcccaattaccttccgtttaaggctgtaaagtatcccattgtgtgtatttacagcattttctttatttctttctttgagactgagtgtcactctgtcgcccagtctggagtgcagtggcgtgatctcagctcactgcaacctccgcctcccaagttcaagtgattctcttgcctcagcctcccaagtagctgagattacaggtgcctgccaccatgcccggctaatttttgtacttcttagtggacacggggtttcaccatgttggctgggctggtctcaaactcctaactaactgcaagtgatccacccgcctcagtctcccaaggtgctgggattccaggcaccgcgcctggcccaactaccttcttttgaaggctgcatagtatcccattgtgtgcgtgtaccgcattttcttttttttttgtttgagacggagtgtcagtctgtcgccaggcctgagccaccgcacccagctgtaccgcattttcttcatccattcatctattgaacgcttgggttcattccatatcttggtgattgtgaatactgctgccataaacatgggggtgcaaatgtctctcatagaccgatttatcttttggataaatacctagaagcatgcttgctggatcatcgagtagttctatttttaatttttttgaggaacgtccgtaccatttactgtattcacccatttctgcaggaaacagtggcagaggaacacaagttttcttcttccctgtcccagctgtgcaaaaagagacccacagccgggcgcggtggctcatgcttgtaatcccagcactttgggaggctgaggcaagcggagcacctgaggtcaggagtttgagaccagcttggccaacgtggtgaaatgtcgtctctactaaaaatacaaaaattagctgagtgtggtcgtgggtgcctgaaatcccagttacgtgggaggctgaggagggagaataccttgaacctgggaggcggaggttgccgtgagccgagatcgtgccactgcactccagcctgggcaacaggctctctcaacaaaacaaaataaaaaaaaaaaaaataaaaataagagacccacaagggctttggacctcctttctttgcaaaacaagaaaataatatagcagacattgggcagtttttcattctgactttccagtttcatttttgcttcttcctgtatggttgctgcctggacctctttcttattgctgggaggtctttcccctgcccccatccttttgagcctttctatctacttttcttttgaaagaaagtaaataaaaccccacacatccagacaataggagcgcacgcctcagaattctggctgcgagggactgaccccatccagagagaacgaacaaatgcatcaaaaccctggctgcaagcgactgaccccagcttgatccacttaagccagaagagcctttgcttctatgtttaatctgcaccaagcttagtgatcactttcttctcagaggccagaacacagagtccaacctttccaggatgccagcttcctatctctggggtctcctcttcctgcagagaagctttagtctcttacccgagctgcttctctattctcttttgccttgctttgcctataatactaacacactgtctttttcttatgttacgttggactatcccaaggcagggacccaattggcctggcttgggttccctgcctgactgtgggtttggctgaggagtgggcagcaatttccagccgttggcactgccagaacgcatgggtgtatggggtttctggaggcagcagctctatagtgaagcagatatgtagggggtgttcattaccaagacagcagtgattgtccacgagcagggtggttccaacagggagcctacagtctaactgcagatggatgctaccattttacatgtcccatgtatgacatccatgtaccgtatgttgctggacaccgcattatggcaactgaaaaacaaaaaggcattaaatgcctgggaaaatgtacagctcattacatctcatatggtttggctctgtccccactcaaatcttatttatttatttagagacagagtctcgctcactcaggctggagtgccgtggcatgatctcggctcactacagcctccacctcctgggttccagcgattctcctgcctcagccttttaattagctgggattacaggtgcccgccaccatgcacggctaatttttgtgtttttactagagacgggcttttgccaaattggccaagctggtcttgaactcctgagctcaggtgatccacctgtgttggcctcccaaagtgctgggattacaggcgtgagccaccgcgcccggccccaaatctcatcttgtattcccacctgttgtgggagggacccagtgggaggtaaccgaatcatgggggcaggtctttgccctgctgttctcatgatagtgagtaagttttatgagatctgatggttattataaaggggagtttcctgcacatgctctcttctcttgtctgtcacaatgtgagacgtgcctttcaccttttgctttccaccatgattgtgaggcttccccagccacgtggaactgtaagtccagttaaacctttcttttctaaattgcccattctcagatatgtctttatctacagcatgaaaacatacttatactttatttatccatccttatctatatcaaatactatttgaccatagattgtgtaaagacaatatggcacagagacaccatggaatactatgcagccataaaaaagaatgagttcatgtcctttgcagggacatggatgaagctggaaaccatcattctcagcaaactatcacaaggacagaaaaccaaacacctcatgttctcactcataagtgggagttgaacaatgagaacacatggacacagggaggggaacatcacacactggggcctgtcggggagtaggggactgggggagggatagcattaggagaaatacctaatgtagatgacgggttgataggtgcagcaaaccaccatggcacatggatacctatgtaacctgcatgttctgcacatgtaccccaggacttaaagtattaaacaacaacaacaaaaaaaaaaccagactcatacaacatccctacaaacaggaaaaatggggaggggaacatgggagtcaccttgtagtttacttagatttgctgtgagaagaagctatgggaggctttccaaaggctgcgggaaggatttgggctatcttcaggagattgagcttgacagcagcttcaaggcgccttgtgggaggggaggctgggggcaggaaaatcaggtgggtgaaaaatacactgatttgcagagaaatggtgccagcctggactgtgaaaacagagacgagaaaaaccacactcggcaatatttgagcacgtattaaatcctggatggcacattgcatttttatggatgtcattcctaagagattcacagtcaggggaagatggtacataacaactcgggcatgtcagatgcacctctgtagctgcgtgtccagatgccatggagtgagatgcctggttttgctcatagagttagaaacattatcagaaaatacatgtatttgagttaaattttagagagtgagtagaaattcatcgggtctacaaggaggcaaagagctttcctggatgaaattcctccttggcgttcacctaaaacttactaatttcttacagaacaaggataccacgggaggtgggtgccgcagaaccagggaactgtgtgtctgagtcaagatactgcagagaaatagaaccaatatgatgtgtgtactgatagaaagcacatttattttaaggaattttgctcatatggtgatggaggctggcaagtctcaagatgtatggggtagaccagccagctggagacccagggaggagctgatgatgtagttggagtccaaagtccatctgttggcagaatcccttctggctcaggtaacattagtcttctgttctagtcagaccttcaactgattggaccaggcccacccaccataggaaggacaaattgctttactcaaagtgtactgatttagatttttttttttttttttttgagacagagtttcactcttgttgcccaggctggggtacgatgcgatctcggtgcgatcttggctcaatgcaacttctatctcccaggtttgagcaattcttctgcctcatcctcccgagtagttgtgattataggcacacaccaccacgcccagctaatttatttttatttttttggtagagacaaggtttcaccatgttggccaggctgatctcaaactcctgacctcagatgatccacctgcctcagctgcccaaagtgctgggattataggtgtgagccactgcacccagcccagtcttttgttctattatgaccttcaactgattagaccaggcctacccaccaattcctttactcaaagtctcctgatttcgatatttatctcatttaaagcaacctcaaagaaacacccagaagaacatttaatcacatatgtgggcaccatggctcagccaagtggacttataaaatcaaggatcaagggtgcctcagaacaagagtacccagacagaacacaagttgggcagtatttcaagaggcaggggaagccatggaagctgctctgaggggacttgtgatcaggtgtgtatgttagggaggtcactgtggcagcagggtatagggtagactgcaggggtcttgtggcctctgtctctgtcacaggccaagtcatattcaaatttataaaattcaaaatttttacatcattaatttgaaattttattaaataaatacagtatatatatatatatatatatatatatatatatatatatatatgcttctttttatatactttaagttctggggtacatgtgcagaacgtgcaggtttgttacataggtatacatgtgccatggtgggttgctgcacccatcaacccatcatctacattaggtatttctcctaatgctatacctccactagcccctgaccccctgacagaccctggtgtgtgatgttccccaccctgtgtccatgtgttctcattgttcaactctcacttatgagtgagaacatgtggtgtttgcttttctgttcttgtgttagtttgctgagaatgatggtttccagcttcatccatgtccctgcaaaggacatgaacccatcctttttatggctgcatagtattccatggtgtgtctgtgtaccacattttctttatccagtctgtggtcgtatagtatttctggttctggattcttgaggaatcgccacactgtcttccacaatggttgaactaatttacactctcaataacagtgtaaaagcgttcctatttctccacatcctctccagcatctctcgtttcctgacttttttagtgatcgccattctaactggcataagttggtatttcattgtggttttgatttgcatttctctaatgacccgtgatgatgggctaaaaattcagagaaaatgtaataaaatgtttaatctagctcaagtatccttcctttgttgaatcagttttcaccttttctgtctttcctgctggctggcttgctggagcccgctctcatgagtggtgcaaggtcagagatagaaaaccaggcccatgtatggttgtgtcttttcacaagttcagccttttattgatgctatttcagtttacagaagccccaagatgcacggagttttcaaggaggcaattctccttaggacttcccatttagtactgaaatggcttgagcccttggagtactggagcctgtgtgccggcagcatttagtcagagctacaggcgcacaggctcctgctgtgacccaagtcagtcagtattgcaacctatacatactaatacacttcaccaatatatgcatgttatagattaaacattctacatcaaacaacgtaacatttatcatcaagagaaaaggggtaggaaaaagcttaacaaaggagcacagggatattgatgtggacaaaaaaaagtctcctggcctggccctggagggccatcagtggtcgccatcttgcaaggaagagcctttgatatcagtggggcagagccttttgcggtggatgctgcgtaatgattacaagtgacagcaagatggcatctgttaaggtagccatttggagctgctgaagccctgttctttcatgaccacagagtcctctggtgaggattgacaatggaagagggtgtttggttgtgtccttaactgtttggatgtggtctttattgatcaggtgaacatctggctcctgtaggcatgatgccttttgaatgaaatgtaacatggaatctttttctaaggtggagtcacttatgtcaagcgtgctctacacactcactgtaagaattaaagaggaaagaagcatgaaatgtcacttgacagttaaacacaggtttattttagagaaacctgagaggggcttctggctgagttaggtcagagctcttctctcttatagactaagcacatttaagggttttggaagggggtgcttatcataggttcagaatgtttgtatgtgagggagagtttattgcagggttgaatatctctggtcagaggggaggctgtctcagggttggtatgtttttggtcggagacgggtttatcttagggttggaatgtttctggttatgctgacatgagtcatgaggctgatgttttcgggctggatttaggcggtttttaatcaaggggagcctagaatggtggtgtttgttcaagatggccatgctcccgctctgtcacccacaacctgaagaccgttatcatattgattttgtatctcctgtgcgtacctgatggagaatgactgaatgtttgaattaaaagactcagggagaaggcaaagttgtgtttaagttgcaagttgaaaaaaacaatccattggctctgttagcagctattagagaggttggggcgggagcagagtctgtagcttaactttgcttttgttatgtcgatgctatgagcgtgggaatcatggaaactgtgaataaatggaagagagtctgtcagtgacctactgctgcatcttgggccagcccaggcatccgtgagtgttcagggagacctcgggagagttctcaggcagaaactagccactcacatgcttgtcatctgcggggttgacatggtgggctatttttatgctcagacacttgggagaaagggcaggctgtacccaaaggcagataagtgctggccagatgggcttgctgggcaccgtcgaactcatggtcaccgtcctgcccaggagctagaaatagaactagccccgggacaatccgtgaggtatcaggtgagtatggcccgatacatgtgactcagagacacaaggagtgagggtgtgtgctctgtctcaatgagagaagagagaagtcagggcttgctttggcaacaccaaatgcagatatcagactcctattcagaaaccagaattctcatctcagcatttattttctggatatgtggccgacagataggcatctctgtttataatgcctttaattttgatcttgacaaggactagaggaagctcttactgaaccttcacgcccacaaacaaaagcttctaaatcggccgggcgaggtggctcacgcctgtaatcccagcacattgggaggccgaggcggacagatcacctgaggtcaggggtttgaaaccagcctggccaacatggtgaaaccccatgtctactaaaaatacaaaaaattagccgggagtggtagcgggcatctgtagtcccagatacttgggaggctaaggcaggagagttacttgaacccaggaggtagaggttgcggtgagctgacatcacgccattgcgctccagcctgggcagtaagagtgaaactccatttaaaaacaaaacaaaacaaacaaaaaaacttctaaatcacattcaggaagcattttgtaatattttatttcttatcagggagcattttgtaatattttatttcttctcaacccctgtagtggattgaatggtgcctctattttacccccacccccaccaaaaaaaaaaaaaagacaagttcaccttgaatctgtacatgtgattttttatttggaaataaggtctttgcagatgtaaaaaaggatctggagatgagatcatcctggattgcagtggatcctaaatctaatgacaggtgtccttgtaagagacggaagaggagacacagacacagaggagaaggccacgtggagacggaggcagagactggagtgatgcggccataagcccagggatgcctggagcccccaggagctgggagaggcaggaagaattcttccctagagcagggagcatgtccctgtaggcacctcgatttcacagatgtagtctccaggactgggagaggttaaatggctgcttttgtaagctccctagtttggggtcatgggttacagtggtcccatcccaacctgtaagctctggagaacatgagtctggaatgcaagcgtgtgcggtgattcagcttgatgcctgtggtgggaaaagagccccttgtattatggcttcctgctgtgtgtaagtaaaaccagtcctctgaggaaatcaaagcccagtaaacccgtgcaccctaacttcccaggatcgcaaactggagagagagcggcagccattttctccccctgccttgatttgctgaacctgccacccgtgcagcatttcccaggaggctaacctggtgatattgtccattcttggtcctccgcaatgcaggcaatattcgttgctcagctcaaatgcttgcgtctcctctttcttctctccacctgcaaaacatcttttcataggtcccattgggaacaccagctcgttggctggtatttccacactctttttccttccttttgttgcttcatctacctctgatttgccagttgtctgatgtctcctctcacgagcctatctttctcccaagcctagtagacacgaaccattgaaagcatccttgaatgacaaaagtccaaatatcaatttgcaaggtgaagactgtggcttttattatttgttctcaatggcgggtgtctggcggggagtccagtcgcctgacgttgaatgcagtcatttcctaggtgtgggtcaagattctgatgtccacaggcaataatgtccgtgaacgtgtgtatgtaccttgatggacattactgactgtggactccagaacattggacattgtatatattgatggacatcatatatatatatacacacacacacacagacagacgcacacacacaccatggaatactacacagccacaaaaaagaatgaattaacagcatttgcagtgacctggatgagactggagactattactttttttattattatactttaagttctggggtacatgtgcaggacgtgcagtttttgttacataggtatacatgtgccatggtggtttgctgcacccctcaacccgtcatctacattagatacttgtcctaatactatcactcccctagccccccacccctcgacaggccccagtgtgtgatgttcccctccccgtgtccatgtgttcttattgttcagctcccacttatgagtgagaacatgtggtgtttggttttctgttcttgtgttagtttgctgagaagaatggtttccagctttattaaaagtcaggaaacaacagatgctagagaggatgtggagaaataggaatggttttacactgttggtgggagtgtaaattagttcaaccattgtggaagacagtgtggggattcctcaaggatctagaaccagaaataccatttgacccagtaatcacatgactgagtatatacccaaaggattataaatcattctactataaagacacatgcacacgtatgtttattgtggcactattcacatagcaaagacttggaaccaacccaaatgcccatcaatgatagaatgtataaagaaaatgtggcacatagacaccatggaatactatgcagccataaaaaaggacaagttcatgtcctttggagactattactctaagtgaagtaactcaggaatggaaaaccaaacatcgtctgttgtcactgatacgtggaagctaagctatgaggacacaaaggcatgagaatgatacaatggactttggggacttggggagagcttgggagggggcagcgagggataaaagactacaaatagtgtggaatgtgtactgcttgggtaatgggtgcaccaaaatctcacaaatcaccactaaagaacttactcgtgatcggatgtggtggctcacacctgtaatcccaacagtttgggaggctgaggcgagcggattaccttaagtcaggagttcaagaccagcctggccaacatggtgaaaccctgtctatactaaaaatacaaaaggaattagccaggcctggtggcacacacctgtaatcccagctgcttgggaggctgaggtaggagaattgcttgagcgtgggaggtggaggttgcagtgagccgagatcatgccactgcgctccagcctggctgacagagcgagactctgtctcagaaaaaaataaaaagaacttacttatataaccagatactgcctgtaacccaataagttatggaaaattaaagaaaaacacacaaaaagagtatattcaggatcacttaagtaagcatgatactacatcacatctcgttgcggaaattatatggattatcattccatgagtgtaccagcttccggaagtttctgagctcatatggggagtgggaagtaggtggtctcgtgggaactgcagggctggccccttgtcaggacggtcatcactagtgacataaataccccatggtagagagagctggggtgtcttcgtcggttttgtgtcactagaaaggaacactggaggctggataatttatagaggaaagaggtttatttgggttatgattctgcaggctgtacaagaagcacagggccagcatctgtctctgctgaggacctcaggaggcttccactcatggtggaacgggaaggggagctggtatgtgtacagagaccacacgaagagacaggagggaagacagacgggagacgccaggctctatttaacaaccagcctgtggagaactcatagagtaaaaactcactcatgcttcaagaaaggacattgatctcttcaggaagaatccatcgtccgttgctcaaacccctcccattcgacctcccatccagcactgaggcttacattttaacctgagtttgggagaggaggaattttaaagcagagcctgtagattctaaagcaaaatattctgggtctcctgcttgtagaatggttgtgagtgtgacttcctttttctatttttattttatttttttgaaacagagtctcgctctgttgcacaggctggagtgcaatggcactgtctcggctcgccgcaaccttcatctcccaggttcaagcgattctcctgcctcagcctcccaagtagctgggattacaggcgcgcaccaccatgcctggctaatttttgcatttttagtagagacggggtttcaccatgttgaccaggctggtcttgaactcctgacctcgggtgatctgctggcctcggcctcccaaaatgttgggattacaggcatgagccaccatgcctggcctgggattgttatttctaaatgattccagctttttttttttttttgtctcagctgaggcacagcggtggaacttgtcgtcttatcattgacttgttatgttcatgaaggacttggaaaaccaacgctgatcctcagagtaacagcatagatcctcacaagacagtctatgaagctggagccccctgggttgtaaaatgcctccgcaccccgtctctgtttctgaagaaggaagctctgctgagcagctaaacatgacgtgcttgttaagtgtgcattggttaaagaacagatgaaggtacaggctcagtctccaaaacttcattatacaatctcacagatgagtagcaccgttcagcattgagtgacacctactttcccgtctccaggtggttagatatcatcatctccaatttaaggcccatctaagaggtgcaccttttctcgatcctgaggctcaagtgtctaaacagcaactgtaaattttctccaatcagtgtttctcccctgtgtggaaataaattcgcatccttgaagttcagctctctccttcattttacaaaaaaacaaaaaacaaaaaaacttgttttaagcaagattaaaagtgaattttctattagcagtaattttatatcactccctgtcttgcttcttttgcactcactgaattgaagagaacgatatgaaattgcctggaaataaaaatgaaagtgcttctcagagccaaacaacactactcgtgtgaaagaatatagaatgaaagtttgaagtgtccatcagtcctgaacctgggatgatcctgtcctgatatccttaacgagaatgcatctaccaagaccctattcgcaaatcagttcacattcacggtgtttgggggttaggacttgggcatgtcattacgggaaatagctttgttggcttttctggttttacatagaaagagcaataaaggtcagccgcggtggctcacgcctgtaatcccagcactttgggaggccgaggtgggtggatcatgatgtcaggagttcaagaccagcctggccaacatggcgaaaccccatttctaatgcaagcagggcttaaaacctagatgacgggttgatgggtgcaggaaaccagcatggcacatgtatacctatgtaacaaacctgcatgttctgcatatgtatcttgcaacttaaagtaaaataaatctatctatctatatctatctatctatcttagggctgctgtaataaacgaccacacacttggaagtcttaaagccacaacaagtttattcttttccagtcctggagaccagaagtctgaaataacgatgtgggcagtactgtgcttcctctggaggctcacttgaacctgggaggcagaggttgcagtgagccaagatcatgcctttgcactccagcctgggcaacaacagcaaaactccgtctcaaaaaaaaaaaacaaaacaaaaaacaaaataccgtgaatatgttctctaaattaatctcacagcatgggagaaggtgaacaggataccccagtactgatgacaagtattatgggatggaaaagagaactggcattcttctttgctggcaacacaacctgtttttgttgatgtgaaggcagttaaccttgttgctagataaatgttactgcagatgtctgacgtaatgagaatgcgttatccacagcaaaatgcttttgaaaaagaaactgcagggaacttcacagtgagtgactaagactcactactgcagtctggcgtggtggctcacgcctgtaatcccagcattctgggagggtgaggcaggcggatcatgaggtcagtagatcgagaccatcctgggcaacagggtgaaaccccgtctctactaaaagtacaaaaaaactagctgggcatggtggcgggcgcctgtagtcccagctacttgggaggctgaggcaggagaatggcttgaaattgagaggcggaggttgcagtgagccgagatcacgccactgcactccctggtaccagagcaagactctgtctcaacgacaacaaaaaaacaaaaacaaaaacaaaagcatgatattaaagacactgtgctccatgactcagaagttgaaagagctactttgaatctgcaaatgatacctccatggatgtcgcctaagttcatgaaagatggaagcatagtgacagtaacaataatttaagaaggtttgaaaggaaaatcttggggtccccaaatcactaagctcaagggaaaagtcaagctgggaacttctcagagcaaacttgcctcccgttttattcaaagttactcctggccaggtgcggtggctcacgcctgtaatcccagcactttgggaggccagggcaggcagaacacgaggtaaagagatcaagaccatcctggcctatatgatgaagccccatctctactaaaaatattttaaaaactagctgggcatggtggcgggcacctgtagtcccggctactcgggaggctgaggcaggagaatggcttgaacctgggaggctgaggttgcagtgagccgaggtcgcgccactgcactccagcctggtgccagagcaatactctgtctaaacacacacacacacacaccccaaaaaaataatgaatgcaaccatttgtctcttatccacctatgacctggaagccccctccccacttcgagtcgtccccgtgtttctggatggaaccagtgtacctctcaacatatattgattgatgtctcatgtctgcctaaaatgtataaaaccagcgtgtgccctgaccaccttgggaacatgtcgtcaggaccacctgaggctgtgtcatgggtgcgtcctcaactgtggcaaaataaatttttctttttttttttttttgagatggagtcctactctgttgtccaggctggagtgcagtggtacgatctcggctcactgcaacctccacctccctggttccagcgattcccctgcctcagcctcctcaatagctgggattacaggtgcccgccaccatgtccagctaaagttttttttgcatttttagtagagacggagtttcaccatgttggccagacttgtcttgagctcctgacctcagacaatccgcccgcctcgacctcccaaagtgctgggattacaggcgtgagccaccacgcccggacttaactttctaaattaactgacaccatctcagatattcagggttcacaaaggcttggaggggcctgcaaatatatacaattatagaattaaatagtgatggatagagtcccttattcaaaaatactgttataaattaagttaaaatattaaagtcaaagaaacttcacacccataatcgcaatgctttcagaagatggaggattattttgagctcaggactttgagagcagcttgggcaacacagcaagatgccatttctacaaaaatttttcaaaaatagctgggcatggtggtgtgtacatgtggtcccagctactggggaggttgaggcgggaggatcacttgagcccaggagtttgaggctgcagtgagatgtgctcaaatcactgcactccagcctggctgagagaccaagaccttatctcttaaagaaagaaaataggcggctgggtccggtgactcacgcctgtaatcccagccagggcacgcgaatcacctgaggtcaggagttcgagaccagtctagcgaacatggtgaaactccgtctctactaaaaataccaatattagccaggcatggtggcaggtgcctagaattccagctacttgggaggctaaggcagggagaatcacttgaacctaggaggtggaggttgcagtgagccaagatcatgccattgcactccagcctgggtgacagagtaagactgtgtctcaaaaaaaaaaagcatacttttgagttaaaacaacagaattaccattcaacccagcaaccattcctgggtacatacctaaagaaataccaattattctaccgtaaagacacttttgcacatgaatgttcattgcagcattatttgcaatagcaaagacatgggaattaagctagatacccatcagtggtagactgggtaaagaaaatgtggtacatgtacgtcgtggaatactgtgcagctgtaaaaaagaacaagatcttattattttttgcaggaacatggatggagctggagatcattgtccttagcaaactaatacaagaacataaaagcaaatatcgcatgttctcacttataattggaagttcaacattgagtaaaggtggcctcaaagaaaggaacaacagacattggggtctgcttgagggtgaagggtgggaggagagggaggattaaaaagctgcctattggccgggcgcagtggctcacacctgtaatcccagcactttgggaggccgaggtgggcagatcacgaggtcaggagttcgagaccagcctggccaagatggtgaaaccctgtctctactaaaaatacaaaaattagccaggcagagtagcaggcatctgtaatcccagctactcgggaggctgaggcacaagaatcacttgaacccatgaggcggaggttgcagtgagccgggatcgcaccattgcactcaagcctgggcggcagagtggcactctgtctctactgcatatcagatattgtgctgattatgtgggtgacaaaataatctgtacaccaaactcccatgtcacgtaatttgcctgtgcaacaaacctgcacatggactcctcccgaatctaacatacaagtttaaaaaaatacatgtttgtacagctgcaccacgtgtgtatgtgttttaagctatgtgttatgatgactcaaaaacgttcaaaaaattaaaaggtgttaaagttataaaaaagaataaaatgcatcacacttttcaaatcatgaaatacctttttttacccatcgtgaatgtaaacattgacaccaatgggaagcttgagtattgtgtccattttacagggcaagaaaacaggggaatgggtaaatagcaaaacgagcaaagaaatgagtaggcaaaggcccatcacctatttctttgtggatgtctttgttgaactttttttcaacaaaatgaaaccaagccccctgattgttagttacctcacgcccatagtcttggccagtgagtcttttcgtaaaatggtactcaccgcagagtacattctgaatacacgttagacaacgatgaccaggaaaattcctgagtttttgatcgatcacattcctggccaaatcagatggatatttaagacctcagtgtgccctttgcaatcttgcaactcctgctttggttctctggaagaaatcttcttgtcgaagattcttactaaaactcaatgggttaaaatgcaaagatcttatttgttgcatagaatcaagactctgggtcaatacctggcagagtgactggaggctgcattggggtggactgtttttagacggcaggtcaggccccagagagaggtagttgggtgggaaacataagtcctatttctaatgcacagttgttgtgcctcctctggatatccaaatgtttggcacaatctgttttcctagaatcccagctgacatagagcagctaatgctcacatactgtcatccagccagtggctcatttagccaattaacacgctgatttcaaaagcattgtgaaaatatcactgcacacactaactagcttctgaccatcccttcccttcccttcctggcatatttctccagcgtaatctctgctcatagcctttcttacgagctacccacacccttgagcttcacaggacccattcagtctgtttgtgttttctccccgacctttcagcaatgtcaccatgatcttttcaagaatctttttctttgcttctcctgacaaatgcatcatccttctgagcaataaacagaggaattggcaaagttaataatgtcgttattgagcacttagtgaatggtgagcattatgctaagactgttttgtggtgtatccatacaccattccaacgatatatattttttaatttaagcatactttattggtaaacaatactaacaattatctgaacatttcgcgagtcaaaaccttattgctggtggagagtcttgcctcaatgttgctggctgtggactgatcagggtggtggttgctgagggtagagggtgctttggcaatttcttaaaatagacaacagtgatgtttgtcacatcagttgaccctttctgtcatgaaagatttttctgtatcaagcgatgctgtttgatagggttttacccagagtagaacttttttcaaaattcgagtcagggccgggcgtggtggctcacgcctgtaatcccagcactttgagaggccaaggcaggtggatcacctgaggtcaggagtttgagaccagtctgaccaacatggtgaaaccccatctctactaaaactacaaaaaaattagctgggcatggtggcgggcacctgtaatcccagctactcggcaggctgaggcaggagaatcgcttgaacctgggaggtggaggttgcagtgagccaagatcgcgctatggcactccagcctgggcaacaagagcaaaactccgtctcaaaaaaaaaaaaaaaaaaaaaaaaaaaaccaaaaaaccttcctgaaaggattcctcattctgaatgccatttagaaccttggtgattcatggcaggaagttaagatatccacattaacagaaatcgggaaaaagtgaattccaatattcatgaatgacattgagggggttcaagacttcagtggaggaagtcacttctgctatggtgaaaatagcagaagtaaaggtgcaggttgaagatggggctgaactcctgtaatctcatgataaaactggaatggaagaggagtttcttctcatgaaggagcagagaaaatggtttcttgagatagatactattcttgggcccatttcactgatgagaaaactgaggcctctccaggttgaagggtacaactaccaagtgtgggagtctgggctctaccccattactggacatctccagagcctgttctcccttctgctaagtttgcgggtcgctcaacattgtctccttggacgtgtgataagtcttcctgctcctccttcatcagtctttaacatttgagagacatttagagtggcctggaccaggctctttgctcattctcttttcttctactgaggcctctttcacaagtaggttttctcatctctctcttctttcatttattctctccttcattctctctttctcattctcttattctctctccctgtcttctttcctcttctcttccctcctcttcccctcctacttcttccttcccctccttctcctgcccctcatctcctcctacttctcctcctccttctccttcttctccttcatcttctttcgtttcttctccttccctttctctcctcctccttctccttctccctttccttcccttcccctctcttcccctccccttccctcccctcccctcccttcccttcccttttcttttctttttttttttctttcacggagtctcactctgttgccaggctggagtgccgtggcgcgatctcagctcactgcaacctctgcctccccggttcaagcgattcttctgcctcagcctcctgagtagctgggattacaggcatgcaccaccctgcccagctaatttttgtatttttagtagagatggggtttcaccatgttggccaggatgatctcagtctcctgacctcgtgatccacctgcctcagcctcccaaagtgctaggattacaggcatgagacaccgcacctggccccttctactttttttttcccttctccttcacctcctcttccccctcctcctgcttctcctcctcctctttcacctcctcctccttcctttctcctcctcctccttcctttctctctgtctctctctctctctctctctccctccctcccccccccccccccccccccgccgtctctctgcttctctctcattcactctcattgacgtccatatccaaatttttggaatcgcagtgctgccctcttagttctttgtcatgaaccatctgttgcccttggattgttttaccttttgtatccttggcagcttgacatacccatggtctaagcaagagtgttttctctgaaagtgcaggcatgagctgatacttgtgtgtttcatccattatcagcactgttttatgcatgtaaggagggtgtgtggcatttgcttcgtgggttgtaggaagggacacccaggaaacaaacaactaaagtgaagctttcctgcgggctaggatttgaaggtcatactaatgtccttcgagagagttaatgtcaagaattggtgtgaccaaacagtggtggatgtcatagtgttttcctcttttcataggttcacttttcaaatgagacagtagccatgagggaccatccatgcaggctgagactagtcttcaggaaaatatctatgcctagtagtttcagaaaggttagggttgcatagatgtacccacctgtccatcctgatccttactctaaattcgacctcttctatcattgctttcaccatcactgtcttgttggtgatgggcccagcttcgagaaactcagatctgcctcagtgctgctggagctggagagctggaagaaaaccaatatggcgtttgaaccgcacaatccaaaagtattgtagcagcactgattcataggttccttctcagtagaacctcttttgaattcctccaaacaaagccttctatttgagccatggcccttgagtagaccgatgtcatggactattagagtatgctattggtgctccagctacccatggccaaccaccaggcattacttaggtagagccccactgcctggcctatgcaccaggcatcaacatgaggtttcataaatacctgggagtacaagtgcagaatctctgttgaaagaatgcaatactctttttatttcttcaccgaataattaaataatttttatttcttcattaaagggcaattgaagagaagacaacatgtctctcttagtaggtaccatccccgagtagaactcatcctcctctgtgcaaagattcccattgttcagatcactctaatgctttgaggaaaacctccccacagtgtaacatacagaacactcttccgggggttatggcagatgctggagtctcttctaccaccacctaaagatgctggggtactctgcaacaccacctgaggaaaggaacaggatgaaacacctgttgtattagtcacctagggctgccatgacaaaatactacaggctgggccgcttaaacagcagacttttattttcccacagttctgaaggctggaagtctgtgagatcaaagtgtgggcagggctggttcttcctgaggcctctctgctgggcttgtagacaccgtcttctccctgtgtcctcatagggtcgcccctctgtgtgtgtctgtgtcctcatctcctcttatgaggtgtcttagtccatctcaggctgctatcacagaataccatagactgggtgacttataaacaacagacattgattctctcacagtcctggaggctggaagtctgagatccaggtatgggcagggctggttcctcctgaggcctctctcctgggcttggagacgccatcttctccctgtgtcctcacagggttgtcccaatgtgtgtgtctgtgtcctcatctccttttcttatgaggtgtcttagtccatttcaggctgctatcacagaataccatagactgggtggcttgtaaacaacagacgtttattctcccacaatcctggaggctgtaagtccaagatcaaggtgtaggcagggctggttcctcctgaggcctctcttgtaggcttgtagatgccatcttctcactgtgtcctcgcagggtcgtcactctgtgtgtctgtgtcctcatctcctcctctttttttttttgagacggagtctcgctctgtcgcccaggctggagtgcagtggcgggatctcggctcactgcaagctccacctcccaggttcaagcgattttcctgcctcagcctcccaagtagctggaactacaggtgcgtgccaccatgcctagctaattttttctatttttagtagagatggagtttcaccgtgttagccaggatggtctcgatcacctgacctcgtgatccacccacctcagcctcccaaagtactgggattacaggcgtgagccaccacacccggcctcatctcctcttcttataagcatcccagtcttctcggattaggggcctccctggtgactttgttttaccttaatcacctctttaaagactatctccaaatatggtgacattctgaggtcctgggcgttagggctttaacatagggatttgggagaaggaatcagcccatcacagctgtgcattctaagactccagtgactttgtgctgacaatggcttttccttgggtagctctaaccagatggtctggctgggtctatcttgagtctagtgactcccaccacgaggccaactgagcagggtggccaggaaagcctgtggccttacaacaaggtgatgctcacctgcagcacacaggccatcactgtagctctgctggctttattcttgggtttatagtgatggcttctttctgcctctgcctcccttgaggcatctcgtttctgtggttggagtactgtgagcctaagagacagagagcatgtccacagtcaggcttcccttacttgcttcagtagcatctcatgagtgtttccaatgcattcagggagactcttcttcactgaaggagtcagatccattttgcagctttgctgcttggaaccttgatggaatggctgagtacatggccgccagcgtcactcatgcacgaaaagtgttgttgaaagctaatagaaactgaaatctggtcgggcacggtggctcacgcctgtaatcccagcaccttgggaggctgaggcgggtggatcacctgaggtcaggagtgcgagaccagcctggccaacatggcgaaaccccatctctactaaaaatacgaaaaattagccgggcatggtggcaggcacctgtcatcccagctactcaggaggctgaggcaggagaatcgcttgaaccctggaggtggaggtttcagtgagccgagattgcgccattatactccagcttgggcaacaagagtgaaaatctgcctggaaagaaaaaaaaaaaaaagaaaaactgaaatagaagatttcccttcccccagttcactttgactgcgctaaagtaatttcctttgagggcagagaggacacggattgctttgggcatacttcaaaatgctactgtctccctaggaatattgcaaagtggttactttcccccaataacacacaactggatatttctttgatcttcaccctgggaacctggtggagctcccggaggtaaaatttgtgaaagtacaaggtcccctctaagatgggcccccagaagtttttctgttgttgttgttttttgagacagagtctcgctctgtcactcaggctggagtgcagtggtgcgatctgggctcactacaacctccacctcccagggtcaagcaattctcctgcctcagcctcccgagtagctgggattacaggtgcctgccaccacgcccggctaatttttgtatttttagtagagacggggtttcactatgttggccaggctggtctcgaactcctgacctcaggtgatctgcccgccttggcctcccaaagtgctgggattacaggtgcgagccaccatgcctggccaggagtttttaacttacttaggcttgtccactgtcagcctgcagctgtttaataattaccctgcaaatgtgtccatcaggtgctggctccagcaggaactcctagacaagcacaattccacttgccacctgtctgtccagtcttcaggcagcatttcgtcttgtgatctctattttctgatggatcgcagagttgctgattttcagtatgttctgctctttgcctattgtgaggataggaattaaaatgcgcaagctctctacatgttagtgaagtggctacgttgtctggggtatataccctggggttcgtcattgggcatcaggaaaatttaggacaaagacacacacgaggagtttaggagtggaagtttaatcaggagaagagaaagagaaatggttttctctatagagaaaggggtctccgagcggaaaggaccagctggcaccaaatgtgatggattttatagtccagtttgaggaggcggtgtctcatttacatagagctcagagattggttccatcaagcatggcatttacatagcccacaggaaaggctggttgcccaccctaatcgtttatgcaaatgggctttgtagttggtcggggctctccgagagattggttccatcaagcatgacatttacatagcccacaggaaaggctggttgcccaccctaatcggttatgcaaatgggctttgtagttggtcggggctctcggtcctgtttttcttactttacatgtggctgacaaagaggagggaagatggagccactgtcttgaacgtgtctagtctctagttcctgctgggaagatggagccgccgttttgaatgtgtctagtccctagttcctgccgggaagatggaaccgccatcttgaacgtgtctagtccctagttcctgccgggaagatggagccgccatcttgaacgtgtctagtccctagttcctgcccggaagatggagccgccatcttgaacgtgtctagtcgttagttcctcccgggaagatggagccgccatcttgaacgtgtctagtccctaggtcctcccgacattcacccgtacaagctcccagctggcttgtgtatgtctgcagctcgacttgacaggctgttcattgttagaaaatgacttggggctgcttttcgttaaagagaaaagctgccgggcgcagtggctcacacctgtcatcccagcacttttggaggctgaggcgggtggatcattaggtcaggggttcgagacgagcctgaccagtgaaaccgcgtctctactaaaaaaaaaaaaaacaaaacaaaaattagccgggcttggtggtgcgtacctataatgccagctacttaggaggctgaggcaggcgaattgcttgaacccgggaggcggaggttgcaatgagcgaacatcacgccactacactccagcctgggcgacagagcgggactccatctcaaaaaaaaaaaaaaaaagaaaagaaaaaagccttgccgaggactcccatacccttactgtctgcctaagtgatttcttcttaactcctgtatcactggcagactctgagttgcctgttgggtggagtactatattgccgagtatcatgactgtattagatgtgagggagacagtgtgaataggacatggtccctgaagagcacagagctttcacctggggctgggcggagcttctgtcctatccagtgttatggaacccttgcaagcacaggtcaagcagctcaagggctggaagacgtgcacacaaaatccaagggcaacgttggaaagaggtttagtgtttcttagaaaaatgccagaaggctgaagaagtgggggccccgagcagctctgaagggtgtgtatgcaattaaactgaagccaaaggctgagagagaggagtgagagccgcctacggagctctgtgcagcttcatcataaactcacagacaggcttcatgcagcgccgtctcagtgcattcaatgtttggattccacatgcatgcgtcctcaacccccttgcaatgctgttctccttggagggaaatgggtccttcttaccctatcacatgcaggtatctggtctaccagataaatgtgtgagaaatcaccaacaaagcagaaattacttttaattacaaagcagagtcatcgtaaaactttgtgcaaaatctttttttttttttttttccagacagggtctccatctgttacccaggctggagtgcagtggtgtgatcatggctcactgcaacttcaacttccgaggctcaggtgatcctcacatctcagcctcccaagtagctgggatgacaggtgtgcaccaccacacccagctaatttttactatctgcttaagtcatttcttcttaacccctgtatcattagaggagaaaccggaagcccctatttttgaaattagtaaccacctatcacctaaaattcctctcattactgtgacgataatgatgattttttcgagaccggatctcactctgtcacccaggctggagtgcagtggtgtgactgtggctcacgacagcttcagcctcccgggctcgagtgatcttcccaccacagtgtctaaagtagctggggctgtaggtacgcatcatcattcccagctatgtatatattttaaatattttgtagagatgggatcttcctctgttgctcaggctggtcttaaactcctggcctccagcagtcttctcacctgggcctcttaaagtgctgggattacaggcgtgtaccaccgtgtctggccaaaaaacatatctattctggggttcatagtgatgcttgtttctgccttggcctgtcttgaggcatctcactcctgtagttggagtactctgagtgtaacagatggagagtatgtccacacccactcttccctcacgtgtttctgtagcatcccgtaggagttttcaaatgcatttggagatgtattcaccctgtgacagattcaatgcatctctacaaggcagaatagctctaccatggtgtggctatggcgcttggctacctgagtctttattctgccttccaggtgcttgttggttggataactttgggtaggttcttgtacctctttgagcttcaagactgtcttagtcagctctggctgttgcaagaaaatacagttgaccttgatacaaaaattagctgggtgtggcgcctgtaatcccagatactcaggaggctgaggcaggagaatcgcttgaacctgggaggcggagattgcagggagccaagatcacaccattgcactccagcctgggcgacagagcaagattccatctcaaaaacaacaacaacaacaacaaaaaactagagttgacccttgaacaatgtgggagttaggggcgtcacacacgtccctggcacagttgaaaatccaaagataacttttgactcacccaaaacttatgaatatcctattgttgagcagaagccttatcaataccataaagtcgattaacatatattttgtatgttttatgtattgtatactgtattattaaagtatgctagagaaaagaaaatgctgtttgtttttttttagccgggcgtggtggcgcacgcctgtaatcccagctactcaggaggctgaggcaggagaatcgccttataaggaactttgagaatcaaaaatcataaggaactttcattcttttttttttttttttgagatggagtttcactctgttgccctggagtcaggctggagttcagtggtgtgatctctgctcagtacagcctacgcctcccacgttcaagtgattctcctgcctcagcctcccgagtagctggcactaaaggtgcacgccaccacgcccagctaatttttgtatttttagtagagacagggtttcaccacgttggtcaggctggtcttgaactcctgaccttaggtgacctacccgccttggcgtcccaaagtgtggagattacaggcttgagccaccacgcctgataaggaacttttattctaagtgaagtaactcagggatgaaaaaccaacatcgtatgttctcagtgttacgtgggagctaagctatgaggacacaaaggcataagaatgataaaatggaatttggggtcttgggggggaagagtgggaggggggtgagggataaacactacaaatagggtgcagtatatactgttcgggtgatgggtgtaccaaaatctcacagatcaccactaaagaacttaggtaaccaaataccaccagtaccccaatcacttatggaaagataattaaaaacaaaaaaggacaccaaactaaatttttaaaaatcatagagaagagaaaatatatttactatttctgaagtgggagtggatcgtcatgaaggtcttcatccttatcgtcttcaccttgagtagcctaagatgagagcggacaggagggattggtcttgctggctccggggtggcagaggtagaagaaaatgcccgtagaagtggacccgtgcaattcaaacctgtgttgtttaagggttaactggaccatagatggggtggcataaataacagaaatttatttctctatagtactggaggcagaaatgtttacatccaggtggcaccatggttgggtacttgagaggttcctcttcttggtttacagatggtctcgcagggcagagagagaggggggtggagcacgagggagcatgtgtgccctggtgtctcttcttacaagggcacgaatcccaacataaggatcccaccttcacgacctgatgtaaacatcatcatctcccaaaggctccgtctccaaataccatcccctttggcattagggtttccacacatgagattcggggtgacaccattcattccatagcaggagccctccttggcagactgggacaccaacgcctcttccctcttgggctgacacgagctgtaaatgtcagtggacatttaaatactgcgttacacattcgatgtcctgtctgcaatggagccgggttctgtaaacataagctgccatggcgaaatcggatcatcatcgcccatcaagctctttggcagcagtgctgtaatcagtgcaaacatttatttatataaatgctcccatcccctcggcatgaagatatacttaggctctctcaatggacagccacgccacaagcccaggaatgagagcttgtcagatactgaggctgttttcagagccagtgttcggctgaagtggcacagaagctatcattgtttgcaaatctctgctgcttgtcaagccacagggttaagtaaccccggatgttgcgaacactctgaagtgctgacctgcagtgtctttttggatcactgagccctcaggcagacaggctgtacgtggaccgacacgtcatggctgctgtcttgcacttaaccctctttatctttagaccttgattgtgcacctgtttctcattggaagctaatgacaatccacgaagcggcttggcagtgactgtctctgattgtgtaaggaggggttgccacattcacccatgttgttgactttcaactgtacacttgaaaacgtcaaaagtcagagtaagcattgcctcatgtctccgagtgtagcaattctaggaaaactcttccgaatgggtttaaagtcaaacaaatccaatcaaaacagacttgcagggccaggcacggtggctcatgcctgcaatcccagcactttgggaagccaaggtgggcagatcacttgaggtcaggagttggagaccaacctggccaacatggcgaaaccccgcctccactaaaaatacaaaaagttagccaggtgtagtggtgcgtgtctgtaatcccagctactcaggaggattagggaggagaatctcttgaacctgggaggtggaggttgcagtgagctgagatcaccccactgcagtccagcctgggtgacagagcaagatcccatctcaaaaaaaaaaaaaagaaaagaaaagtccacatagggaaatatgtgaagctctttgggtcatatgatcgctaccacaacagcgcaatatgtaaatgaatgggcaagttctgtgttctaagaatcttgagggacactgagatgtaaatgtatatatttatcacgtggcacaaaatacagttgacccggccgggcacagtggctcacaactgtcatcccagcactttgggaggccgaggcgggtggatcacctgaggtcgggagttcaagaccagcctgaccaacatggtgaaacccgtctctactaaaaatacaaaaaattagctgggaatggtggtgcgtgcctgtaatcccagctactcatgacgctgaggcaggagaatcgcttgaattcgggaggtggagattgcagtgagctgagatcacgccatcgcactccagcctgggcaacaagagggaaactccacctcgaaaaaatatgtatatacagctgacccttgaacaacacgggggttaggggtactgacctctatgcagttgaaaatctatgtataggttctgactcccccaaaagttaaatactggtagtgtactcttgaccggaagctttattcataacatagagtcgattagtacatagtttgtatgttatgtatattataaagtcagctagaaaaaaaatgctaaggaagagaagagaaaatattttactacttactaaatggaagtagatcatcataaaggtcttcgttctcttttttttttttttttttgagatggagtctcactctgtcaccgaggctggagtgcagtggcacgatctcggctcactgcaacctccgtctcctgggttcaagcacttcttctgcctcagcctcccaagtaactgggattacaggcacacgccaccacacctggctaatttttgtatttttagtagagacggggtttcaccatattggccaggctggtcttcaactcctgacctcgtgatctacccgcctcggcctcccaaactgctgggattataggcgtgagtcactgcactctgcaggagtagggagaggagggggaggggaggaggagaagggagggggggaggaggggggacgaagagggaggaggagtcatctcgggtgaaagtccaaatgggtgaatctgctcagttcagatgtatgttgtccaacagtcaactgtgttatccttcttttgattttttttaacccactgtttaaaagatgtggaaatagttttttggtttacaaggtgcacaaaaataggcaaggggctggattttgctagagggctgcagttgaccaaccccgggttagaccattaccattgtcagtgggcacacaaagtaatgaaattattatagaaaacatgaggcgttgtttactggaaaggggtcttgatcctgaccccaagagagggttcttggatcttgtgcaagaaagaatttggggtgagtccatagagtaaagtgaaagcaagttgattaagaaagtaaaggaataaagagtggccactccattggcagagcagcaccgagggctgccagttggtgatttttatggttatttcttgattctgtgcgaaacaagggaaagattattcgtgagttttctgggaagccggtgggcggttctgggaactgagggttcctcccctttttagaccctatagggtaacttcctgacattgccatgacatctgtaaactgccatgaggctgatggaagtgtcttttagcagcgaatgcattagagttagcgtataatgaacagtgaggaagaccagaggtcagtctcgtcgccatcttggtttgcatggggtttggccagcttctttaccacaacctgttttatcaacaaggtccttaggacctgtatcttaatgccgacctcctctcatgccagtggtcatgtgcattcatctggctggaagggtatctttttttttttttgagattgggttgtcactgtgttgcccaggctggagtgcagtggcacagccttgaccttctcagctcaagtgatcctcccacctcagcctcccaagtagctgggactacaggcatgcaccaccatcaccacacccagctgcttttttttttttttttttctgtatttttggtagacacgaggtttcaccatgttgcccaggctggtctcgaactgctaggctcaagcaatcctcctgcctcagcctcccaaagctctggtattacaggcatgagccactgcacctggccttcaggactatcttcagacacttgttgtagcctcttcatttctgcacatccctccccagcggagatgctctcacaaattgctcataaggaaatttcttgtgggctccaaaatctttcccctaaaacagagttctgttgaatttctccctgacaatgtaaattaacaacttgtcttcacaagtgtgggacaaagataagactagaaatgatctctccgcccaccctgagacaaatgcatgtttgacatcttcctcttctgtatgttgactttgtcttatgcaaaagtggatttactgtgcatgaaatgaacgcgtgattgactgttcctctacccgcactttgccatgtaaaatgtgtattcagagagtgccaatcaaagactcacaagaatgtaatcatttgcctcttttatctactctccttcttttttttttctttcctctttccctcctgcctgcttttttccctttctataccaaagccctcaaaaccatccttggaaaaagcacagggccgcacgcagtggctcacgcctgtaatcccagcactttgggaggccgaggcaggtggatcacctgaggtcaggagttcaagaccagcctgccaacatggcaaaaccccgtctgtactgaaaaataaaaaaaatagcagggcgtggcgttgcatgcctgtaatcccagctacttgggacagtgaggcagaagaatcatctgagcccgggaggtggaggctgcagtgagctgagactgcgccactgcactctagcctgggccacacagcaagactctgtctcaaaaaaaaaaaaagccaggcgcggtggctcacgcctgtaatcccagcactttgggaagccgaggcgggtggatcacctgaggtcaggagtttgagaccagcctgacaaacgtggtgaaagcccatctctagtaaaaatacaaaaattagccgggcgtggtgacgtgcacttgtaatcccagctactcaggaagctgaggcaggagaatcacttgaacccgggaggcgaagggtgcagtgagccgagatggcgccattgcactccagcctgggcgacagagggagactccgtctcaaaaagaaaagaaaaagcacggagcacaggtcctatggtgactggcgtctgtttttcctggactggggcacattctcaaccgtggcaaaattaacctctaaactaatggaggcttgcctcactcatcttctttgattcaaaactttgagttaatccatttatgcctgaagttgcaagtttttgaatttttgccatcagatcttggcgatgaccttgagcagtaggatataaataactccacatgcttagcattccaataatggaacactaggcatacgtgggtttaatcaaaggagagatcatctgtgctggacctgcctcaaagagggtgagatgaatgagtaattcttcttcttcaaataaacttgagatggtctcagagatccttttcctggtttttgttgttattattgttgttgtttttgaggcagagtcttgctctatcacccaggctggagtgcagtggtgcaatctcggctcactgcaacctccacctcccaggttcaagcgattctcctgccccagcctcccaagtagctgggattacaggcgcccactaccatgcctggctaatttttgtatttttcgtagagacagggtttcacccttttggccaggctggtctcgaactcctgagctcaggtgatcttccccacctcagcctatcacagtgctggaattacaggcgtgagccaccgcagccggccctttttgctggttttgaagaagcagactcccatatgacaagttgctgagggtgtcacagcaagcagagagccaccattgtctgacagccaaaatgaaaatgagacttggccgggcgcggtggctcacgcctgttatcccagcacttttggaggccaaggccggtggatcacctgagatcaggagtttgagaccactctttccaacaaggagaaaacccgtctctactaaaaagacaaaaattagctgggtgtggtggcaggcacctgtaatcccagctactggggaggctgaggcaagagaatcacttgatcttgggaggcggaggttgcagtgagctgagatcgcgaaactgcactccagcctaggcaacagagtgagactctgtctcaaagaaaagagagaaaatgtgactcaatctcacaaccacaagaagctgaattttgcctcccaattcagcatgcctggaagagcatcctaagctacagatgtcatctcagctttgtctgacaccttaattccagccttgtgagactctaaatggagacatcctgttaatctaaacccaatcttctgacttacagaactgtgagatcataaaggggtgttgttttttaaactactacgtttggggcgttttgttacgcagcagagctagctaagatggatggctccttaagcagctcatttgagggcagagggaggcaacttctgcagacagatgggcatctatattcgctaggttcaagctgttaatgctgctatgtatacccaaatgacctcactaccttctcaccaggcagcaagaaacaggatcctcagacgaacagaagtccaacaccttagtctaagtctgtttatgttctcctgataggaaatcttttcatctcataaaaagctgctgatgtaggcctttctcaccctgtaccccacgttactgatgcctgttttgttgccaaactggactggtgtccacttgcctggtgcacttaggtcaaacctccacaatgaggctttgcagcaagagaaaggatagtgtttatttggacagcaccaagccaggagactcaggcagctcacgcttaagacctaacgttttttttttttttattgaaacggagtttcactcttgctgcccaggctggagtgctatggcgtgatctcagctcaccgcaacctccacctcccgggttcaggcaattctcctgcctcagcctgctgagtggctgggattacaggcatgcgccaccacgcctggctagttttgtacttttagtagagacagcatttctccatgttggtcaggctggtctcttaactcccgacctcaggtgattccctcgctttggcatcccaaggtgctgagattgcaggcgtgagccaccgcacctggcctaagacccaatcttttcaatgacttccgagccatagtgtttcaagtcgggtaaatttcaggacagaagctgctccaggcaaaatcatgaggacgaagttctgatttttttatcttgcccaaattcctatctaaagggtctagggagtcattctttacaaaccatgagttctcattagatgggttttatttaaccctatatatcgtaacttactttccaatgtgactctggcataacataatgagacaaggaaaaacaatgtatttaaccccaaaatatatttccttgccataccttgaaattgccctgagaagtctcttgtgggaaaaatccacattctatagagaatagcctttcctccctccctcccttacctcctttacctcccttccttccttccttccttctccccttccttcctcccttctccccttccttcctcccttctccccttccttccttccctcccttctttcccttccttccttccctccattcctttccctctctcccttctttccctccctccctcctttccctccctccctccttccctccctgcctccctccttccctccctcattccctccttccctccctcattccctccttcattccctccttccctcccttccttccctccctcccttccttccctccttccctccctctcttccttccctccttccctccttccttccgtccctccctttgttcctttgttccttcccagatctgggacataatcaactgagagccaggcccccttttaggtctgataagaaacattttacaacctgttctctctgaagtctgctatctgagagcttcctgtgcaaaataaaacttggttcccacaatcctttatctccacctggacatttcctttctgttgattccaggtcttcagataaactcaaccagttgtcaaccagaaaatatttaaacttacctatagcctggcagcccccaggttgagttgtcccacctttctgaaccaaaccaatgtatttctgaaatgtatttgattgatgtctcatgccttcctaaaatatataaaatcaagctgcaccccgaccacctggggtacatgttctcgggatctcctgagggctgtgtcacgggccgtggtcactcatatttcgctcagaataaatctcttcaaatattttacagagtttgactcttttcatcaacaattataaatcacggctgggcgtcgtggctcatgcctgtaattctagcactttgggaggccgaggtgggcagatcacgaggtcatgagatcgagaccatcctggccaacatggtgaaaccctgtctctactaaaaatacaaaaattagctgggcatggtggcgcttgcctgtagtcccagctatttgggaggctgaggcaggagaatcgcttgaacctgggaggcggaggttgcagtgagccgagatggcaccactgcactccagcctgggcgacagagcgagactacatctcaaaaataataagtaaaaaaaaaatcataaatcaatacatggaagctatacgttggtttggcctaaaaagggatatcttgggccaggtacggtggctcatgcctgtaatcccagcacatttgtaggctgaggcaggcagatcacctgaggtctactagtagttcaagaccagcctggccaacatggtgaaaccccgtcttgactaaaaatacaaaaaattacccaggtgtggtggcaagtgcctgtaattccagctacttgggaggctgaggcaagagaatcgcttgaacctgggaggcagaggttgcagcgagccaagatcatgccactgcactccagcctgggcaacaagagcgaaactccatctcaaaaaaaaaaaaatatatatcttgaagctgggcccgagggtggggttgcttacaggaacaaggtggattcaaagacttttggacttgcaattggttaaggaagtggagctttgtctaagacttgcggtcagcagtaaaagcacattggatctggcccatgggcaggacctcctccaggaccctcaggaagaaatttaaaacaaggaacagggatcagagttcagtccctagctctcccacgtctgaggtcttcatgccagaggattccatagggtagaggtgtgagtttcttttattttttttaattatactttaacttctggggtacatgtgcagaatatgcaggtttgttactaggtatacacgtgccatggtagtttgctgccatccatcatctacattaggtatttgtcctaatgctctccctcccctagtcccccagtccccgaaagacccctgtgtgtgatgttcccctccctgtgtccatgtgttctcattgttcaactcccccttatgagtgaaaacatgcagtgtttggttttctgttcctgtgatagtttcctgagaatgatggtttccagcttcatccatgtccctgcaaaggacatgaactcatccttttttatggctgcatagtattccatggtgtctacgtgccacattttctttattagttgctctagggaagcgaacatccctgactctaatttccttggttgttattttaagctactgtgactttcttcttcatcaagttgctcattaacttctcccagccagcgaagtgcctggagtttccttcctggaaggaactcaagatttctcttgatttccatgcttggtcgggggtggagagagtttcctggtttgcccctaagaggggtccctgccaggtctcagttcctcaagctttctctttagcacctttagcagacagatactatcacagcttacagtgcttgcagcatgggtggtggcgtggggattttgatgccgttggattttccccactttttccattttgtgcccagaagcattactcttgaagcatttaaatttgaacacagtgggaaacagcttcttaggaattaagttttaactggtttccagtgtatctaaacagcagacaggtagacccttggtaacttctttttgatgtataaacaactcagaccattaaatcgacgctcattagcaacctatgctgctcatccaagctaccctgaagtttacttttagcccagtcctgtgggtggataatggtttcaacgcattcccaggaggacgatttacctccttggagacagaattgttcttgaaagctcttcacaagtccgcgtttccacggcaacatcaagattgacttctcgcccttgggtagtgccttgtcttcgaaagcctttctttcctctttacttacacaagctctttggggcatctgctctttgcctcgcgggtgggtcaatggtgctttcattttaatcttcttttctagactagacctgggagtcagaggacaactttaattatctgaacactttaccattctgacaacaatatttacagagtttatcctgaaggtggtttctgaggacagctgtgtatccgaggagcattgttttaacttgagttctctcgtagtgatgtatctcaagtgctcaagagggagaggagggccatcgtagtaaacacaatgaaaacaaaggcgtcacccacttatttatcccaccatgccaggcagctctctccccatctctctctttctctctctgtatgtctctctctctttctctccctctctgtgtcacaacctctgtctctctcattctattcctctctgtccctctctgtcactttctctgtgtctctcctctttctctctctctgtctctcgcttattctctctgtctctcagtttctgtgtctctctccttctgtctctctttttttttttttttgacacagagtgttgttcttctcattcagtctggggtgcaatggagtgatctcggctcactacaacctccgcctcccggattcaagcgattctcctgcctcagcctcccgagtagctgggattacaggtgcccgccaccacgctcagctagtttttatatttttagtagagacggggtttcaccatgttggccaggctggtctcgaactcctgacatcaggcgatccacccgcctcggcctcccaaactattgggattacaggtgtgagcctgtatctgtctctctgtgtctctctggcacactctctgtctctttcaagctctctttctgtgcttctatttctgtgtcacaatctttctctctgtctctttcctccctctgtctctctctttctctcccattctcaccctctctttctccataactttctctgtgttttgttcttttttcttcctctctcttgcttattttctctctctctccctctctctctctctctcacacacacacacacacatatacacacacacacagaataatctcgctgcagcgtctttcacagtaggtcttaggggcagatggatagctgcctcatacaaagaaaataggatttcaggtctccagagaggcgctccatacctgcataacgactaagagatactggtatttcacctttatttttaaattgataaatatatagaaatgagagacgcagggggtgacaaccaatctgccctccttcttggcaaattccggcagttcgggcacctgggttccttccctcctgaatgaagagaggccagaagccatcatgagcttcgtccctgctcaagactttgcaggctgtggtcgcatcagctcttggctccaagaactgggctttttgggtagcaggacggctgttgctacccacaagtgcgggaagaactgtcctctggctgcctggatcccggaggttctggcttaccaagacactcgtgaatttattaggatgcgtagggacggggcaggtgcagacggattcaggggctgtgttggctgttggtagatgcttgaaagctgttgctgctctgagctgaacgccttctccacaagcgctgcctcctggtctaaatgatgggtttttattttatattattttgagacagggtcttgctctgttttctaagctggagtgcagaggtgcagaggcataatcatagctcactgcagcctcaacctcctatgctcaagcagtcctgccacctcagcctcccacgtagctgggattgcagacatgcaccaccacactcagataattttttatgacttccttttgtagaggtagggtcttgctatgttgcccaggctgctcttgaactggcctcaagcaatcctcccacctcggcctctcaaaatgctacagtgacagggtgagccaccacacctggccatgatgattttcaaattagcccagttgggttacaaggttgactaagatctgattttcaggtagtggttatggacacacttatcacatttattctaggagctctttaataatatttcagaatggacagcatttctggaaatttttttcttagtattaaatacatttgcttttgtatgtctcagtggaagacttctttaagtttacatttttatgatttttttcttctgtatatataaatgttactcatcaagcaattcctgccctcctagcaaatttcttctgctatgcttttttcagaatttctatcagaacagcataaatttcacaaaacaaaccacctcagactctttttgtccaaccagtcagtatcagggcacttatctgttctttgaaagtctagaagaattttctaaaataccctctgcactcatctaccctttcttcatgccattctttcattattcttctctatttttcttatagctattggtctgattagacctaatttccttgattgaattgggataattagtatctctgagaaaattatttcctcgagattttcacattttacttacaaatgtaacatattatcaggatactaagaaacagaaacctatcattttaaagcttttttcatacagtacagtgtttcctatttgtaagtttgcatttcctgcctcattaaatatattattgacagtattttctgggaccttgtttctccttcttccttccttccccgtttccacccatcctttcctccttccctttcttccctcctttctccctccctccctttctttcttccctccttccattcattcttgcttccctcccctcccctccccttccctctttccacccatcctttcctccttcccccacaatgttgattttgttcatttctccctgcctacctaggaattcttgaaaaatatacttggatattgtgttattctgaagaaaatgctgtgaaaatggcacattatagcttcatctcaattcagcatttggtttatgattttcaagttagccctgttgggttacaaggttggttacacagatccaaaccatgccttcataggcgatgatcctccttgttccattaacgttttagacttcaatcattgctgtcttgtgtgactagggccatttctacttggtttttgcttgtttggctgataaatgtgaacgttttaacaattgttgaacaattgttaaaacaattgtcgaacaattgtcgaacagttgttttaacaattgtaattcctcctttttaatactctgtatctttaccatcaagatacagacatcacctttttcacaggctctgagtgtaggaggccaccattttggctttatatcatgaccagtaactgggagcgccctcgttggctgaagctgtacttcctgcttcttttctgttcttgccacatggataactggtatactccatcttattccatgagctacgtggcagacactcattttgtagctcctaggagtgcgttaaatactcccaaacactctaactttcatttctctaaattatctaaatagaatgaaggtatcgttgaaggtactccaggtggaatgaaaaaacctatctcaagtcttccggagatcctcctgtgttcggttccctggtccctctcatggtgccctgggaaagggacgcagctcctacatgggttaggttccaggtgaacgcagccactgagctcctagcaagtacgatttcctgtgtcctatgcgcagatcaccctggtgtcttggtccagtgggcttgaagcctcatactcttttgtttttccttgttttttattttattttttttatttttattacttttttttttttttgagagggagtcttgctctgtcgcccaggctggagtgcagtggcacaatctcggctcactgcaagctccgcctcccaggttcatgccattctcctgcctcagcctcctgagtagctgggactacaggcgcccgccaccacgcctggctaattttttgtagttttagtagagacagggtttcaccatgttagccaggatggtctcgatctcctgacccctcgtgatccacccgcctcggcctcccaaagtgctgggattacaggcgtgagccacccaccccccggccttgtttgttttcttttaaaaaaaatttcatgaggtacacgtgcagctttgttgtaagatacattgtgtagtgctgcggttcacgcttcagttgaacctgtcactcaaacggtgaacaaaatacctcataggtagagttttagcctttacacccctctccctcccctgctcttggaatgcgcaggtgtgccagcttcccatttttatgcctgattattcaatgtttagctcctatgtataattgagaacaagtggtatttaattttccgtttctgtgttaattcacttaggataatggcctccagctgcatctgtgttgctgctaaaaacatgatttcattcttttttatggctctatactattctacggtatatatgcagcaactacattttcttcatccaacacataattgatggacacctgggctgattccctcatgcctcccaagattgaatcaggaagaaatcagatccagaacagactcatttcatgacaagttatgaaattgaatcagtaatttacaaaaacctatcaatcaaaaaaaaaaaaaaaagccccaagaccagacaaattcacagctgaattcgaccagatgtacaaagaagagctggttccaatctgactgaaacgattctaaaaaattgaggcggagggattcctccctaacttattctacaaaacctgtatcatcttgataccaaaatctgacaaggacacgacaaaaatagaaaactacaggccaatatcccagatgaagatagacgcacaaatgctcaaccacatactagcaaacagaatccagcagtgcgtcaaaaagatgactgatcatcgaaaccttgtctctactacaaatacaaaaattagccaggcgtggtggtgcgcgtctgtaatcccagctacttgggaggctgaatcgcttgaacctggcgggtggaggttgcagtgagccaagatcgcaccactgcgctccagcctgggcaacagagcaagactctgcctcaaaaaaaaaaaaaaaagataattgatcgcaatcttaattgtgggcttcattcctgctctgctctttgtccaaagagatttttctgaatgtcaggggtgaagttcaagttctagcacccagtgagcattctgccttcccctgctgcagggcttgatgtatcggctcatcttcccctagtgatgccagccataccctgttccccttacccttcctaccagtgtttctcttggtgcgaggtagctcctgaatggatgcaaaaaaaaaaagatgctgattgcaagaatgagcaaagcccgttggttgcctgtattactccgttctcacactgctctgaagaaatacctgagactgggtaatttttaaaaattttaagttccgggtacatatgcaggattgtacatagataaacatgtgccgtggtggtttgctgcacctatcaacccatcacttaagtattaaagcccagcatgagttagctattctttttattattgtactttaagttctggggtacatgtgcagaacatgcaggtttgttatataggtatagacgtgccatggtggtttgctgcacccatcaactcgttatctacattaggtatttcttttaaagctatctctccccttgccccccaccccccaacaggccccagtgtgtgatgttcccctccctgtgtccctgtgttctcattgctcaactcccacttaagagtgagaacatgtggtgtttagttttctgttcttgtgttagtttgctgagaatgatggtttccagattcatccgtgtccctgcaaagcacatgaactcatcctttttaatgtctgcatagtagtccatggtgtctatgtgccacattttctttattcagtctatcaatgacgggcatttgcgttggttccaagtctttaatattgtgaacagtgctgcagtaaacacacatgtgcatgtgtctttatagtaggatgatttataatcctttgggtatatacccagtcatgggattgctgggtcaaatggtatttctggttctagatccttgaggaatcgccacagtgtcttccacaatggttgaactaacttccactctcaccaacagtgtaaaagcattcctgtttctccacatcctctccagcatctgttgtttcctgattttttaatgatcgcccttctaactgatgtgaggtggtatctcattgtggttttgatttgtacttcactactgagcaggcattagctatttttcctgatgctctccccctccctgacccccacccacaacacgccccagtgtgtgttgttcccctccctgtatccatgtgttctcattgttaagcacccacttatgagtgagagtgtacagtgtttggttttctgttcctgcattagtttgccaagaataatggcttctagctccatccatgtccctgcaaaggacatgatctcgttcctttttatggctgcatagtattccacggtgtatatgtaccattttttttaatccagtctatcattcttgggcatttgagttgattccacatccttgctattgtgaatagtgctgcaatgaacatatgtgtgcctgtatctttataatagaatgatttctatttatttggatatatacctagtaatgggattgctgggtcaaatggtgtttctggttctaggtctttgaggaattgctacactgagactgggtaatttataaagaaaagaagtttaattggctcatggatctgcaggctgtacgggaagcagagcagcttctgcttctagggaggcatgaggaaatgcataatcatagtggaaagtgaaggaaagcaggtgtcttacatggccctagcaagagaaggagagacagaggtgcagttggggtgggctggggagatgctacacacttttcaacaaccagatgccacgagaactcattcactattgcaagcacagcacccaggggatggcactaaactattcctgagacatccacccccgtgacccaatctccccctacaagggtccacctccagcactggggattccaattcaacttgagatttgaatgaggacacagatccaaaccatatcactacccatctatcaattcatccatccatctatccatccatccatccatccatcagttcatccatccatccatccatccattcatccatccatccatccacccacccacccacccatccatccacccacccacccatccatccatccatttatccatccatccatccatccatccatccatccatccatttatccatccatccatccatccatccatccatcagttcatccatccatccatccatccatccattcatccatccatccatttatccatccatccatctatccatccatcaatccacccacccacccatccatccatccacccatccatccatccatccatccatccatccatccatccatcagttcatccatccgtccatccatcaattcatccatccatccactcacccatcctctcatgtatccatccatcaatccatcgatccacccacccacccatccatccatccatccatccatccatttatccatccatccatccatccacccatccacccatccacccatccacccatccatccatccatccatccacccacccatccacccacccatccacccacccacccacccatccatccatccatccatttatccatccatctatccaatccatccatccatccacctatccatccatctacccatccttccacccatccatcaattcatccgtccatccgtccatgcatgcatccatctgtattagtctgttcttgcattgctataaagaagtacctgagattggatgatttataaagaaaagaggtttaattggctcatggttctgcaagctgtacaggaagcagagcagcttctgcttctggggaggcctcaggcaacttacaatcatgatggaaggtgaagtggaagccagcacgtcttaatggctagagcaggagcaagagtggaggggaggtgctgtgcacttttaaacaaccagatcttgtgggaactcattcatggtcacaagaacatcaccaaggggatggcgctaacccattcgtgagaaatccacctccatgatcccatcacctctccccaggccactcctccaacactgcggattacaattcaacatgagatttgggtggggacacagatctaaactatatcaccacctcgcaagccagtgatctcaatagaatgctgatgttcatgttgctagtggctataagccttttttctcaaggagcaagaaaaatgcatcttctagtttttttaaaaaaaatccattcacactgctgtttttggaagctcagcttgtgcttttacccatcctttgatcactggttccaattattagcagtagtatgggttttcctctttcttacatccccacaagtgtttttgtggaaaattacagcagtacctcaggagtttctatccagatgacactgtgctcagaatcagcgcttttaaactctccatggcaaaactgcctctcccctaatctgcagcagattgataactgccgtagatacaataaaaatgaattactaaaaaaaatgcatttaagaaacatggaaactagaagctctcagtgtgttttttttaagtcattggattgaacaaagcttaaatgactgtcattattttttaagtttctaaacatttactttcaatttctgaacatgtctcaccacagacagcttgcagtaacagttcacagagtggcagccgtctgattcaggagtgtgtgtaccatcataccatccaatatattactttatttatttatttatttattttttgagacagtctggctctgtcacccaggctggagtgcagtggtgcgatctcagctcactgcaacctccacctcccgggtttaagcaattctcctgcctcagccatccaagtagctgggatttcaggtgcctgaccccatgcccggctagtttttgtatttttagtagagatgcagtttcaccgtgttggccaggctggtcttgagctcctgacctcaagcgatccgcccgctttggcctcccaaagtgctgggataacaggtgtgagccactgcacctgcccacccaactgtatttctctaaggaaaatattgaaagtacttatttccttttccttgatggcctggtgacttggtacagatgggcttcattctccatgatgaggaagctgttatattatcttaaaacatgccttccaagagaaggttaaagtatatatttcagatcacaaggtcaggagcacttttggctgccacgtttggctgactcttggatgttgtgttatttaaagtgtcctagatcagccacaataaaacaaaacctaatcactgtgtctcaacctcaggtgtgtgctgcaggaagcgccagttcttgtgatatcggagccatgtccacctctgttctggggacccgggaccccacgggttggtctgagtatgtcatcaagagctagatgaggccgggtgaggtgcttcacacctgtaatcccagcactttgggaggccgaggcgggcagatcacaaggtccggagttcaagaacagcctgggcaacatggtgaaaccctgtctctactaaaacacaaaaattagccaggcgtggtggcgggtgcctgtagtcccagctactcaggaggctgaggcaggagaattggttgaatccaggaggtggaggttgcagtgagccgagatcgcaccaccgcacttcagcctgagctacagggtgaaactccatctcaaacaacaacaacaaagaactaggtgaaaagacctggcgtgctcctgcagcgcaaccagccgtgatcatacaaagaccagaatgctgcaggatggcatgtcatggcccatccctctcatctctgctccacgcagcaataagaccaaagctaacctgcttccagagacacctcgtggaaatgtgcaaggctcagcaaagaaaggctaatatctaatgattcatgtatttacacagctttttttttgagatggagtctggcactgtcaccaggctggagtgcagtggcatggtctcggctcactgcaacctccgcctcccaggttcaagcgattcccctgcctcagtctcccaagtagctgggattacaggcaatgcaccaccatgcccagctaagttttatatttttagtagagacagggttttgccatgttggccaggctggtctcgaattcctgaactcaggtgatcgcccgcctcagcctcccaaagtcctgggattacaggcgtaagccactgcgcccggcctgcttttttatttcttactagcacgagaacttagagtgatacaaatcttctgaatattttggctgcattctgcagacggtgacaccttctgtttccgtggatattatttataaaacatttttgtcacctgctatgaattgttaccctgtccacatgctttaaaagggcagtttttgaaatcaacatgagtttgggcactgggaaattgcatacttaataaaattaaacattaaaaaggggctctttctgctttcctatcaactcaggcagcagggtgatagatatagggggtgagggatgcaccctgtgttggccagggttctctagagggatataactaacaggataaatagctatatataaaggggggtttattcagtattaactcacaggatcacaaggtcctacaataagctgtctgcgagctgaggagcaaggaagccagcccgagtgctaaagctgaagaacttggagtccaatttttgagggcaggaagcatccagcacgggagaaagctgtagcatgggaggctaggccagtctaaccttttcacattcttttgcctgctttttgaatgtgctgtgctggcagctgattagatggtgcccaccccgattaagggtgggtctgcctttcccaccccactaactcaaatgttaaacttgtttggccacaccctcacagacacacccaggatcaatactttgcatccttcaatccaatcaggttgacactcggcattaaccatcacacctggtgtgtgtttctctgattataaggacaccagtcctactggacgagggcctcacccttttgagctcctacaggccctgtctgcaaataaagtcacattggagtttaagggttctgatgatgagtgagggagggcacggctcagtctataacgatgtcctatatctattgcaaagaaaaaatgaaggcactattcaattcctccaaattaggaggtttgccagagcctcagacaaaaggattttttagggaggtacagttcattccataatgatgttctctatcgcaaagaagaaggggtaattcagttcctccaaaccaggcgatttgccagaactccaaacaaaaggaatttttttttcttcttgatccctatttatcaacacatgcctctgtgtctttccagttgacttcatctcttgggcagcattaatttcagaaatctgtatttctgacttgccctcaggaaacccctttagatgttagaaattcttctgtggatgaagttatctttttttttttttgagacatagtcttgctctgtcgcccaggctggagtgcagtggtgtgatctcggcttactgcaacctccacctcccaggttcaaacgattgtcctgcctcagcctcccgagtatctgggattacaggcgtgcaccaccacacctggctaatttttgtatttttagtagagaccggatttcaccatgttggccaggctggtctcgaactcctgacctcaggtgatccacccatctcagcctcccaaagtgctggggttataggcatgagccaccacacccggccagatgaggttatcttcttgagtctcagggtttactgtctgtcactgagttgcaaataaaagaaaagttggatgagttattggcagcctcaagagcaacagtgagaattgtagactcactttctgcattggagggtgtggtgtgtgggctacgggaagcgtggacatcattcaccatgctaggtgccgagaggggcatcagacacagcaggtgcgtgaatctcctgtcttcatatgatactgtctcactgtcagaatcacagtgacagaaggcatttgttactgtggattcacactccgttagggttaagatttttattctgtgtgagttccttagggttactgtgaaaagcacatcttatcttctctcgataatttttaagtgacatttaaaaatattcaagcatgtgacttgaccgaattgcttagcatttgagttgttgcattaaatggagcatctcgtcactttcaagtatttgatactggcagttgctaagagttaaaaggcagctggatttgtcgcagacaatgagttaaggaatccttccacatttttcccatttttttttttttttttttttttttttttgagacagagtttcactcttgttgcccaggctggagtgcaatggcacgagctcggctcaccgcaacctctgcctcccaggttcaagtgattctcctgccttagcctccctggtagctgggattacaggcatgtgccaccacacccggctaattttgtatttttagtagagacggggtttctccatgttggccaggctggtcttgaactcccgacctcaggtgatccgcccgcctcggcctcccaaagtgctgggaatacaggcgtgagctgccgcgcccggcccgtttttcccaactttaaaagtaagggttctcaggaccctgtgtagagcagtgaaaataagacctcgtgtgtgtgtgtgtgtgtgtgtgtgtgtgtgtgtgtacacacgcgcctgcaggagaactgctgttccacttaggtgagaggatgggctgtgtgcttcagaccaggaaatgtgtcatcttgccaagcaacctggctgagtgtgctggagtcaggatcttgaacagaaacttccttttctggtgttgttcactacagagctaaaatggccaaatatatactgtgaaaattgttttttttttttttaacaaaagaccagatccctccttcagctgtatacatttttgaataaaatcatattgaactaacaaaaaaaaaaaaaacaccaaaactggggaacttgcacaatagaaatatatcctctcccaggtctggaggacaagactttaaatccaaggtgtctcagggctgagctccatccagacgctctaggggaggatccttttggcctcccccagctcctgggggctccaggcatcccacggcttgtggctgtatcactccagtctctgcctctgtcttcacatcatcattttctctcatctgtctcaagcatgcctgttcctcctccttataaaaaccccaggctaggcgtggtagctcatgcctgtcatcccagcactttgggaggccgaggcgggcagatcacctgaggtcaggagtttgagaccagcccggccaacatggtgaaaccccatctttactaaaaatacaaaaataagccgggcgtggtggcgggtgcctgtaatcccagctacttgggagactgaggaagggaggatcacttgaactcgggaagtggaggttgcagtcagccaagatctgtccgctgtattccagcctgggtgacagagcaagactttgtcaaaaaaaaaaaactcaaaaagacaaaacaaaaaaaactccgcactcctgtcatcctagcattttgggcagcagtatgataacaaggccaggagtttgagacctaccttggcaacatagagagacccctgtctctataaaagctaacaaacaaaaaacaaaaatctttgtcattatatttaggctaatacaggataatttcctcatttgaaaacctttaatgtctaaacaccctattttcatacaaggtaatcttttcacaggttctagagattaggaccaggagatttttagggacggagtggaggataccgtcatttagcctaccacattcttactaccttaggaaaggatggccaggcaaggtggctcacgacggtaatcccagcactttgagaggccaaggcgggcggatcgcttgagcccaggagttcgagtccagcttgggcaatattgcaaaatccgatctctacaacaactacaaaaagtagccaggcgtggtgctgcgcacctgtggtcccagctactcaggaggctaaggagggagaatcgcttgaattcgggaggtggaggctgcagtgagcccagatcacacctttgcactccagcctgggtgacagaacgagaccctgtctcaataaatgcataaataattttaaaaaggaaagtaattcagcacaaacatttgcatattcccaagatgatgctcacagcttgcagtgcctgcctgggtcctattcctatctgcctgggtctatctgcctgggtcctattcctatctgcctgggtcctattcctgtctgcctggggtctatctgcctgggtcctattcctatctgcctgggtcctattcctatctgcctggggtctatctgcctgggtcctattcctatctgcctgggtcctattcctgtctgcctggggtctatctgcctgggtcctattcctatctgcctgggtcctattcctatctgcctgggtcctattcctatctgcctggggtctatctgcctgggtcctattcctatctgcctgggtcctattcctgtctgcctggggtctatctgcctgggtcctattcctatctgcctgggtcctattcctatctgcctggggtctatctgcctgggtcctattcctatctgcctgggtcctattcctatctgcctggggtctatctgcctgggtcctattcctatctgcctgggtcctattcctatctgcctggggtctatctgcctgggtcctattcctgtctgcctgggtctatctgcctgggtcctattcctatctgcctgggtcctattcctgtctgcctcgggtctatgcatttcctttttgtctgaggacacatttttgcttcatgctgatatttttcacttcacctttctccccttttcttcttttctctttttccctctccttccctcccctccctctggggcagaagctggcatgcggcagagcgccagcagaggacgtggcccaagctcccatacatcttccctttacctcttccgctgacttttttctgggtgtgcccagagagcctagctctggacactcaaagatgcatcatttcaatgtatgttccaaagttacgtagcatccaaggcatatgagacatgcttaaaaacatactggtcatgcaagtgaggaggtgcaatgatgggtactgtcgttgcgattgcggaagccagatctagagatgcccggcgtggcttggggttcaggaaaacttcctgaaggaggtgacacatttgcgtttacgatccccaagtgaggcacacaagcatctctcggcgagaaccccacagtccatcccagaaaaggaaagtcaagagaatgggctacgtatgggaggaagggaactatttatggtcttcgatgagaaaataaatgtgcgtatgcgccccagctttgtgcttcggtattgccacatgccggaaccgcgtgaaaatacaagccgtcaatacaagcaagtgctagccctcttttattattctactgcagaagaaggaagtccttgcttctgagtcattttgtgtattagttacacatgccgtgtaacaaaataacacagactcagcagcgtgtcctaacagcctggtaatattttatccagaatgacgtgttttagaaagttatgtcctgtcaaagtaatccagataccatttccttttcttcttgtttttttggtattattatactttaagttctggatacatgtacagaacgtgcaagtttgttacataggtatacacgtgccatggtggtttgctgcacccatcgacccgtcatctacattaggtatttgtcctaaagctatcccttccctaaccctccaccccccagcaagccctggtgtgtgatgttcccctccctgtgtccatgtgttctcattgttcaacttccactgatgagtgagaacatgcagtgtttggttttctgttcctgtgatagtttgctgagaatgatggtttccagcttcatccatgtccctgcaaaggacatgaactcatcctttttttatggctgcatagtattccatggtgtctatgtgccacattttctttatccagtctatcattgatgggcatttgggttggtttcaagtttttgctattgttaatagttccgcaataaacgtatgtgtgcatgtgtctttatagtagaatgatttataaacctttggtatatacccagtaacgggattgatgggtcaaatggtatttctggttctagatccttgaggaatcgccacactgtcttccacaatggttgaactaatttacactcctaccaacggtgtaaaaatgttcctatttctccaaatcctctccatttccttttcttctccttatacagtaaggaatatgaaactaacacacactttctctcatttcattctctttctttttctgtctgctctctttgtctttctccctctctctctccctctctttttcctctctctctctccctctctttttcctctctctctctctctttctctgtctctctctttgtcttcttttctctatttctctctgtctctcagtgtttgtcacgctctctctctttgcctctttctgtctctttttttttttttgagacagagtcttgctctgtcacccaggctggagtgcagtggcgcgacctcggcttactgcaacctccacctcccaggttcatgcgattctcctgccttagcctcccaagtagctgggattacaggcgtgcaccaccacagtcgcctaatttttgtatttttagtagagatggagtttgaccacaatggccaggctggtctcgaactcctgacctctgcccaccttccaaagtgctgagattacaggtgtgcaccaccacagctggctaatttttgtatttttagtagagacgaggtttcaacatgttagccaagctggtctcaaagtcctgacctcacgtgatctgcctgccttcgcctcctaaagtgctgggattacaggcatgagccatcgtgcccggcctctttctttgtatctctctgtctgcctttctctctttgtcccttttactgtctcccgtccctctctctctttctgtttctctctctcactgtgtctctttgtctttatctctgtgtgttttttctctcttccccttttcctccccctccttttttctctttctctcttagcctttctttctttctctctttctctctctctctgcttctatctttctatctctctctttctcattcttacactccatctctgtctcttctctctctctgatggtgagtggagagtcatttcgttttggaatgatgatgagcattccagtaatagttttggagagtaaggctcatagagcttattaagcaaggtgtgtctgtcataaaattgattgctggcattttacacatcagtgcagacatggggggcacaggcagacccctccccccaccacacacacacactgcttatcctctgaaagctatgtggccttcataaaaatattaacagttcttttacagtaatgattttcccctatgaggctccccagtgaggaggctgtaaatgacactgaccaccagcagccctgcagatcaaggctgttctcttctcggccagcccagaaccagcctctgctcgctccctccctgaggactcctgtctctgacctctgcacacatgctgtgatttgctcttccacctcacaccattccccatcctcacctttcagaactcactggcagtgtcccccaataccttccacctctctccagaaattaccttcccatctcaatgtaagggaacttgcttcttccctcagagatctgctgtctctgctgcaagtaatagctagttttcatgcattttgttctgtctgactttaggttgttgcattgttctcccaacctccttgaacccatggacctggaggcagaattatatacctgtgaatttgcttttctttctagttcctctccctccaaaacctcagtccttctgggaaaaaaaaaaaaaaaacagctttaacacaatcaaacacatcacttttagcgatggagacccactgggaatttagagagaaagagtgaagttgatatactgaatacaatagacataagtctacctctctacctatgtgatgttataaagctgtccctgagtcattcactctctaaaaatgtcatctttggctggacacagctgctcacgcctgtaatccaacactttgggaggctgatgtgggaggctcacttgagcttaggagttcgagaccagccatggggacatagtgagaccctgtctccaaaaacataaatgtaataaaaaataaaatgctttcttttattattcttctgcagaagaaggaagtccttgcttctgagtcattttgtgtattagttacatatactgtgtaacaaaataacagactgagcagcgtggaagagctcatacttactatctgtagcaagggatccataaatggcgtccttttttattattatataaaattctatattctcctgtggaagaaggaagtccttgcttctgagccattttgtgtattagttacatatgccctgtaacaaaataacacagattcagcaacgtggaagggctcgtacttcttactatctgtagcaggggatgcataaattgcttcctgtttgattattatataaaattctatattctatattcctctactgcagaagaaggaagtccttgcttctgagtcattttgtgtatcagttacatatgctgtgtaacaaaataacccacagactcagcagcgtggaagggctcatacttactatcccacagctgctgcgggtcaggaatctgggcaggtgtaactgcattctctcttcggggtctcactgggctataaccaaagtgtcatctggcctgaggtcctctctggagctcaggatcttcgaaattcacatggttatacgcagaatccaattcctggaagctgcagatctggggatctgagtatcttgctggcttttggccaggggctgctgtcagctcctagagaggccatgcccaggttctggccccaaggcgctctcacaaaacatcagctcacatcaaggtcaggaggagaatgacaggtcccacacagactcaaggaaaggggactatacaaggatgggactcattgatctccctagagtatgagctcctcattgtaccctactgacatgtccaattcagtgttacttcctggacaggcgtggtggctcacgcctgtaatcccagcactttgggaggctgaggcgggcggatcacctgaggtcaagagtttgagaccagcctggccaacatggtgaaacattgtctctactaaaaaaaaaaaaaaaaaaaaaaatacaaaaatacaaaaattagctgggcctggtggcatgtgcctgtaatcccagctacctgggaggctgaggcaggagaatcactggaacccaggaagcagaggctgcagtgagctgagatcctgccacagcactccagcccggtcaacagagcgagactccatctcaaaaagagcagaaaaaaaaaaagtgttacttcctagatgaaattgagtttgacctgtttagaaattttcttaatctctgaaataggttgggagataaccaggtattttttgttgttgtccttttccagtggaatttttatactgtgacttggcttccatgacttccatccggcagtttgtgcagaagttcaagatgaagaagattcctctccatgtcctgatcaacaatggtgagtcctggtgaaattgcagcaagccaggggttaatttgaatgcaaacaggaactctagctttcatgcgggagaagtgtctcagcaaaacaggatatccatgggaattattgaacatacctgctatttctagtcagtgcttcatttcacggatagctttggaagagcatcattcttgttagcatgttactttgaaataatggtaaacgcgataacatgttgtatggagttgacacgttgacttgtccacttggactaaagggtatgaggcacatgctaagggttggtgttttcccaaatgttatcttacaaaaccatcaccacattcccctgagagtcattatttgggcactagaagctcattaccatttatctcttgattttaccccctgttcaacattctcacccagataggtggagtcaatatctccccttccccaccttcaatctgcccatctgccaatcttcaacacaaactacccttgaccttgagcccttctttgagcctcgctgagtgcttaaggtcattgcaacgcttactgttgaccttgagcccttctttgggccacgctgagcgcttaagatcattgcaacacttaatgtttctcctcgtaacactgatgcccattactctcatcccctgctgcagtccattttattttttataaaagttaacctgaaccctccacactgaggaggtacagttattgacatctccaaactaagtaaatacatagaactaaaggtctcagaaatacaccaacaaacatgtgtgctagtagaatttaacgcatcactttcacagatggagaccaaatgcaaattcagagaggaaataaatagtgacattaatacagtggatagaacagacgtacgtcaaacagtgagcccataaagacagcacattcctttcaaatacatgaaatatttatcaagttattgacacttcagattgcagacaaaaaaatcagcaaaaggatcttgtgattacccaatgtaattactccattacccacctagaccattaaagattcttaattctgcaaaaccccttgtgctacctaacgtaccattttcataaattctggagattaggatatggacatgtctgtaaggagggagaaagcattattctttgtactaaagttgtaatacctgtctgtttccagctgccaagatgtggtagcttctatctaatttttttttctttttgtcttgatgtgtttcgtgtttttgtataacattaatgggattggaggataggaaagtggatgagatacccacggttccccctcaacccacttgtttaattggaaattattatgctagagtttaaaggagaagcatgggatataaaactatacatagagtgtgatgccaatttatgcataaaaatttgtacagacatagctatgtgtgagtgcatatgtatttgtatatgtatttgatgtatgatgtatatgtatttatgcataaaaatacgtgcagacatagctatgatgtgtgagtgccactcaaatagctacagacaacaccatttccatgtacttagcctggtaagaaacatcgtattatcagtgctagtggctcctgttggaaggtccggaatgattttaactttgtgtgtcttctttggagatcaataacacttttcagatttgccatcctggtgggatctgaagtttctacgcaggcataaatgatttcccagtcagcagccatttggaatcttctgtctcagcactgggtgtggacttcctttgctgaagacctatcagtattagaagtgattagaattatagcattataagtcaccaaatgtggagaccacttagaggcactgtggagatcctacacgacccgacgtctcatttcctcgttctgtgtaacacccttactcattagtaatgggagcactttatcacagagcagttggagatggaaatacatacatgacatggtgcccttgcacagagacacacaaaacagaactgtccatcctcttaggacttttgtgcgactacttccatccatttggtatgggcttgcatccaccagtaagcagaaaaaattaggaatctcaggccgggcgcggtggctcacccctgtaatcccaacactttgggaggctgaggtgagtggatcacctgaggtcaggggttccagaccagcctgaccaatatggtgaaaccctgtctctactaaaaatacaaatattagccaggcgtggtggcgggcatctgtagtcccagctactcaggaggctgaggcaggagaatcgcttgaacctgggaggtggaggctgcagtgagccgagaccacaccattgcactccagcctgagcaacagagcaagactgtttcaaaaaaaaaaaaaaattaggaatgtcagatatgatatgtttctccagcagaatcttactgtgttctggggggagcagaattttactgagcaatgtgtatatgaaccacatctgtgacagtggatacaggctaacaccagttgacacaggctaaccagcgtatactccatcactcaaccaccacgtttaccttttgaaatggctattgcattcctaggattctcctctgttccttttctcaacagattttaaacaaggcacacagggctctcagaaacaaacaaaaatattctggaaactgggacagggttgaatttgaatcaaaagggtcttgttgttggattgtctctgtaccctatctcttctgtagaaaatctcatgcacatattgggtttacttcttcctagacttatctagacctttcttccatgctaagaccttttaccttcgctcaatgcctcagaggcacctcaagccagtaagtccagtgtgaaattcctgagtctatggctgacactggttctagaggagagtatttccttccccagtttttagaagactgtcagcgtttcttcacccatggcctccaacccggccttaaagccagcaatgatagtggctcacgcctgtaacctcagcactttgggaggccgaggcaggtggattacgtgaggtcaggagttcgagaccaacgtggacaacattgtgaaaccctgtctctactaaaaatacaaaattagctgggcatggtggcgcatgcctgtaatcccagctactcgggaggctgaggcaggagaattgcttgaacccgggaggcagaggttgcagtaagctgagatcacaccactgcactccagtctgggcaacaagagcaaaactccatctcaaaacaacaaaaacaacaacaaagccagcaatgagacacctttgaatctctctttcttgttctctctctctccctctcttcccttctctctctttctctctctcatcttgccttctctttttttttatctccttcacttacttttgttcttctgcctgccttgtagaagaaccattgtgattatttggggcccaccaggatcatctcagataatcacctcatctcaagatcttccactaattcacatctacaaaggcccttttgccgtgaaagtcacattttcatgtgttccagagatgaggacatggacattttttcatcttttgagttattactcttccaaattgggaataggttgtgggcatctctggggtcattattgtgtcgaccacatgagaattagtctgtggacatctttagagccattattcagtcttccacatgaggattaggatgtggacatctttggggccattattctgtttcccacatgaggattagaatgtgaacatctttggggctattattctatctaccacatgggaattaacatatggacatctttggggccattgttcggcttccacatggggattaggatgtggacatctttggggccattattctgtcttccacatggggatttggatatggacatcttcggggccattattctgtctcccacatggggattcggatatggacatcttcggggccattattctgtgtaccacatggggattgggatgtggacatctttggggccattattctgtctaccacatggggattaggatgtggacatcttcagggccattattttgtcttccacatgaggattgggatgtggacatctttgggtcattattctgtcttccacatgaggattaggatgtggacatttttggggccattattctgtcttccacctgaggattaggatgtggacatctttggggccattattgtgtctcccacatggggattacagtgtgggcatttttggggtcatgattctgtctcccacatgaataatgtggacctggacatcttgagttgtgcattatttaacctgccatacctacctactctgcccttcacatacttcgcttgcaggaaaaataaaataataagcaagattcttgacctcatagaaatcatactttagcaacggaaacaaacattggaccaataatcattctgtgaaatgttctgccttagaaaacacacctcttgcaatgtgacaacacagtcttgtaaagtacagagaagattgcaccccaagtcacacgcctccctggaattccccagcctgtgctgctcagaacaccatttccaggaggtgataatgagaatccatttgttacaagatgatggcttgaaataacactttgcactttcttccttttatctttttgttctacatctttcaagaggttgctcaggctgtggctttcctggactccctataggtttttgtggctgactaaggttcatcttgtccctggggtcactgttgagaagagctcagttgcagaggatctggatttttttttttttcctctgtgggtacagacagaagcttctagaaaagagctggagacttcgcttttggaggctgtgttgaatacccattgcccactcttcacaagaagacagaaatgcagagaggcagtctcttgttgacaaatcctcttggttctcttggaaatgcaacagaaccatggagcttcgtgaagcccatgggcttggaaaggggcctcccgaggtacccagggtggatggaaagctgcagggataagtgctcctcaagccagaagtagcccagatggcacagtctatgctgagaatggattcatcaccagcctgtgtgctggaggcttgggccagatgaaccttgatttagagaggaagtaaagcattttttgccttggtttgtgcatcagaattcatcttcatggtgtgcaaatgacgaggctggattctatacagtcagcactgagaatggattcagcacaagcccgtgtgctggaggcctgggtctgatgtacctggatttagggaagaagcaaagtatttttctcatttattgcatgccttagtttgtgcatcagaattcatcttcgtggtgtgcaaatgagaaggctggattctacacagtcagcgttgagaatggattcatcaccagctcttgtgctggaggcttgagccagatgtacgttgatttagagaagaagtaaaggatttttctcatttgttgcatgccttggtttatgcatcagaattcatcttcgttgtgtgcaaatgagaaggctggattctatacagtcaacgctgagaatgggttcatcaccagctggtgtgctgaagcttgggccagatgtaccttgacttagagaagaaatcaaggatttttctcgttggtttgtgcatcagaattcttcttcgttgtgtgcaaatgagattgctggattgtatgtttgggatattgctggtgtcaacttatgtaaatagagtttctatttataggcagcctcagggaaggactccagtggtggtacttttagtgtctaagaggctagtagggggtctgcagacccctaaaccagggctgtccaacccccaggtcatagtaccagtccatggcctgttaggacaccggccgcacagcagaaggtgagtggcaagtgaacaagcaaagcttcatctgtatttacagccactccccattgttcacatgactgcctgagctctgcctcctgtcagatcagcagcagcattagattcttataggagcacaaaccctactgtgaactgtgcatgtgagggacttaggttgtgcactccttatgaaaagctaaagcctgatgatctgtgcatgggaaggatctaggttgtgtgctccttatggaatctaattcctgatgatctgtcactgtctcccatcacccccagatgggactgtctagtcacaggaaaacaagctcagggctcccactgattctatatgatggcgacttgtagaattatttcattatatagtacaatgtaataataatacaaataaagtgtacaataaatgtcatgccccggaatcatcccaaaaccatccccacattccacctccaccttctgtcttcagaaaattgtctttcacaaaagtggtccctggtgccaaaaaggttggagactgctgccctaaactatttccccagaaccttccctccaaaactcctgctagtcaaccacgtgcctcaagtctcatggaaaacagccccagctgagctcagccagggtgacttccaaggcaagaaggagctacacttcgtgcttttctttttttattcttagagcaatcaaggttttgcaaacattaaatacttcagacatagaatatctttttcatttgctagtgggttgaaaatagaacctgactgcctctgtctggctgctgtgggaagctcagaggcaacgcgatgatttatcaagcacaagaataaatcaataatagacctcctgcagagccggtatttatggtttattcacttcaaaattgtatttatctagcttcccatccccatgtctgaaaattgatagatttttaataatgcagaggatttatagatttatccttgtcagccatcttcccataactctaatggatgaatttctttctgagataatgaattactaagcattatttttcctaccaccaaagaaatacgtccacgatacagggtgaccctgaaaaataacaatgattcttccctggccagagacctaaagactctgttttttggtacagttcttcattcacccattcattcattcattcattcattcattcaaattcattcattcacttgaatgaattcaaatgagtgaatgaatgaatgaaagaattcaaatgaatgaatgaattcagaggaatgaatgaatgcaaatgaattcaaaggaatgaacaaatgaattcaaatgaattaattctaaggaatgaatgaattctaatgaatgaacaaatgaattcaaaggaacgaatgaattcaaaggactaaatgaattgaaaggaatgtatgaattcaaaggaatgaattcaaaggaatgaatgaatgaattcaaatgagtgaatctgaatgaattcaagggaatgaataaattcaaatgaaggaatgaattcaaatgaatgaacaaatgaagtcaaaggaacgaatgaattcaaaggaatgaataaattcagaggaatgaatgaatgaattcaaaggaatgagtgaattcaaaggaatgagtgaattcaaaggaatgagtgaattcaaaggaatgagtgaattcaaaggaatgagtgaattcaaaggaatgaacgaattcaaaggaatgaatgaatgaattcaaatgagtgaatttaaatgaataaattcaagtgaatgaatgaattcaaaggaacaagtgaattcaaaagaaggaatgaattcaaatgatgcaaatgaatgaatggaatcaaatgaatgaatgaattctaatgagttcattcaaatgagcaaatgggcacagggcacctacaagacccatgagagttaaggaagattcattcggggaagcccaggtgtgcagttctgcatcaacagaagactgaggtgcagtggagccggtccttactgaggacccactttttggtggacggacacctgagcagccatctcctgtctttgtgggcgcctggcattttctatgtgactcgggctccacagtcatctggtctccctcccgggaagacggaaagtgttgcatcgcggcgcatgcattcgtcagcggatccttgagtctgcacaggtgtagaccatttattctgcgtgccttctgtttgcttctcttccagagctgctctcctgtggatagagtagctttctgttccgtagtggtttcctctgcctctcccgatggcgccttctctgaacaggaggcatttggatgttcttttagtgttggtgttggcagcagcatgggatgtggtctgttgtgactctgcggcaggctgttccctgccagagaaggctagatgttcagggcgtccgtcccatagcctccctggactggctccatccttcccaccgccctcccgagattctaggaagtgggttgagaagcagtggtttttcagttactcaaatgcttttctcctctctctctctctttctgtaactctctgtctctctctcctccttctccccgtctctctgtcattctctctttccacctcttcactgtctcacttttcctctcttttgctttttctctctgtctctctctctcctcagtctaccccatccccgcttctactattttgctctcgacctcccttctccctcctccctccctctctccccctctctctccccttctcccttctctctctccctttctccctctctctccctctctctctttctctcttctctctttcttctctctctccccctccctccctcgctttctcccctcttctctctctcccattctccctctccctccctccctctctccttccttccctctctccctctttctcccctcttctctctctccttttctcccattctctctctccctctctccctccctttcccttcttctctccctcccctctttcttctctctcccctctttcttctctctctccctttctgtttccctctcgcacaccctccctcttctccctatctcctttctcttcctgtctctccccttgtctctctatctcctttgtcttcctctgtgtcccacttctctctctttcctccttcccccatctctcctcctctctcctttgccttccttctctccccctttctctctttctctctgtctctttctctgtctctccccttatttcctccctctccttctctcttcctttctcgtttgccctccctctctctccctgttccctctccatctctctctctctttcccccatttcctcctcttccttctctctccctctcgtttgccctccctctctctccccgttccctctccatctctctttctctctctttcccccatttcctcctcttccttctctctccctctcgtttgccctccctctctctccccgttccctctccatctctctttctctctctttcccccatttcctcctcctccttctctctccctctcgtttgccctccctctctctccccgttccctctccatctctctttctctctctttcccccatttcctcctcctccttctctctccctctctcgtttgccctccctctctctccccgttccctctccatctctctctctctttcccccatttcctcctcttccttctctctccctctcgtttgccctccctctctctccccgttccctctccatctctctttctctctctttcccctatttcctccctctcctccttctctctccctctctcgtttgccctccctctctctccccgttccctctccatctctctttctctctctttcccccatttcctcctcctccttctctctccctctcgtttgccctccctctctctccccgttccctctccatctctctttctctctctttcccccatttcctcctcctccttctctctccctctcgtttgccctccctctctctccccgttccctctccatctctctttctctctctttcccccatttcctcctcctccttctctctccctctcgtttgccctccctctctctccccgttccctctccatctctctctctctttcccccatttcctcctcttccttctctctccctctcgtttgccctccctctctctccccgttccctctccatctctctctctctttcccccatttcctcctcttccttctctctccctctcgtttgccctccctctctctccctgttccctctccatctctctttctctctctttcccccatttcctcctcttccttctctctccctctctcgtttgccctccctctctctccccgttccctctccatctctctctctctttcccccatttcctcctcttccttctctctccctctcgtttgccctccctctctctccccgttccctctccatctctctctctctttcccccatttcctcctcttccttctctctccctctcgtttgccctccctctctctccctgttccctctccatctctctttctctctctttcccccatttcctcctcttccttctctctccctctctcgtttgccctccctctctctccccgttccctctccatctctctctctctttcccccatttcctcctcttccttctctctccctctcgtttgccctccctctctctccccgttccctctccatctctctctctctttcccccatttcctcctcttccttctctctccctctcgtttgccctccctctctctccccgttccctctccatctctctttctctctctttcccccatttcctcctcctccttctctctccctctcgtttgccctccctctctctccctgttccctctccatctctctttctctctctttcccccatttcctcctcctccttctctctccctctcgtttgccctccctctctctccctgttccctctccatctctctttctctctctttcccccatttcctcctcctccttctctctccctctcgtttgccctccctctctctccccgttccctctccatctctctttctctctctttcccccatttcctcctcctccttctctctccctctcgtttgccctccctctctctccctgttccctctccatctctctttctctctctttcccccatttcctcctcctccttctctctccctctcgtttgccctccctctctctccctgttccctctccatctctctttctctctctttcccccatttcctcctcctccttctctctccctctcgtttgccctccctctctctccctgttccctctccatctctctttctctctctttcccccatttcctcctcttccttctctctccctctctcgtttgccctccctctctctccccgttccctctccatctctctttctctctctttcccccatttcctcctcctccttctctctccctctcgtttgccctccctctctctccccgttccctctccatctctctttctctctctttcccccatttcctcctcctccttctctctccctctcgtttgccctccctctctctccccgttccctctccatctctctttctctctctttcccccatttcctcctcctccttctctctccctctcgtttgccctccctctctctccccgttccctctccatctctctttctctctctttcccccatttcctcctcctccttctctctccctctctcgtttgccctccctctctctccccgttccctctccatctctctctctctttcccccatttcctcctcttccttctctctccctctcgtttgccctccctctctctccccgttccctctccatctctctttctctctcccccatttcctcctcttccttctctctccctctcgtttgccctccctctctctccccgttccctctccatctctctctctctttcccccatttcctcctcttccttctctctccctctcgtttgccctccctctctctccctgttccctctccatctctctttctctctctttcccccatttcctcctcttccttctctctccctctctcgtttgccctccctctctctccccgttccctctccatctctctctctctttcccccatttcctcctcttccttctctctccctctcgtttgccctccctctctctccccgttccctctccatctctctctctctttcccccatttcctcctcttccttctctctccctctcgtttgccctccctctctctccccgttccctctccatctctctttctctctctttcccccatttcctcctcctccttctctctccctctcgtttgccctccctctctctccctgttccctctccatctctctttctctctctttcccccatttcctcctcctccttctctctccctctcgtttgccctccctctctctccctgttccctctccatctctctttctctctctttcccccatttcctcctcctccttctctctccctctcgtttgccctccctctctctccccgttccctctccatctctctttctctctctttcccccatttcctcctcctccttctctctccctctcgtttgccctccctctctctccctgttccctctccatctctctttctctctctttcccccatttcctcctcctccttctctctccctctcgtttgccctccctctctctccctgttccctctccatctctctttctctctctttcccccatttcctcctcctccttctctctccctctcgtttgccctccctctctctccctgttccctctccatctctctttctctctctttcccccatttcctcctcttccttctctctccctctctcgtttgccctccctctctctccccgttccctctccatctctctttctctctctttcccccatttcctcctcctccttctctctccctctcgtttgccctccctctctctccccgttccctctccatctctctttctctctctttcccccatttcctcctcctccttctctctccctctcgtttgccctccctctctctccccgttccctctccatctctctttctctctctttcccccatttcctcctcctccttctctctccctctcgtttgccctccctctctctccccgttccctctccatctctctttctctctctttcccccatttcctcctcctccttctctctccctctctcgtttgccctccctctctctccccgttccctctccatctctctctctctttcccccatttcctcctcttccttctctctccctctcgtttgccctccctctctctccccgttccctctccatctctctttctctctctttcccccatttcctcctcctccttctctctccctctcgtttgccctccctctctctccccgttccctctccatctctctttctctctctttcccccatttcctcctcctccttctctctccctctctcgtttgccctccctctctctccccgttccctctccatctctctctctctttcccccatttcctcctcttccttctctctccctctcgtttgccctccctctctctccccgttccctctccatctctctttctctctctttcccccatttcctcctcctccttctctctccctctcgtttgccctccctctctctccctgttccctctccatctctctttctctctctttcccccatttcctcctcctccttctctctccctctcgtttgccctccctctctctccccgttccctctccatctctctttctctctctttcccccatttcctcctcctccttctctctccctctcgtttgccctccctctctctccctgttccctctccatctctctttctctctctttcccccatttcctcctcctccttctctctccctctcgtttgccctccctctctctccctgttccctctccatctctctttctctctctttcccccatttcctcctcctccttctctctccctctcgtttgccctccctctctctccctgttccctctccatctctctttctctctctttcccccatttcctcctcttccttctctctccctctctcgtttgccctccctctctctccctgttccctctccatctctctttctctctctttcccctatttcctcccctccttctctctccctctcgtttgccctccctctctctccctgttccctctccatctctctttctctttctttcccccatttcctcctcttccttctctctccctctctcgtttgccctccctctctctccctgttccctctccatctctctttctctctttcccccatttcctcctcttccttctctctccctctctcgtttgccctccctctctctccctgttccctctccatctctctttctctctttcccctatttcctcctcttccttctctctccctctctcgtttgccctccctctctctccctgttccctctccatctctctttctctctttccccctatttcctccctctcctcctctctccctctcgtttgccctccctctctctccctgttccctctccatctctctttctctctcttcccccatttcctcctcttccttctctctccctctctcgtttgccctccctctctctccctgttccctctccatctctctttctctctttcccctatttcctcccctccttctctctccctctcgtttgccctccctctctctccctgttccctctccatctctctttgtctctctttctccctatttcctccctctccttctctcttccttctttgccctccctctctctctcctctctctctctctgattgccctttcatccccatcactctcctttctctggagttctccgcttggagagcggagaactctcccttctcctcccgttcaggatacacctcacctgtgttcactgcttcaggcacaatatgtgattgtgaccctgagcgttcactccccagtaaaatgccattaggtgcacagaccaatgaacgataattgtattgcgtattttccacctttgaattggcagatcaatggacgataattttactgtttattttccacctttgaattggcagatcgatggacgatagttttattctgtattttccacctttcgattcgcagatcaatgaacgatagttctattgtgtattctccacctttgaattggcgaagagacagattccgtgaatgctcctaacgtggacggcacccgatacactgacgtggccacagggttttcttattccttacaaaattcgcaatgaaacatcagtatatttgctgatgattaaaacttgtgcaacaaaatctcagaagtcaccacaaaagaatgtatccatgtagcccaaaaccactggtttcccaaaaattattgaaattttaagaaacaggccgggcgcgatggcccacgcctgtaatcccagcactttgggaggccgacgtggatggatcacgaggtcaggagttcgagaccatcctggccaacacggtgaaatcccgtctctactaaaaatacagaaattagctgggcatagtagcatacacctgtaatcccagctactcaggagcctgaggcaggagaatttctggaacccgggaggcagaggctgcagtgggccgagattgtgccactgcactccagcctagcgacagagtgagactccatctcaaaaataaaattaaattaaaatttttaaaaaaaggcaaattattattttattttatttatttatttccttttttgagacagagccttgctctgtcgcccaggctggagtgcagtggcacaacctcttctcactgcaatctccgcctcccagaaaaaaacaggcaaattaaatctatggtaatggaaattggaattgtagttaccttagaagaatgtgataattaattttggatcaaaaaagggcttaggggtgcagatgtgggaggcggttacctgagaggggagagtgctcgctttggatgattccattgagatttccctcatgatctctgcaccttttttttttttgttttgaaacatagtctcgctgttgtcggccggggctggagtgcagtgcacgatatcagctcactgcaacctctgcctcctgagttccagaaattctcctgcctcagcctcccaagcagctgaaattacaggtgcccgccaccacactcagctaattttttttttttttttgtatttttagtagagacggggtttcaccaagttggccaggctggtctcaaactcctgacctcaggtcatccgcctgcctcggcctcccagagtgctgggattacaggtgtgagtcaccgtgcccagccctgtgcaccttttttatactttcctttgatttaaaagaaaataataacttgacaaaaataaataaatagaattttactgatgccgaaaaaaacatgattatggaaaatttaaaacacatacaaaagcctacaggcatttgaatttgccgtcgattgtctaactagtactcaattctgcatttcggacttccgtcaatccctcctctggggtaccatcatctcttcctaggccatgataatggcctcctaacaggcatctcaggcacccatccaatctctctacctggcaccaatctggtctttcaatgctctgcttacataggaagaggaaaattaatacctaaagccactggcaaagaactcaacaacaaaacaatttctccttcagaatatgtcaggctttcgttccgtaaatatcagcgtttcaggtgggtttgctgcctagaaacgtctccgtgacactgtggtttaaaatacgggtgcgtggccgggcgcggtggctcacacctgggatcccagcactttgggaggctgaggcgggcagatcacttggggtcaggagttcgagaccagactggtcaacatgacaaaaccccatctctactaaaaatacaaaaaaaaaaaaaaaaagtttagccgggtgttgtggtgcacacctgtaatcccagctacttgggaggctgaggcagaagaatcacttcaacccgggaggcggaggttgcagtgagccgagttcaacccactgcaatccagcctgggcaacagagtgagactccatctcaaaaaaaatgaaataaaaaataaaatacggacacactgcactccagcttggttgacagagcgagactctgtctccaaaaaaataataatattagtagggctgggtgcagtggctcacacctgtagtcccagcactttgggaggccaaggcgggaggatcagttgagattaggagttcaagagcagcctggccaacatggtgaaaccccgtctctactaaaaatacaaaaaatagctggccatcggggcaggtgcctgtaatcccatgtactcgggaggctgaggcaggagaatcgcttgaacccaggaggcagaggttgcagtgagccgacatcacaacactgcactccagtctgggtgacacagcaagagtttacctcaaagtaataataataataataaaataggaataaacgtaattactcgcagtagctcactaacgatgaattatcagcatccagggcccctgcgcgtggctgctgcattcaccacggcgcaggaattctcacgcagcttccccgccaggcgagtccctagcacggctcggattcatctggagcacaggtcaccacctgcctgcacagaagcactgtcccctctgctcttgcaaaagataccttccccaacgatgctgttgtcaccaagaatttgctcagagctgcaagccattatcctaagagaaccagcacagaaacagaaaaccaaatactgcatgttctgacttacacctggaaggtacacagcgggtactcatggacacaaagatgggaagagcagaaactcttgactgctagaaggtagggggagggaggcaggggatgaaaaaccacctgttgggtacagtggccatttcctgggtgacaggttcactcacagccccaccctcagtctctaatgtgtattcctctattccgtatgccccttcaatgccagaagcatacccagagcttagtgcccacttacaagtgagaacgtgtatttgcttttctgttcttgagtgactccacgtagaataataacctccagttctatccaagttactgccaatgacacgattccactctttttaatggcttagtagtattccattccattttctttatccagtactccacggaggggtacttaggttgattccgtatgtttgcaattgtgagttgtgctgcaagaaacagacaggtgcaggtattttgttttgtattgttttgtttgattattttattttattgatttatttatttttgagatggagtcttgctctgtcacccaggctggagtgcagtggtgcgatctcggctcactgcaacctccacctcctgggttcaagcaattctggggtttctccatgttgcccaggctgctctcgaactcctgacctcaggtgatctgcccgccttggtctcccaaagtgctgggatgacaggcgtgagccaccatgcctggcctgcaggtgtctttttgatataaggacttcttttcctttgggtagatacccaggagtgggattgctggatcgaacaaatgatctgcttttagttctttgagaggaacatccgtgctgttttctatacagcttgtatgaattcactttctttcggggcacaggaatgtaggcagttctgcctggggggtctcctgtggggctgcagctggggctgactttatctgaaggcttgaccaggttggatgtccaggatagctttctctggtgtcaagaagctggtacagcctgtcacctgggcttagctgggagggccaacaagaacaggtacctggggcctctccagcatgtcaggctgaaggtgctcagtctttttaaaccaaagctggctcctcccagactcagcattcccaagaaccaagcaggggccacgtgaccttattgacccaactttggaagtcacacagtgtttacaccactgtggcattctacaaaagaattaacgagaaagttaatgagcatggccgagattcaagggaaggggcgtagactctagctcccaaggagacgagtgtcaaaagaatttgcaggcctgctttagagccccctgaagctgcctttcaaaaccatgcatgcataagccaggtgttcatgataagctcgtctctcctaagctgggaatttatgacacttcaggcacggattgagctgtgtgtctccagattcttcacatcaaataaaatatgaggaaaatggcatcgtgaaaaagatgtttatagttcatcaaaatgcaaagcttcccgtccacccacagcaacctattctggtgtttttgtttttttgttgttggtttttttttgtttttgagacaaaaatcaacttaggttgattccgtatgtttgcagttgtgagttgtgctgcaagaaacagacaggtgcaggtatgtttttttgtttcgttttgtctcactctttcgcccaggctggagtgcagtggtgtgatctcggctcactgcaacctctgcctcccaggttcaagcgattctcctgcctcagcttcccgagtagctgggattacaggcatgcaccaccacgcccggctaattttgtatttttagtagagacaaggtttctccatgttggccaagctggtctcgaactcctgacctgaactgatctgcccgcttcgccctctgaaagtgctgggaggattacaggcatgacccaccgggccgggctttttttctggataactcctgaggtgaattctgacatacttctcagaagtgttttgttagatgggctttgaggactgtaggagtgttgaatgtttaatacacatgtgtcttgtgactgattgatactggaccctgattgatattggatccctcccagttggtttatactcctgatgttttacaggcataagctcagggaataaattctctgtatcctggaagtttttttgaaagctagatattcacgtaggagggggaagcactgagtctggctggaaagtgtgtgcaggtgagaagcaaggactgcacctgaacagtctgctcatttctccctgaggatttcagcaggccacaggcctggaatggcatggtggtgcctctcccctgccaccattctctgtgagagtgtgtccagaatttattccttcttgtgggttcttggtctcgctgacttcaagaatgaagccgcagaccctcacggtgagtgttagggcttttaaagatggtgcgtcccgagtttgttccttcagatgttcagatgtgcctggagttttttccttctggtgggttcgcagactcgctgacttcaggagtgaagctgcggaccttggcagtgagtcttacagctcatacaggtagtgtagacccaaagagtgagcagcagcaagatttatggtgaagagtgaaacaacaaagtttccacaacgtggaaggggacacaagctggctcaggtggccagcttttattcccttatttggccccgcccacatcctgctgactggtccattttacagagtgctgattggtccattttacagagtgctgattggtccattttacagagtgctgattggtccattttatagagcattgattggtccattttacagagcactgattggtccattttacagactgctgaatggtccattttagagtgctgattggtgcctttacaattctttagctagacaaaaggtctccgggtctccactcgacccaggaagtccaggtggcttcacgtctcaaaagcagcagatctccatccacgtttattttttatttcccccttgctgtacccaaagcactacaaccgcactgtggaggctacagccagaataagacgttggtttttcctcaaggacctcacaattgtcaagcctccactggggccagggacgtgtagagccgcgggacccactgctgagtcttctgtgggccctccgcgcaatggggcatccagtgcggcctgtgcatccacagttttgaaaggcgggttggagaggctgtaaaacaggcctgcaaattcttttcacacttgtctcttcgggagctggagtccctgctccgtctcttgaatctcggctgtcctcattaactgtctcgtaattcctagaatggggcagtggtgacaactctgtaggagttccaaagttgggtcgataaggccacgtggctcctgcttggttctttgggaatgctgagccggcgaggagccagctttggttttgagtgttcataaagtacaactggaaagactgtgtacacaaacacaggcaggtacacaaatgcacacgcatcaaaaatttatagggaaatgggtccatgtaccgaggcacaaataacatacagatattacagtacacacagaagcaagcacatatacaaatgcatgtacctcaaaaaatgtatacacctacggatacacctctacatatacaaacacatagagaaatgctagacctacatatatgtatagatagctccatataagatacacacaaacacaagcacgtgtacaaatgcatatgcatagaaaaagatgtacgctatgcagatgtacatatacatacacaaatacatacagaaacgctagacctatagatatatacatatctccatataaaatacacacacggccgggtgcagtgtctcacgcctgtaatcccagcacttagggaggccgaggtgggcggatcccctgaggtcaggagtttgagagcagcctggccaacatggcaaaaccccgtctctactgaaaatacagaaaaatttagccacgtgtggtggtgggtgcctgtaatcccagctactcgggaggctaaggcaggaaaattgcttgaacctgggaggcggaggttgcagtgaggcgagactgcctcattgcactccagcctggacgacaagagcgaaactcctcctcaaaaaataaataaatacatacatataaaatacacacacacatacaagcacataaacaaatgcatgtacctaggaaaatgtattcatgtacagatacacgtatacatatacaaataagtagagaaatgctaggcctatatatgtgtagatatctccatataaaatacacacaaatacaagcacatatacaaatacatgtacatataaaaaatgtgtgcacttgcagatgcatgtatacatgtacaaatacacagagaaatgctagacctctatatatttgtgtgtagatataaaatacatacacactaatacaagcatatatacaaatgcatatgcataggaaaatatgtacacatgcagatatacatatacaaatatgtagacaaatgctagacctacatatatgtatagatagctccatataaaatacacacaaacacatatacaaatgcatatgcatagaaagatatgtacacatgcagatgcaaacacatatatatacaaatacagaaatagatctacaaatatcaatatagctccatattgaaatacatctttgaacacaaacgtgtccatatgcaaatggataggtgtgtgtgtgtattaatcatacacctcaaatgcatttgcaaatgcaaacgtgcacaaatgcaaaagctatgggattccacagatgaatcaaaatgcatattcatgcgtgcaatacacgtagatgttccaatgtacaaataatgacaaatgctgtgtgtttgtaggtgtatgaacacatgcaaatacttgcgattgtacaattccaaatagaaacatataatatatacatacactgtatgcagatacacatgcaaagatgtaaatgtgtatggacatgtatatacatgtgaataaatgtgtacacatgcaaactcatgcacatgtgcatacaacacatatgtaaaagaaaatatgcacaaatttataggcatttgaaaatgaatctgcatgtaaagacgtgaacacatatgtacatgctaacatatatctctataggcatatatctttgaattatgcatacatgcagttatatacccaagtgtatagctatataaacacatttacaaatgcgtatgcatatatgtatatgaatagacgtgcctgtatttgcgttacgtgtagatagatacagaattccaggtacatatataacatgcctatgtatacacatctacattatccatgtacatacaaatacatatctacattggcattaatatccaagcaaactggtctgctctaagtacaaggcagtatggttcgtgcgtgtttctaggacaagtcacctttgagatcaggcctccacagcaaggacttcagggcaggcgctcagccgggcttggcctgacaggggtgggctgttctgtgtctggtagatagaacatgtcaagcacagaacctgcggtgatgatgatgtctatagaatgatgaccgacagggctgccctgtggtctaggggtgaggacaggccatgtttatactgaggtcggcatttctcaaaggacatctgagcagtttgtttgtgggatactcagtgaagagggggtgccatagcagctatacttgtccagaattctggggggagacaggatctctgttgcccaggctggggtgcagtagcacaatctcggctcactgcaacctccacctcttgggctcaaacaatcctcccgcctcaacctccccgagtagctgggactacaggcacgcaccaccacacccactaattttttgtatttttggtaaagatggagtttcactgtggtgcacagcctggtctcgaactcctgacgtcaagcagtctgccctactcacctacccaaaggctgggattacatgtatgagccatcacacctagccgcccagaataattaattgtccaggggactctgtttggtgacttggatgattctcactctcttgtgtgtgttgctgtgttatcattgtggttattatttttcttttccttttttttttttttgagatggagtctcgctctgtcaccaggctggagtgcagtggcatgatctcagctcactgcaacctccgcctcccaggttcaagcaattctcctgcctcagcctcctgagtagctggaactacaggaccctgccaccaaacctggctaatttttgtatttttactagagacaagggtttcaccatgttgggcaggctggtcttgaagtcctgacctcagatgatccacccgccttggcctcccaaagtgctgggatgacaggcatgaacttctgacctcaggtgatccacccgcctcagcctcccaaagtgctgggatgacaggcgtgagccaccgcgcccggcctgtggttattatttttaaactcaaggcacagaggtgcagagacagaaggcaggaagggacttcagtgatcttctagaatcttctccatcacacctaaagcaggaaacagaggcccaggaggaagacatggccgccagctctacaccccaccctccgatgtcctgggccatttgcgcatctggggaatccatctgtgagatttctccactgtcttccccagtctaactccttctgatattctcttttgtccagctggggtgatgatggtccctcagaggaaaaccagagatggattcgaagaacatttcggcctgaactacctagggcacttcctgctgaccaaccttctcttggatacgctgaaagagtctgggtcccctggccacagtgcgagggtggtcaccgtctcctctgccacccattacgtcgctgagctgaacatggatgaccttcagagcaggtaggtgcaccctgtgaataatcataacagcatctcaggtgggttaaaggttattcatctccctctgtctgtgcggtgtggcgctccctgcatctgctggacgctggtgctctgggaacagtgctccctgcgtctgccgagcactggtgctttggggacagtgctccctgcatctgccggacactggtgctctggggacagtgctccctgcatctgccgagcactggtgctctggggacagtgctccctgcgtctgccgagcactggtgctctgggaacagtgcttcctgcgtctgccgagcactggtgctctgggaacagtgctccctgcatctgctgtacactggtgctctggggacagtgctccctgcatctgccgagcactggtgctctggggacagtgctccctgtgtctgccgagcattggtgctctggggacggtgctccctgtgtctgctgtacaccggtgctctgaggacagtgctccctgcgtctgctggacaccggtgctctggggacagtgctccctgcgtctgccaagcactggtgctctggggacagtgctccctgcatctgctgtacactggtgctctgggtacagtgctccctgtgtctgccgtacactggtgctctgggtacagtgctccctgcgtctgccgagcactggtgctctggggacagtgctccctgcgtctgctgtacactggtgctctgggaacagtgcttcctgcgtctgccgagcactggtgctctgggaacagtgctccctgcatctgctgtacactggtgctctggggacagtgctccctgcatctgccgagcactggtgctctggggacagtgctccctgtgtccgccgagcattggtgctctggggacggtgctccctgtgtctgctgtacactggtgctctgaggacagtgctccctgcgtctgctggacaccggtgctctggggacagtgctccctgcgtctgccaagcactggtgctctggggacaatgctccctgcatctgctatacactggtgctctggggacagtgctccctgcgtctgccgagcactggtgctctgggtacagtgctccctgcgtctgctgtacactggtgctctgggtacagtgctccctgcgtctgctgtacactggtgctctggggacagtgctccctgcatctgctgagcactggtgctctggggacagtgctccctgcatctgctggacactggtgctctggggacagtgctccctgcttctgctggacactggtgctctggggacagtgctccctgcgtctgctggacactggtgctctggggacagtgctccctgcgtctgctgtacactggtgctctggggacagtgctccctgcgtctgctgagcactggtgctctggggacagtgctccctgcgtctgctgagcactggtgctctggggacagtgctccctgcgtctgctgagcactggtgctctggggacagtgctccctgcgtctgctgagcactggtgctctggggacagtgctccctgcgtctgctgagcactggtgctctggggacagtgctccctgcgtctgctggacactggtgctctggggacagtgctccctgcgtctgctgagcactggtgctctggggacagtgctccctgcgtctgctggatactggtgctctggggacagtgctccctgtgtctgctggacactggtgctctggggacagtgctccctgcgtctgctgagcactggtgcttcctgcatctgctgggcacaggtgctctggctacggtgctccctggagtctgctgggcatgggtgctctgggcacagtgcccccgcatttgctgcacattggtgcccggcatagtgctccctgcatctgctgggcatgggtgctctgagaacggtgctccttgcatctcctgagcattgtgctctgggcacggtgctccctgtgtctgctgagcacaggtgctctgggcacggtactccctgtgtctgctgggcacaggtgttctgggcacactgctctctgtgtctactgggcgcacgtgccctggaaatggtgctccctggatctgctgggcacagatgttctgggcacgatgctccctgcatctgctgggcatggtcctctgggaacagtgctccctgcatctggtgggcactggtgctctgggcattgtgctctctgcgtctgctgagcacaggtgctctgggcacagtgctccctgagtctgctggacacaggtgctctgggcacggtgctctctgcgtctgctgagcacaggtgctctgggcacagtgctccctgagtctgctggacacaggtgctctgggcatggtgctccctgcatctgctgggtagaggtgctctgggcacagtgctccctgagtctgctggacacaggtgctctgggcacggtgctccctgagtctgctgggtagaggtgctctgggcacggtgctccctgcttctgctgggtagcggtgctctgggcacactgctacctgtatctgctgggcacatgtgctctggaaatggtgctgcctgcatctgccgggcacaggtgctcctggcgctgtgttgtgggatatgtacatccccagccatttgctgtccttgggcaacttagcaatgtgcgatggtattgttactttattttttagaaggaacaagaaacacagaggtgagacatagaaaaggaaaacggatctatttaaaccttctcttgtgcccccatgggaatgtcaggcactgcatctgcaggtggcattggtgtggactcctgtcgacacgcaatgtactgtctgtccatcagcaggtctctcttgtgaattcctcctaaccccgccttaaggataaaaacgattcctctgtgggaataatcatcttagtttgtttaagctgatataagaaaaaatccagcagtccgggtgtggtggctcacgcctgtcatcccagcactttgggaggctgaggcaggtagatcacgaggtcaggagatcgagaccatcctgaccaacatggtgaaaccccatctctattaaaaatacaaaattagccaggcgtggtggtggacgcctgtaatcccagctactcgggaggctgaggcaggagaatcgcttgaacccgggaggcggaggttgtggtgagccaagatcacgccactgcactccagccggagtaacaacagcaaaattccgtctcaaaaaaaaaaaaaaaaaagaaagaaaaattccatagtttgggtggcttataaataacacacatttatgtctcacggttctggaggctggaagtccaagatcaaagtgtgccagcgtctggcgagaacccgcttcctggttcacacatggcaccttctcactgtgtcatcaagcagtggaaggggcaagggagctctctggggtcccctttataaaggcactgattccatacttgagtctcccccatcgtgacctcatcacctcccaagggcctcacctcctaacaccatctcacgggggatgaggatttccatgtaggaatttggagacagacacagtcagagcacacagtcggactcgcctttgaatttctctgcagccctaagatcacaaagcgttaatgccacactcggaaagaactggctgcttggctgtgccagcatcagactttggggccagcctctgtaatgtacagcagggtgggcgccctccccacccccaggccctggagtaccctcaggactacgaggagggtgagcccaggggcacaggccctgccagctcctaacagtttgcatttccctgcacagcgaggggcaggatgtaacgaagggagggccgtgggggcctcctaggataccttggcccatctgttttgtcgaattgagctcctgtgtctgtgagcctctctgctctgaagggtgtgggatgagggagtcggcctcgatgggatcctgcatgaagtgtgaaccctgccggttgtgggagggaaggagcgaggctggccaggacttcatcttctccgggcagctgaagaagcaccgggctgtgcagggaagggcgggtgagaggaatgcagggagagcagggcctgtggccgggaggggctgcttctccttcatggtgccctgaggaagcaagggcatgtgtgcgtgcctgtgtgtacagctgagatgtgtgtgccaatgtgcacaggtgaggtgtgtaccagtatgcacaggtgaggtgcatgcgtgcccatatgcacaggtgagttgtgtgtacctgtgggcacagatgaggtctttgtgcccgtgggcacacatgagatgtgcatgcctgtgtacacaggtgaggtgcgtgccagtgtgcacagataaggtgcgtgagtgctcgtgtgcacaggtgagtcatgtgcgtgccagtgtgcgcaggtgacgtgtgtatgctggctggggcatttcctgttttcacacccatgcatgacagcacccagaggaagacatgcgtgtttctcaggcttcttctcagctcagggctcactgcaggattgtgtaggcctcctgcctcgggctccatgctgaagggtttgcctggacccactggcaagaacagccctgccatgactggcttccctaactccaggcctgaggctgggctgggtgtgtgggggccagccttccctgatgcccactcggggctccacacacggagcctgctgtatgagagggcctgggagaagggaggagggaacgaggagtcttggcacagccagcagcacttgctgcagacacgactcactgagcaaggcaaggcatgggttggggaacctggggaatgtgagctgcttggcaggcattaccgctcgccaaagacacacaggaacaccccttcctcgtacagcactggtggagggccgcctgtctgttattctgagagctcactttggggttgatactgttgatcaaagcaatctctgttgtatttactcattttttttttcagatggagtctcactctgtctcccaggctggagtgcagtggtgtgatctcggctcactgcaacctccgcctcccgggttcaagcaattctcttgcctcgactcccaagcagctgggactacaggcacccgccaccacgtccagttgatttttgtatttttagtagagacaggattttgccacgttggccaggctggtctcgaactcctgacctcaggtaatcctcccatgtcggcctcccaaagtgcgtggattacaggcatgagccaccgtgcccagccacgatctctgttttgaataatgaagataagcagatcacatccagaacaaccccacccaacagaaatgacagctacttcctagagactttaggtgctacagagcagattcatgcgcttaataagaattgagcctcattatcacctaagaaagctgaggaagcatatattaccaagtgcaattaacaagagagtttttattcctataaaaacacatattaaagaaaggctttgacggtattgcttatatgccattaactattattttattttattttttgaaagagacaaatgtcactctgttgcccaggctggagtgcagtggtgctatcttggctcacggcaacctccgcctcccgggttccaatgattctcccacctcagcctcccgagtagctgggattacaggcatgcaccaccacacccagctaatttttgtatttttagtagaaacagggcttcaccatgttggccaggctgtaatcaaactcctgacctcaagtgatctgcctgccttgacctcacaaagtgctgggattacaggcatgagccaccacacccgaccaccattaactcttatctgaagagttatgtccacatcctaactccaaatatgtataattgagacctaatttagaaataggtctttgcagatggaattaagtgaagatgagatgattagggtagacccttgatccaatatgatgggtggccttacaagaagtagaaaatacctgggcacactggctcatgcctgtcatcccagcactttgggaggccaaggtgagcagatcacctgaggtcaggagttcaagaccagcctgaccaatatgatgaaaccctgtctctactaaaaatacaaaaaattagccgggcgtggtgctgcgcgtctgtaatcccaggtactcgggaggctgaggcaggagaattccttgaacctgggaggtggaggttgcagtgagctgagatcgtgccattgcactccagcctgggcaacaagagcgaaactctgtctcaaaaaaaaaaaaaaaatgaagtagaaaatttggagacagagagacacagagaaggccacatggagatggagatggaggtggagactggagtgatgcggccacacacccagggatgcctggagcccccaggagctgggagaggcaggaaggaccctcccctccaccctcacagataccccagagtaacattcaatcaaacatctaggtgccccatgatccagtcaggttaacacataatattaactattccgaccccactctacatataagaagggccctaaatggaatgacaggtgttcttggaaagagacagaagaggagacacagacacagaggagaaggccacgtggagatggaggcagagactggagtgatgcagccacagggtcagggatgcccggagcccccaggagctgggagaggcaggaagggccctcccctagagcctctggagggaactggatacaattgtagtggattgaatggtggttcacagaaagatctgtccacatcccgaagcccagaacctagaatgagactttatttgaaaataaagaactttgccggtgtaattagttagagatctagagatgagatcatcctggagtagggtaggtcctaaatccactgaccggtatccttctaaaagacagaagaggagacacagacacagaggagaagtccacgtggagacggaggcagagactggagtgatctgaccacggggtcagggactccccgagcccccagaagctgggaaaggcaggaagggttcctgccctagaagaccgtccagagagagcacgaccctgtccactcctgaatttcagacttctggtctccagaaggtatcacttcactggatgaatttctgtgactttgaagcatccagtctgtgctcatttgtttggacaatcccaggaaagtaatacagattgcaaagcagatcaaggaacttcaaagtcaaagggcttgagagccagagccagctcagagccggctctaacattttttgtttatttatttgtattgtattgtttttattttaatttattgtatatatctatatctatatatatatctatatatctatatatatatctatatatatctatatctatctatatatctatatctatatatatctatatctatctatatatctatatctatatctatatatctatctatatattttttttttgagacagagtcttgctctgtcgcccaggctgcaatgcagtggtgcgatctcggctcactgcaacctctacctcctgggttcaagcgattctcctgcctcagcctcctgagtagctgggattacaggcatgcgccatcacgcccagataatttttatatttttagtagagacgggggttcaccatgttggccaggatgatctccatctcctgacctcgtgatcctctcgcctcggcctcccaaagtgctgggattacaggcgtgagccactgcgcccggccacttccccctattttttcgagacttacaattcaacttacactgcttttcttttcctgttctcctcttttgcttcaccagtttgattatgtaaaatgaatattgatgacaggcattcacctgagccatgtttcatttctccatgattcctctgcaggggataatgagagagtgttaacagatgcctcctctgagctttctggaaactgttcttcgttgacggcactgactctttccaaataggcccctttttcatcgttcatagcttaggagtgatctcttaaaggagagaacattgctttgctggggctgccataataaaataccacggacctagtggcttaaacagcagacattgagcctcccacagtcctggaggctggaggtcccagatcaaggtgtgggtgtggctgactcctcctgaggcctctctccttgggttgtagacaccgtcttctccctgtgtcctcacaggatcatccctctgtgtgtgtctgtgtcctcatctcctcctcttatgaggtgtcttagcccatttcaggctgctatcacagaataccatagactgggtagattataaacaacagacattattctctcacagtcctggacgctagaagtttgagatccaggtatgggcagggctggttcctcctgaggcctctctgctggacttgtagacgccatcttctctctgtgtcctcacagggtcgtccctttgtgtgtgtgtgtgtcctcatctcctcttcttatgcaatgccttactccatctcaggctgctatcacagaataccatagactgtgtagcttataacagcagacattgattctcccacagtcctggaggctggaggtctgagatcaaggtgtgagcagggctggttcctcctcaggcctctctcctgggcttggagatgtcatcatcgccctgtgtcctcacttggttgtccctctgtgtgtgtctgtgtcctcatctcctcttcttataaggacctcagtcctattggatcagtacctaccctagtgacctcattttacctgaatcgcatctttaaagaccccatctccggccgggcatggtggctcatgcctgtaatcccagcactttgggaggctgaggcaggtggatcacctgaggtcaggagttcaagaccagcctggacaacacggtgaaaccccgtctctacttaaaaaatacaaaattagccaagcgccatggcaggtgcctataaccccagctactggggaggctgaggcaggagaatcgcttgaacccgggaggcggaggttgcagtgagccaagattgcaccattgcactccagccttggtgacaagaccgaaactctgtctcaaaaaataaataaaataaaaggaccctatctccaaataaggtcatctttctgagttcctcagagttagaacttcataggaatctggggagacgtaattcagtccatgagatacgcccaggtccccttggtagaatagaacacgcctcagccggcgtcttctgtattactgtaggagcccctagatgaccagatggtggtaggacagccaggtattcccagtcaggtgcagttgcctggatgtgtgttccccgaattattgtgcattgggccatctggccgacgaacttcagcttccgtggttagctccgtctccatctccctgatttttctgttcttgtgtcatccctgcgtcacatatgactgaagttcagtaaatatatggtgagtgggccgggcatggtggctcacgcctgtcatcccagcacttcgggaggccgaggcaggtggatcacaaggtcaggagttcaagaccagcctggccaacatggagaaaccccatctctactaaaaatacaaaaattagctgggcgtgggggtgcacacctgtaatccctgctactcggaaggctgaggcaggataattgcttcaactgggactcgaaaggcagaggttgcagtgagccaagatcgcaccactgcactccagcctgggctgcaaagcaagattctgtcttaaaaaagaaaaagaaaaaagaaatgaagatgctcccattctcagaccatcctccagatctcctaaacccgaagtttggagaacaggggttggcaaggagaaggtctttgggggaattctgatgcatgctaaaatatgagaaccacttgaatttaaaatatactgctttttttttttggatgaaagatgtggttcttggcttttgcctgatataatcattgccagtaattagtgttaattgccaagattgatttactggcttggaaaattagcgttcttgtaaaggaataaatcacagtgttgtaacatattccaaaaatccaagagtttttacacatgagagaacatgtctcctcaacttggctgtaccgaatcatccccatggtgaaataaatttcaatagaaagcactttgggaggccgaggcgggcgtatcacctgaggtcaggagttcgagaccagcctggtcaacatggggaaaccccgtctctactaaaaatgcaaaagttagccaggcatggtggcatgtgcctgtaatctcagctgctttggaggctgaagcaggagaattgtttgaacccgggaggtggaggttgcagtgggccaagatcatgctactgcactccagcccagcttgcactccagagcaagactccctctcaaaaaaagaaaaaaaagggcaggcacagtggcttaagtctgtcatcccagcactttgggaggctgagaggggtggatcgcaaggtcaggagatcaagaccatcctggccaacatggtgaaaccccgtctctactaaaatataaaaaattagccaggcatggtggcatgtccctgtagtcccagctactggggaggctgaggcaggagaattgcttgaaccggggaggtggaggttgcaatgagccaagatcgcaccactgcactccagcctggagagaaaaaaaaaaaaaaaagagggacacataccttccaaaatcattttctattctttaagatttctttcctgtgagacccttaaatttgttttgttttattttattttatttgagacagagtttcgcttttgtcacccaggcatcgaggctggagtgcagtggcgcaatctcagctcactacaacctctgcctcgtgggttcaagtgattctcctgtctcagcctcccgggtagctgggactacaggcaccgccaccatgcccacctaatttttgtgttttttttttgtagagctgggttttcaccatgttggtcaggctggtctcgaactcctgacctcgaatgatctgcccacttcgacttcccaatgtgctgggattacaggtgtgacccaccgtgcctggccatgatagattctctacctatttaagaaattctttatttcactctgacgtccctcagtcatggagttgttataggcatgggcgtgcctcactgtgaacatggctgtcttggtttgagtttctcaacttatgtaactttgggtgacttcttcattattttattcctaaccatgaattcacatcccgtgaaatcatccagtatagactaagttgtgtaacgtgttttgagtgtggtatcccatctcgattcggatttcactcaaggtttcacatgttccccctgtgttctgagatatgtcggacagctgacacactcactatgtgtctatgagcgaaagtatcagggtgtttggatgcagctggaattcacaagatacctgcaatgtcctgtgttgttttggttgttttctcttagcggaaaaagtcaaagacctctctttgagatcgacaccatccaggccaatgtggtaaaaacccgtctctactaaaaatacaaaaattagctgggtgtggtgacgggtgactgtagtcccagctactcaggaggctgaggcaggagaatcacttgaacccgggaggtggaagttgcagcaagccaagatcatagcactgcactccagcccggcctgggcaacagagcaagactccctctcaaaaaaaaaaaaagaaaaaaaagggggggggcgtggggcaggcacagtggctcacacctgtaatcccaccactatgggaggcctagggggtggatcacaaggtcaggagatcaagaccatcctggccaatgtggtgaaaccccactgtgctaaaaataccaaaattagctgagtgtggtggcgggcacctgtagtcccagctactcggaaggctaagacaggagaatcacttgaatccgggaggcggagattgcagtgagccgagatcgcaccactgcactccaccctagcaacagagcgagaccctgtttcaaaaaaacaaacaaacaaaaaaaacctctctttattcgcagtattttctgagttcctggtaggcggatcgttatcaagaatattaaatgtagatgatagttatcaagaatattaagcgtagatatcctagaaagaatgtaatggagttgtttgtactgccaaagggaaaattcaatttagacatgaaggattgttataatacttataaatatattgaatgccacccatacttactcattaaaacagtgattgtcatcaggtttaatgagcactggaaaaatagctccagtcaactaggttatgagcagtcgattgagtttccctaattgcattggcaatttgattatgcaacaatgtcctgcaatggaaatacgttgcaatgcaacggattcgtaggaagttaacataaaaactcagttgtccttgcttctacacaagtacctctcaaagtggataaataatcaatgcaaaaactgcctgttgatccatataaaaggacaccgcctacggagactggctgttgggagaccgagatatgacacgtttacatcctacagtatccatcacaataacttataaagggctcctttctttttgtttttttttgagacagagtcttgctttgttgcccaggctggagtgcagggtgtgatctcagctcactgcaagctccgccttccgggttcacgccattctcctgcctcaacctcccgagtagctgggactacaggcgtctgccaccacacccggctaatttttttgtatttttattagagacggggtttcaccctgttagccaggatggtctcgatattctgacctcgtgatccgcccgcctcggcctcccaaagtgctgggattacaggcgtgagccaccgcgcccggtcttataaacactcaaaagtatgttcagtcttcacgatttttaataacaagaagagagtaatgctttaatcagcaaaaaatggagaactcaaatacccttttataaggtccagatttagtagcaggtggcttttgttcagtttcttattcaacaggaaagctcattgaatgattttttgtttcattttgttttttggcagtctccctgtctcacccagactggagtgcagtggcgccatctttgctgattggctcacggccatgtccgcctcccaggctggagtgtggtggcgccatcttggctcactgccatgtccacctcccaggctgcagtgcggccgcgacatcttggctcacggccatgtccgcctcctaggctggagtgccgtggcgccatcttggctcacggccatgtccgcctcccaggctgcagtgcggccacgccatcttggctcaaggccatgtccacctcccaggctgcagtgccgtggcgccatcttggctcacgaccacgtccgcctcctaggctggagtgccgtggcgccatcttggctcaaggccatgtccgcctcccaggccgtgcagtggcgccatcttggctcactgccatatctgcctcccaggccgtgcagtgacgctatcttggcttgctgccatgtgcgcctcccaggctcaaatgatctgctcccacctcagcctcacaattagctgggactacaggtgtgctttaccacacccaggtactttttgtattttttgtagagataaggtcttactatactccccagtctggtcttgaactcctgggctcaagcgacctgcctgccttagtgtcccctaagtgctcagattacatgcgcgagccaccactcccggcctaataccaacgacttttgtcagagtccttagggtttcatttacagaccttaatgggcatttcctcctacgtatttgctttcattctttcccatttctggggtggatatttcttcatccctaacccccaccccagggaatctctcctgaaactacgtgcccctcttggattcatttcttcacctcctgtagagaaatgtattggcttttcgcctgcccccacaccgtatttttaaacaatcttagttctctcttctccacgctactgtgtaaaaccataattacagaaccaacccctccatttactctggaaaaatctgcctttggatgatgcattttctgctttttcaagtaaccattcctcttacccatcaatcaaatgctggagattcagaaccgaatgcttgtagctgatatttaaaaaacgatcatgccagcaggaaagccagtctttgcctctctgcacttagtaactatctgtttcctggactcttctcttcccctggggtgaggagattggagaagtttgccttaaaaagatatcttgacagtaattggaggtttacagtttatcttggatcagagatgggacttcagctctgaactactcaatttccctgtcttaattcttccagtctcttagatttctttttatttatttatttttgagacagagttttgctcttgtcacccaggctggagtgcaatggcgtggtatcagctcactgcaacctctacctcccgggttcaaggattctcctgcctcagcctcccgagtagctgggattacaggcacctgccaccacgccctgctaatttttgtatttttagtagagacggggtttcaccatgttggccaggctagtctcgaactcctggcctcaggtgatccacccacctcagcctcccaaagtgctgggattacagacataagccaccatacccagccaattcttccaatctctttattatgcagtcagcctttccagtcccctcctaccccaccccaacccccaaaaagttatgttttgattgttcattattttgcaaagtctccatggctaaggacccccttgtcaccctttctgtcctgcccttatttatttctaaggcagcagacctgaggtttcttttccagcagaaatcgggtaaacctcaggtctgtttgaaatgcttgttccccagtgccataaagaaatagcacttgaacattaatttcctcagcaaggccattttttttactttctgcagaaagggtacactctccagcagttttgccaggagagtacagcgaacaaaggggacagggtcatttatcacttgatgcgtccgccctactgctgtgtccagtttccagggctggaatgggacctcacattctgtatttgtcccgattggccagcaccttggaactatttaaaagaggcaaaggcagaggagaacaaaggaaggaggaagtaacttgtggaatgctgagaaaggaaaaagcacttttagataaagaagaggaacaggctgtgacgtaatgcttgcttggaccagtataagcatgccagggctgatacttaggttaaattgtgggagctaagagcataaagtacattgatttctttatcacggctagcagatatttaggaatgttagcacaagtctttgaatgaagtttgcttctcagagaagttactatttattcctaattagatggggaggaaagtctttgaacaggaacctttattttttacaggcccgatgtcagattttggcatgtggctttctgctacccatggctgcgtgatgagacagtggctggaggcagaactgagcccctggaggtgttaatgggggagtcacttgtcctcatgcaagcattcaaacatgccttttgcacaacggcaaggcacatctcagaacatgtcagctgcaggctgcgatttcccgggtacgagctttccaagctctgtgatccactctgtctttggttacatgaaggtgggaaaattgctcagttgctaagatcacagtgttggggctcagaaaacaatcccctaaatttttcagaggcattagaaccagagcaactctgccatcttgaataggggctgcgtaacatgaggctgagacctgcttgggctgccttctctggaggtggatgaggcattctaagtcacaggatgacagaggaggtcagcacaagacacaggtcacaaaggccctgctgataaaccaggttgtggtaaagccagccaaatcccaccgaaaccaagatggtgacgactgacctctggtcatcctctctggtcatgatacgctaattctaatgcattagctgataagagacggtttacagatgccatgacatggtctaaaagggggatgaaccttcagctccgggaattggtcacccctgtcccagaaaactcatgagtaatccacccgttgtttagcatatgatagagaaataaccataaaaataggccaccagcagctctcgggatgctccatctatggagtacacattctttattcttctactttcataataaacttgctttcactttactctatggacccactcggagttctttctcacgagatccaagaaccctttcaaacccctgaaaggatcaggtgatccgcccacctctgcctcccaaagttctgctgggattacagatgtgagccactgcacccagccagaaaagactttttgaatcaatgcttaattttttttttttttttttttgagatggagtctcactctgttgcccaggctggagtgcagtggcgtgatctcggctcactgcaatcttcacctcccgggttcaagcgattctcctgcctcagcacccaagtagctgggattacaggcatgcgccaccactcctggctaactttttgtatttttaatagagacggggtttcaccgtgttagccaggatggtctcgatctcctgacctcgtgatctgccagccttggcctcccaaagtcctgggattacagacgtgagccaccatgcctggcccaaggtttatttttttaagatcaatttcaagtagtgatgttactaaaagatattcataggccaggtgcgttggctcacgcttgtaatcccagcactttgggaggccaaggcgggcggttcacttgaagtcaggagttcgagactggcctggccaacacagtgacaccccatctctactgcaaatacaaaaattagctgggcgtgatggtaggcgcctgtagtcccagctacttgggaggctgaggcaggagaatcacttgaacccgggaggtggaggtcgcagtgagctgagattgcgccaccgcactccagcctgggctacagagcgagactctgtctcaaaaaaaaaaaaaaaaaaaaaaaaaaaaggcacaaaaagggctgagcgtggtggctcacatcacgtctgtcattccagcactttgggaggccgaggtgggcagatcacgaggtcaggagatcgagaccatcctggctaacacggtgaaaccccgtctctactaaaaatacaaaaaaaaaaaaaaagccgggcatggtggcaggtgcctgtagtcccagctactcaggaggttaaggcaggagaatggtgtgaacccaggagggggtggttgcagtgagccaggattgtgccactgtactctagcctgggcgacagaacaagactctgtctcaaaaaaaaaaaaaaaaaaagatttatgattttaaagattgagttgcatgttgtgaagttgctctcccaaaagatgtgcaaatgtatgtgcacgcccttcctttggttgtctggccagttttccccatgttcttcacagtggaaatgatgacagtgtgataggagaacagatggagggtcattccctctgattttgcaagctgaaaaatcaacttgcaaaagcagatgaataggagaaaaggcatacaaagtttactcgatggatacatacagcagccttcagagggaagacccaaagatgcaggggaaaccgtctatttttatgcttaggttcaacgacgtctgaacgaaatccgtgtaggaataggattggaggaagagggtgtgatctaaggctgacggtctgagtggggaaacagacaggcctgtctagatttttttggcctctgagcagtgcgccttccttctgggggtggggtgggaccctctctgggaagggggtcgtagaacctacattcaaacaaggcaggtcaaggaatttccttttccttttcttttctttctttttcttttcttttctttttctttttttttttttgagacagagtcttgctcttgtcgccctggctggagtgcaatggcgcaatcttggctcattgcagcctccaccttctgggttcaagcaattttcctgcctcagcctcccgagtagctgggactacaggtgcccgccaccacacttggctaatgtttgtattttcttttttctttttttttttgagacagagtctcgctctgtcgcccaggctggaatgcagtggcgcaatctccactcactgcaagctccgcctcctgggttcacaccattctcctgcctcagcctcccaagtagctaggactacgggcgcccaccaccacacccagttaattttttgtatttttagtagagaccgggtttcaccgtattagccaagatagtctcgatctcctgaccttgtggtctgcccaccttggcctcccagagtgctgggattacagacgtgagccaccgtgcccggcctaatgtttgtattttcagtagaggtgatgtttccctgtgttgggcaggctggtctcgaactcctgatctcaagtgatccacctgccttggcctcccaaagtgccgggattatagccgtgagccactgcacgatgataggaaatttctttatggcgagtttttatatactcagggtgtagggaaacttagagtcctatttatagggtttctggctggccttgggggaaaggtgctttggttttcgggacccaccttggggaagaaggattccagtttccgtggtgcccttggggcgaaatgggtctgagagacaggagggtaggagaaggtcagcaagaaaggtttgcttctgatgctgcttctgaggtcttcattttaggttactgttctctgagccccagcataggcatgcattattggttttgttcatttattttatgaaaaaatgaatacatgaatatagagggtatctaattttttttttttttttttttttgtgagacggagtttcactctatcaccaaggctggagtgcagtggcgcaatctcggctcactgcaagctccgcctcccgggttcacgccattctcctgcctcagcttcccgagtagctgggactacaggcgcccgccaccatgcccgggtaattttttgtttttttagtagagacgaggtttcaccatgttagccaggatggtctcgatctcctgacctcgggatctgcccatctcggcctcccaaagtgctgggattagaggtgtgagccactgcacccagccctaattttttttttatagtttcagggtctgctctgtaattgtaatattctacttttcatctgcaaaatatagtgtatattggacattttataacagggagaggaggtttagaaaccaataccagggccatgtacagtggctcacacctgtaatcccagcactttggaaggccaaggtgggtggatcacttggggtcagaagttccagaccagcctggctaacctgatgaaaccccgtctctactaaaaatgcaaaaattatctgggcatggtggtgtatgcctgtaatcccagctactcaggaggctgaggcaggagaattgcttgaacctaggaggcagaggttgcagtgagctgagatggcgccactgcactccagcctgggtgacagagcaagactccttctcaaacaacaacaacaaaaaccaacatcagtctctgttccccagtggtatcatttatgtttatactgttttctttctgtatttctcatttgctttgatctttttggttttcttttatgtgttttccttaggaaagcattttcatttttcttctccagatccttaggtcaaagtttacttcatttatttcaattttctattcttttattttctttctttttctttctttctttctttctttctttctttctttctttctttctctttctttcttttcttttctttttctttctttcttttctttcttttctttctttctctctttctgtctttctttctttctttttttgacagactttcactctgttgcccaggctggagtacaatggcgtgatctcgtgtcactgcaacctccacctcccgggttcaagtgattctcctgcctcagcctcccaagtagttgggtctacaggcacccgccagcacgtccagctaattttttgtatttttagtagagatggggtttcaccatgttaaccaggatggtctcaaactcatgacctggtgatctgcccacctcagcctcccaaagcgctgggattacaggcatgagccaacgcacccagccctcaatattgtattcttatttaggaacagcttttgttggtaagaggcattggattttcagaagctttttctgaaacgcatatgatgacggatgtctttcttttgatcttttgaatgtgttaaacattcttttaggctttttgatcttatctttagttttttagcataaatatcatgctgatattcaaactatatctgagatggctttgtgaaccctgaaaatttgagacaggtctcagttaatttagagtttgttttgccaaatttaaggacgtgagcctgtgacatagcctcagaaagtcctgatgacgtgtgcaacgtggtcaggtcacagcttgttttttttttgtttgtgtgtttttttgtttttttgttttttttgagatggagtctcactctcttgcccaggctggagtgcagtggtacaatctcagctcactgcaccctttgcctcccaggttcaagcaattatcctgcctcagcctccggagtagctgggactacaggcacatgccaccatgcctggctaattttttaatttttttttttagtagagacagggtttcaccatgttggccagcctggtctcaaactcctgaccttgtgatccgcccgccttggcctcccaaagtgctgagattacaggcatgagccactgcgtctggccatagcttggttttatacattttagggagacaggagacatcaatcaatatatgtaagagctacgttggggtgggtgcggtggctcacgcctgtaatcccagcactttgggaggccgaggcaggcggatcacctgaggtcaggagttcgagaccagcctggccaacatggtgaaaccccatgtctactaaaaatacaaaaaattagccgggcgtggtggcgggcgctggtaatcccagctactcgggaggctgaggcaggagaatggcttgaacccaggaggtagaggttgcagtgagccaagattgtgccactgcactccagcctgggcaatatgagcaaaactctgtctcaaaaaaataagaagtatagtccttgaaaagcagggacaactggaagcagggagggggcttccagctcacaggtaggtgagacacagatggttacattcttttgggtttgtgatgagccttcccaaaggaggtgatcagatatgcatctatctcagtgagcacaggggtgactttgaacagagtgggaggcaggtttgccttcagcaggttccagctggacttttcctttgagcttcccgcttttggggtgcccagatattttctgttcacagcttccatcaggatacatataccatgtggttaattcagaaaattaggccgggcacagtggctcatgcctgtaatcccagcactttgggaggccgaggtgggcagatcacgtggtcaggagatcgagaccatcctagctaacatggtgaaacctcgtctctactaaaaatacaaaaaattagccaggcaggtggcaggcgcctatagtcccagctacttgggaggctgaggcaggagaatgacttgaacccgagaggaggagcttgcagtgagccgagatcacgccactgtactccagctgggttgacagagcaagactctgtctcaaaaataaataaataaaaataaaatttaaaaatatatatatatataaaagaagcaagcgatatgaaccttcagccaccttgaaatgttgttacgataattgtgtagcaaattgatcgcctctgggcatctttggagccccagaggaaagaaaaacattattgctcaaatacttctccttgtcttattgaaaagaactatgaggccaattctaaggctaatgatctgtgcctagcattaaattctaaaaggagtctatggtggttgtgtgccttcaagggacgttatgtaacaccgcaaataacatctctttaaaaagtgtttctaaggcatacatagaaaaagtagaacatatttacaggagcaaagctggaaacatccagttttctgtgtttctggtgattgaggttaccagagagagagagagaggcacgttactcactttaccgcggttatcggatcgatttttatcactatgtcctgtgatactaaaacatttctctaaactgcttgaaccaaggtgcaaagagtttaacatgtgcttagcacactacagagcttgcagtagatgtgaggaaaatttatgatagcttgggaagtttgccaaattgcttgtgtggttgtcttttatgatttgagactcatcaagaagaccacatgtggccaggcgcggtggctcatgcctgtcatcccagcactttgggaggccaaggagggtggatcacccgaggtcaggagttcaagaccagcctggccaacatggtgaaaccctgttcccactaaaaatacaaaaaattagccgggcgtggtgacaggagcctgtaatcccagctactctggaggctgaggcacgagattcgcttgaacccgggaggctgcagcctgggtgacagagtgagaatctgtctcaaaaaaaaaaaaaaaaaaaaaaaaaaaaaaaaaacagggagcatagtggctcctgcctgtaatcccagcactttgggaggctgaagcgggtggataatttgaggtcaggagttcgagagcagcctggccaacatggtaaaacttccatctttgctgaaaatacaaaaaattagcagggtgtggtggcgggcacctgtagtcccagctactggggaggctgaggtaggagaatcacttgaaccgggcaggtggaggttgcagtgagccaagattgcaccactgcactccagcctgggcgacagaggggggactctgtctccaaaataaataaataaataaataaaaaattagtaacataatttaacatatctgaccccaatacaattaagggatgagtttataataaaaaggtgaactagaaaaatccacacgcgttggaaaactggccaacagatggcatgatcacacatgggtctaggggaggtggctgcgtatagacgtggccgtggccgcaggtacagatgctgctgggatgaagcacttaggcgtgaacgccgtcagcctcttacaccttctcctgcttgccccacagtgcctgctactcaccccacgcagcctacgcccagagcaagctggcccttgtcctgttcacctaccacctccagcggctgctggcggctgagggaagccacgtgaccgccaacgtggtggaccccggggtggtcaacacggacgtctacaagcacgtgttctgggccacccgtctggcgaagaagcttctcggctggttgcttttcaaggtaagccccttctgcttctctgattcacggctgcacctgaagatgctacaggaaagggggtccccagtccagaccccaagggagggttcttggatctcgtgcaagaaagaattcaggacggctcagtggtggaaagagaagcaagttattgagaaggtagaggagtaaatgaatggctcctccgcagacaaagcatccccggcggccgctggttggccatttttacggtgatttcttgatgatatgctaaacgagggggggattattcatgcctcccctttttagaccgtagagggtaacttcctgacattgccgtggcatttgtaactgtcctggcgctggtgggaatgtagccgtcacgacagccggaggtcactcttgtcgccattttgctttttgtgggttttggcccgcttctttactgcaagctgttgtatcagcaaggtttttatgacctgtaccttgtagcaacctcttatctcatcctgcgacttagcataccttaaccgcctgggaatgcagcccagcaggtctcagcctcgtgttacccagcccctattcaagatggagtcacgctggttcacacagctctgacacaaccacttccaggctgcgtgtgcggtgttgggggcttggattccgtgatgtatttgtacattctcaccccaaagccttggttgtgtgcgagctcggtgggtgacgctgtgtagctaggtagtgcccataaatgaatcttcttaggagctggagaccgtttggggatgctgtggtaggggccaagggaaaaacatccccctttgccatttgaaggtttgctgaaaaatcaacgcacaaaatacaattgccctttttgaaacatgaataaaggaaatgacaggcaaatgtattctcatccatggaggagaatgtcagaggaattgccccattacacaaaggggtacagacgcttgtgtcctcttcttcttagcggaaggggagtggggaattgggggtgaatataggattccaaatagtaaatgattttaaagagaagtcaatgggtttgaacaatgtacagtggcccgaaaacagataatgttttttgttattgttgtttgtttgcttgttttttttgagacggagtttcgttctgtgttgcccagagtggagtgcagtggcgggacctctgcccagtgcaacctctgcctcctgggttcaagcgattctcctgcctcagcttcccgagtagctgggattacaggcatgtgacaccacgcctggctaattttgtatttttagtagagacggggtttcatcacgctgaccaggctggtcacgaactctggacctcaggtgatccacccgcctcgggctcccaaagtgctgggatgataggtgtgagccactgcgcctggcctcagataatggtttatgacgagtctctgcagggacagaggctgtggaaccctcagaacagacagtggtttatgaggagtctctgcagggctgttgacagacatcagtctttcctccgcgatgtgggttcagaaactcagggaaggggacactggtcatttttccttctttgacatgtccagacttcaggaaacttcagagaacaacttcatcctgtgcatcgggagacacagaggaagcaggagggggaagttagagagatcttgaggcttcttcagttcagcaggacaaagcaccgtactttggggtgttggtttttaagacccagcagctgaaagctcccacatttctgcaatgatcttcgttgtcgtgatgcattaacttcttaagcactgcaagatttcatgccccagccattcccttgggtttttttgtttgtttgtttgagatggagtctagctctatcaccaggctggagtgccgtggtgtgatctcggctcgctgcagcctctgcctcccgggttcaagtgattctcctgcctcagcctcctgagtagctgggattgcaggtgtgcgccaccatgcccggctagtttttgtatttttagtaaagacagggtttcaccatgttggccaagctggtctcgaactcctgacctacctcaagtaatctgcccgcctcggtctcccgaagtgctgggatacagtagtgagccaccgtgcctgtcctccttgaggtcttttgaagtgatatgtatctgggagctatagatttactttctttcctatctatctcaagtcgggatactaaagttttaataatttgtttacaaaacaaagaaagaaccttgagaagcttttctatttctccctttacattgcagaatcgtctaattagcatttttaaaagtgtctgcttttgaaacaccgccacgattcaccttcaaaaccgcatgggttgaggaattttcggaagagcgattctaactcagctttcaaaattccttgggcgtctactgcttgttgaagtttcccacctctttctgagtcagtttagacagcttttccctttaggtaattgtctgtttcatcaagctttggaattaatgagcttggttacaaattctcttttctccctgttggactcctggcattgctcttgatttcgtctgaaagtctctcatgatatgagctgcccgcccccaatgtggactttttgaggggattaattacttcccttattttgcagtttgctttcttatcagttgttcttcgaatctctcattcctcaagcaaaggaatttctttttttctttttctttttctttttttttttgagatagagtctcgctctgtcaccaggctgcagtgcactggcgcgatctcagctcactgcaacctccgcctcctgggttcaagtgattctcctgcctcagcctcctgagtagctgggactgcaggcacctgccatcaagcctggctaagtgttgtgtttttagtagggacggggtttcattatgttgcccaggctggtctcgaactcctgacttcgggtgatccgcccacctcggccttcctaagtgatgggattacaggcgtgagccaccgcgcccagctgtacatcccttattttgcagtttgctttctgatctgttgttcttcacatctctaattcctcaagcaaaggaatttcaaaatattagttattttattaagcactaagtattcgctagcaatacaccaacactaggatacatttcatccttataaaacccccatgaatccctcagagagtgacttcagtatccaaggagagcatttgctgtttttttattttatttaatttatttattttttttgagactgagtcttgctctgttgcccaggctggagtgcgttggcgcgatctcagctcactgcaagctccgcctcccaggttcatgccgttctcctgcctcagcctcccgagtaaatgggaccacaggtgcccgccaccacgtctggctaattttttttttattttttatttttttttagtagagacggggtttcaccatgttggccaggatggtcttgatctcctgacctcgtgatccacctgcctcggcctctcaaagtgttgggattacaggcgtgagccaccacgcccggcctcttttaaattttttagagaccaggtcttgctctgtcaccctggctgctgtgcatttttttttttttttgtagaaacggcatcttgctgttcgcccaggttggtcttgtgcgctggaattatgacacaatcactggctgcaaccttgaaatcctggcctcaagtgattctcccacctctgcctcccaaagtgctgggatgacaggcatgagccaccatggctggccttgacattatttctttctaaatatttaacaagcaaactgcaactttagccacatgaatcattctttaatcctttgatcatcatctgcaaatttggattaaaaataaccacggggcattgctcgagtgatactgcctttatataagagacaacattgtggaaactttaaaattatagagcagaagaatatgcattagcctggaaatgaaattaaaataatgtaagaattttaaagaaaaggctatacagctgcagtagcttgatgctgtctttgtaatgataattctgtattgctgtgtatgtattatttactagtgtgtatgcatgcatgcatgcatgcattgtatattaagacttggaagatcagctgggtgccgtgtctcatgcctgtaatcccagcactttgggaggccaaggtgagtggattacttgaggtcaggagttcgagaccagactgtcaaacatggtgaaacaccatctctattaaaaaaaaaaaaaattagccgagtgtggtggcgcgtgtgtgtcattccagctactcgggaggctgaggcaggggaatcgcttgaacctgggaggcggaggttgcagtaagccgagatggcgccattgcactccagcctgggtgaaaagagtgaaactccgtctcaaaaaaaaaaaaaagaaagaagaaaaaccttgcaggatctgtccagggtccctggggagaatctgtgtgacatacatatctctgtgatgtttcatatcatctgagggcatggttgtatgtcactctgaaacctctatcctctgtctcatcagaacacatggactcgattccaaattcacggccagtaacctgggcgaccagtcggtaccagaagaaaaactaggaggttgattggtttgtttttgagatggggtctcgccctgtcacccaggctggagtgcagtggtacaatcacagctcacagcagcctcgacctgctggactgaaacgatcaccccacctccacctcccgagtagctgggactacacgaatgcaccagcatgcctggctaattttttaaaattttttggtagagccgaggtcttgctatgttgtccagccgggtctccagttcctagccccaagcgatcctcctgctgtggcctcccaaagtgttgggattatgatttgtgcatttataaagatgagaggtttgatttgtcctgtatacaaatgcatcaggccattcttcatgctgagacatgcagatggtctcagcctccgtaggagagtagcttagtatttcagagggcatgtgtgctcttcagacctctaggaagctcctcgcagcttcatcagtgaaactcagtaccccctacaatgtatacccctcctagggagcaaatgaacgtggctattacctctcttcccaccccagttgtctcaagatcaatgggtgttacaaaaaagagctatcggctgggagtggtggctcatgcctgtaatcccaacactttgggaggctgagggggaggatcatgtgaggttaggagttcaagaccagcctaaccaacatggagaaacccagtctctactaaaaatacagaaattagccaggcgtggtggcagtcacctgtaatcccagctactcaggaggctgaggcaggagaatcgcttgaacccgggggcggaaattgtggtgagcccagatcatgccactgcactccagcctggacgacaagagcgaaactccatctcaaaaaaaaaaaaaaatagaaagctattgtaaatgctgagtgtatcagctccaccattcagggctcatgtccagcaagtcctgaccactttgaaatcatgtgatcaggcctgccatcaaaatgaacaaatttgcagtgtagactgcgcccacttcaccatgaagtagaccactcgtatcattgcttgtcttaagcatgtatttgtatccgccatgcagtctaatgaaagtctgtcttagggttgattggaacttggattgatgtgccgagagggtgacaggttaattaatcaaatcaaggatgcaggtactgggaatttttttatttttattttttttaagatggaacctctctctgttgcccaggctggagtgcagtggtgcgatctcggctcactgcaacctccgcctcctgggttcaagcaattcggcctcatcctcctgggtagctgggacctcagctacctcccagcacgcctggctaatttttacattttcagtagagacggggtttcgatatgttactcaggctgatctcgaactcacagtctcgagtgagccgcctgcctcggcctgccgaagtgctgggattacaggcatgagacaccctacccagcccccccatttctttttttttttttattaataaacaaatctaaccaccctctctggaccttctatttcccctggggactgtccctgactacagtctccgctgcagcaaatccccatacaggaattgctcatacaattcacttccagtcccccatgctccactgaaaatgctccaggtggccgggcgcagtggctcacacctgtcatcccagcactttgggaggctgaggcgggtggatcacatgaggccaggagttcgagaccagcctggccaacgtggtgaaaccccgtctctactaaaaatacagaaattagccaggcatggtggcggacgcctgtaatcccagctactcgggaggctgaggcaggagaatcgcttgaacccgggagcaggaggttgcagtgagccgagatcgcgccactgcactccagcctgggtgacaagagtgaaactccatctcaaaaaaagaaaaaataagaagaaattgctccaggtagagccaccagggacttcaccctttccctgcaatgtgcaggcctcagccctggctgtttcctcctccacgcacgcccttcccccaggtatccaatccctctccttcccttcattcaggcctgcgccaaaacctccgaagacagggcttctcctgggcgcttgctttcccctcacaaagctttgtttgtctttatgggtcatctcaccaattggcttatgtatttatcgattcacttatttattataaatttaaggagtacaggtgcggatttatttattttatttatttattttttttctttgagacggagtctcaccctgtcacccaggctggagtacaatggcgcgatctcagctcactgcaacccctgcgtcccaggttcaagcgattctcctgcctcagcctcccgagtagctgggattataggcatgtcccaccacacccagctaatttttatatttttaatagagatggggtttcaccatgttggccgggatggtcttgatctcttgacctcgtgatccgcccgcctcggtctcccaaagtgctgggatgacaggtgtgagccaccgcacccgtcctggcttatgtatttattgatttgcttatttattataaatttaaagagtacaggtgcggatttctttttttgttcccttttttttttttttttcccctgagatgctctgttgcccaggctggagtgtagtggcatgattttggctcactgcaacacctgcctcccgggttcaagccattctcctgcctcagcctcccgagtagctgggattataggcatgtctcaccacacccagctaatttttatatttttaatagaggtggggtttcaccatgttggccgggatggtcttgatctcttgaccttgtgatccgccggcctcggcctcccagagtgctgggatgacaggtgtgagccaccgtacccagcccggcttatgtatttattgattcacttatttattataaatttaaggagtacaggtgcggatttcttgcatggagacattgcacagcggtgaagtcccggcttctagtgaacccctcaccccagctgtgaatactatacctgtaggtgatttttttcatcctccacctcctgccaacctcccacctttcagggtcctcatcgtcaatccaccctctgtgtctgtgtagacccactggtgaactcccacttgcaagtgagaacatggcaggatcagtgtttgactttcagtatctgagttgtttgttaggagaacggcctgcttttcaaactgaagctctgtttccattaaaatacaacttccaatttccctgctgttcctagctcctagcaacaccattctgccttctgtcttgatgaatctgatgactctagggaccttagaaagtggaaacaggctgggcatggtggatcatgcctgtaatcccagcactttgggaggctgaggcgggtggatcacctgaggtcatgagttcaagaccagcctgaccaatatggtgaaaccccgtctctactaaaaatacaaaaattagctcagcatggtggcacacgcctgtagtcccagctactcgggaagctgaggcaggagaatcgcttgaacatgggaggtagagactgcagtaagccgggatcgtgccactgcactccagcctgggcaacagagtgagactccgtctcaaaaaataaaaagtaaaataataaaataaaaagtggaaacgtgcagtgtttgtccatgtcactgcaaaagacatgatttcattctttgatatgactgcataatattccatggtgtgtatatactatactgtactttctttatattagccagtcctctgctgacagacacttaggttgattgcatatctttgctgttctgaatactactgcaaaaaacctaaaacagctgtgtgcgtggatcagggctctgtgcctggaaggcagggaaggaggtactgaatgtgtgtgtgtgggtctagctgtgtgcatggatctgggctgtgtgcatggatcagggctgtgtgcatggatgaaggcagggagggaaatattgaatgcatgtgcatggatcagggctgtgtgcatgggtgaaggcagggagggagatattgaatgcacatgcatggagccagctgtgtgcgtggatcagggctgtgtgcatggatgcaggcagggaggcagctgcagaatgcatgtgtatggagccagctgtgtgcatggatcagggctgtgtgcatgggtgaaggcagggagggagatattgaatgcatgtgcatggatccagctgtgtgcatggatcagggctcatgatagcaaagcagagaaagaagggagatgacgagggaggggtccctggaagaatcaggcagtggctatttcctgcaacagctcccttctcctctccttccctgctatgcctctcatttttctaatttgttaattctggataataatatcacataagagtgttgtgaacattgccgacagaatatatgggaaaccattttctccactgtaaagctctgtgtaattatgtaattatgagccattcattcctctctctgactatattgcttgtggctctatttagtacacttgaaactctatcttctattttgtgtgtgtttcatcttttttttttcctgcacttgtgcctcaccatccacccactgcccatgtctattggaagctcctgggcagcaggggttatttctgaaattctcttcctttgccccaagagctggcaaaatacgggtgagcatttaataaacattcattggactgaatgaagttgaaatggtttctgtagcttgcagctccaacactctccaggactcaagagtggcttgatgcagattttaccataaatggtgctgcaccgtctccccagcgccccccagccgggcgtctggaacttcaaagatgctcttgtgtctgttaaaagggaacacactgcgttcttggatttgggttcacatttatacatcttctgtcctcttgccagtctctaaagattgtcatttaaaaaaaaaaaaaagctgtagataaaacaggatgtgttatttaagccacagggagcatgatttacaggaccgtcttgtgtattcagaagacaactttcatttccctgcacaaggcgtcaccaagcaagcccacttcatcattccgagaatgtgtggaagacagcgtctgtcagccacagctgcacagcggcagataatgaaattctgccgcgaagccacagttccttgctctacacaggaggtcggccagataggaagtgtcttagtcttcgtgggccacctctagtctctttggcatatttctttctttctttctttctttctttttcttaacaacactttaagagtataaaaccattcttagctagtagcctgtacagaaacaggtacaggctgaattttgcccatggtgtatagtttgcagagctgcataagaagctagaatgagtgaggttcccagcgtggtctctgagaccagcagcctctgggagctcgttagaaatgcagattcttgggtcgggcacgatggctcatgcctgtaatctcagcacttttggaggctgacatgggcgaatcatgaggtcaggagttcgagaccagcctggccaacatggtgaaatcctgtctctactaaaaatacaaaaaattagctggatgtagtggcaggcacctgtaatcccagctactcgggaggctgaggcaggagaattgcttgaacttgggaggcggaggttgcagtgagccaagatcatgccactgcactccagccctggcatctcaaataaataaataaataataaaaaataaaaaaaaatgctgattcttgggcctcctaagatccactgagttagaaataccaggggtgcagttgtttttacaagctctctggcccattctcttgagtgctaagcgtgaggaccccagaccccaggactgcaggggattgagccccagctttggggctgtggacaaaagaagatagttctcggtaattccatatgaatgctctatatgaatcctaaaggaagttctgttgctttagttgttgttgttttcaaaacaagtggatacaagttcattcaggaatcccccagcctcacacaagtgaacaagagtgatttcgattcagaggaagacttttagaaacagaagggtgtagtgtgaaggttgtctagtttttttttaggaaaagctggattatactgtaaattgataatagagggggcagagagagaggaggagaaagaggaaggggaagaggaggaagggaagggagagagagaaaaaggaagatgaggaaaaggagaaaaaataaaaggaggaagacagagggatagaaagagaaaaaggaggagaaggaagaaggaggagaagatgaaggaggaggaaaaagggaggaatagagaaaaggaaagaagggcagaaagaaaagagaaggaggagagaagaggaagagaaagatagaggaaaagaagaagataagagaaagaggaggaggaggaagaagttggagaagatggaggaggaagaagagggagaaaatgagaaagaggagaaagaaaggaagaggaagggagagagagggatagagagaaaaacaggaggaggataaggcagaaaggaggaagaggacgaggtggaggaggaagaagagaagatggaggagaaaaaaagaggaatagagagtgaaaaggcaagaagagaaaagaggagaaagaaaaaaagaagaaaaggcagagagagaagagaaagggagaaagagatgggaaaggagaataagggaaaaaagaaaaaggaggatacgatggaggaggaagaagagagaaaaaggaagaggaagggatagaagaataggaggaggataagggggaaagagaaggagaaggaagaaatgaaagaggaggaggataagatgggggaggaagagaaagaggaatagagagagaaaaagagaaaaaggaagaggaagcaaaggaggaaggagaagggtgtgagagagagggagggaaagagggaggttctctcaggctcagaggtgatgccacccagatcagtttgaggtacacattggaaatgccacagaagttacagaactgggaagggccgttttgtccaaggagatgccatctctcctttccacagggtatgtctgtgatggactctctggtggctctaacagactccccaggaacaaagacatcataggctctgaggctgccaccctaaaaagaagtgtcctctttggatgggaaacttcttcccttgagtggataaatgccctcctttggtttagccttaaaagccagccagcagtctctgtgcttttgattgaaggtctctgtgcgagaccttccagtgactcaagctaagagatgagccaagatcattcctggagcccggcatttcttcctggtttcagaatgcccagactctctgccattgagaccgttcaattttgtattagtcgcagttctcaagaaaaacaggaccaataggatctatgcatagagaaagatttagtttaattgactcttgggattgtaggggcgggcaagtccaaaattggtaggctggctggcaggctggagacctggccaagatttgacattgcagccttgagcctaaaatctgcagggcaggctggacactcaggcaggattgccctgtcacagtctggagtggaattccttttctagtaagtgtcagtgtttgctgtgaaggccttctcctgatgaggtgaggcccacccacattgtgaagcgtcctctccttcgcttaaatgcaactgatttgtaaatgttaatgatatccacaaactacccagtctggtgcttgaccaaatgtctgggcaccatagcccagccaattgatacgtgaactcaatcatcacagagcccacttaagacctgtgttacctgacattaaacagcacaagccatctcctctctgttgtctgtcaggtgagtgtttattcctggtaagagcaggtttgtgtgtgtgtcttacgagattgtagttaaaggaaggttttcttaatcctctctgcttcaggtggtcactgaggccatgaaacatccctagaagtttagcacaacccacagctctcattggggagttgagagcacgtgtgtgcacgtacacatgtgcacactcatgcacacatacatgcacacatgtacaaatacacacatatagatgcaaacacatgcgcgcacctgcacccctcccacacatgcatagtatgtgcacacatgctcacgtgcataaatgcacacacaccttcacatgcatagacacacatgcacatatacacgtgcaaacccatgcacacagacatgcgtatatccacacatctgtgcccacatgcatgtgtgcacatatgcatgagcaaacacacatgcacacatttatgcaaatgtatattcctatcgacacatgcacatattcacatgtgcattcatgcacatgcatgtacgtacatgtactcacacatatccatatacatacagacatgcacatacactcatacaatacacatccctcaagtacacattcacatgcatgcatacatatacacatgtgcaaacacacgcaggcccatacccgcacatctgcgcccccacacacatgcatgcacatatatttatccaaacacatgcatgaatacacacacgtacccattaacgtgtgcattcatgcacgtgcacatacatatacatatacatacagacatgcacatacaatcatacaatacacatctacccacaagtacacacacatccacataaatgcgtacctatgcatatctgtgcacacacacacatgcacacattatgtcaccctatgatttgcgtgtgagtcagcatcccagaaaacatccagccccgaaacctattttccagaacattccagaaggagcaagcagcaggtacagagaggcaagaggcaggggacatcgtggcagaagcagcaggatccctgggtggctggagcagaggtatggagaggaagtgttgcctttgtagaatgttcagaacattcttccaggaaggcagctgagcctgggcagaagtctctgaatttctctttgaccacagcattactccgtcccctcttccacaactttggggcgtggaaactctccttgggaagctcagctaggagtctctttacttgccagccacttccctgagtgtgagtttctgccctaagatgtggacggtgctaaaataaatacatgtgccctcagatctctctcagcacaactcaaggatctactaacagcgtctgcattcaaatagcaacatttccagaaggcgaacgagcctctgcgtgccttgcagagagctgagcgtttgccgcccaagccctgctagcctcctccctaggagacatcccgggtgatgccattcctgctgccctctgctcctggcagtggagcgttaggtagtttccttgcagacagcacaggggatccgtcccaaggacaaagggaagccctgtgtgtgtctcttctgcaaagcccagcatgtctaatacaagttaagtgtggagttcagagggaacagctttctgaagctctttgaagagtcacaggcaaatatctctgtgtgccctgggtgctatctggagaacaggagctctaacaaaaaggaaatcgtggtttgaatgacacaaaagggatttgctatttcaaattcacaatatctgccttatcttagaaatcagaattctcagagtcaccacagatatttggtcaaataggggcagaaccagaattggtaaatgcagcaaaggctctgaggaataaattcctccctcccttccttcctcttatcttctcttttttcctccagtccttccttttgcctcccttttttccttccttcctcccttccttccttccttcctccctccctccctccctccctcccttccctccctccctccctcccttccttcctccctccctccctccctcccttcctccctccctcccttcattcctccctccctccctcccttccttcctccctccctccctcccttcctccctccctccctccctcccttcctccctccctcccttcctccctccctccctcccttccctccctccctccctcccttcctccctccctctctccctccctctctccctccctctctccctccctccctccctcccttccccccttcccccctccctccctcccttcccccctccctccctccctccctcccttccctccctccctccctcccttccctccctccctcccttcctccctccttccctccctcccttcccctctcccttcctccctccctccctccctcccttccccccttcctccctccctccctccctccctccctcccttccctccctccctccctcccttccctccctccctccctcccttccctccctccctcccttcctccctccctcccttcctccctccctcccttccctccctccctccctccctccctccctccctctctccctccctccctccctccctctctccctccctctctccctccctctctccctccctccctccctcccttccctccctcccttcccccctcccttcccccctccctccctcccttccttcctccttcccatccttccctccctccctccctcccatccttccttctctttggttctttgtttctcttctttttttttctttctgtctcttttccttccttcctcctttccttctttgcttcctgcctcccttccttctttgcttccttcctgtttttttttcttttttcatccttcccttcctcccttcttccctcctttctcccttttttcttcctccctcctttcttctctgcttcctttctctctccttccttccctcttttctgtcttgttctctgcttccttcctttcttactgcctccctccctctctctctgtgtcactccttccttccctcccattatgcttccttctttccttccttaattcctttctctatttcctcctttcttcttcctctttttctttctccttctctttcttccttccattgattttttttgtttctctgtctttctccttccctttcactcaacccttcactgacctttgaatacccaaaacaaaggtgctttgacccaggccatagctgatgacactgagttgttcccagcaggtgcaggattctgtgcagacacgtctgtcccctcccttcctgcccggttctcagcactgcctggcatgtacagatgtgggtgcagggctggctggggtgcaggtgcagggtgctccagctgcaccttccggaaagacatttcatggagttaggaggaaaaggggctgcctccggagggaaaactgaggtattcattgtcagcaggaggaaggctgactcgaacccttcttattctgcagcagctctgagacaggtcccagagcttcccctctaacaaaagcgactctgagaacgatgagttgctttgctgttttccctacctgtcacattctctgtgctgccctaacacgagaaaccgtgcccatggtctgggtgttttcttttttttctttcttttttttttgagatggcatctcgctctgtcgcccaggctggagtgcagtggcgccatctcggctcactgcaagccccgcctcccgggttcacgccattctcctgcctcccgagtagctgggactacaggcgctcgccaccatgcccggctaattttttgtgttttttagtagagacggggtttcactgtgttagccaggatggtcttgatctcctgacctcgcgatccgcctgcctcggcctcccaaagtgctggggtgacaggcgtgagctaccgcgcctgtgttttctttggggaaaaagatcacaaagggctgggccagtccaaggtctgctttgcagaacgtggcattagagagacaaatgctggcaggaacccttggtgttcttgaacagtcccatgaacacagagggctctgtttgcaatagagctgtggggcagactgaatgagccaggtaaccaacaggagattgaaatgacttgggaggggaactcgagtaattgctcatgctcctgaagtctctcccctccctgactcttgaggtagcaggtaagtgtgggtataattgcctgtttcctggaaaagaggctttcttgacatatgcacacagcagcctgcgccaatcccagtcaggagagaagtcacctgggcttggtctccatctgccggggttgccagcctgacgtcccatagactgggcagcttagacaacagacactgattttcccaccgtcctggaggctggaagtccaagatgaaggtgtgggctgggcgggctcctcccgaggcctctctccttgggttgtagatgctgtcttctcactgtgtcctcacagggtcgtccctctgtgcatgtctgttttctcctcatctcctcttcttatgagctgtctcagtccatttcaggctgctatcacagaataccatagactgggtggcttataaacaacagacgttgactctcccacagtcctggaggctggaagtctgacatcaaggtgtgggcagggctggttcctcctgaggtctctctcctgggcttggagacgccgtcttttccctgtgtcctcacagggttgtccctctgtgtgtgtctgtgtcctcatctccttttcttatgacatgtcttagtccagttctggctgctgtcacagaataccatagactgggtggcttagaaacgacatacattgattctcccacagtcctggaggctggaggtctaagatcaaggtgtgggcagggctggttcctcctgaggcctctctccttggtttcatattttgcaatattaggataaataatctgtgcatgtgtatgagtgtgtgcatgcaaatgaatatataagcatgtttgcatgtgtataagtatgcatgtgaatgagtatgtgaatgtacacgtggatgagcatgtgtgcatgtgaatgagtgtgagcatgtgtgcatgtgtatgtgcgtacttgtgaatgagggtgcgtgcatgtgtatgtgtgcatgtgaatgtgtgtacatgtgaaagtgcatgtgtgtgagctgtgtgcatgtgaatgagtgtgagcatgtgtgactgcatgtgaatgtgtgtacatgtgaatgtgcatgcaaatgtgtgcatgtgtgagctgtgtgcgtgtgtgagtgcatgtgaatgtgtgtacatgtgaatgagtgcatgtgaatgagtgtgtgcatgtgtgtgagctgtgtgcatgtgaatgagtgagcatgtgagtgcatgtgaatatgtaaatgtgaatgcatgtgtgaatgtgagctgtgtgcatgtgaatgagtgtgagcatgtgtgtgtgcatgtgaattagtgtgcatgtgaatgtgagcatgtgtgtgagctgtgtacatgtgaatgagtgcatgtgaatgtgtgtgtacgtgtgtgtgtgcgagtgtgagcatgtgtgcgtgtgagctgtgtgcatgcgaatttgtgtgcatgtgaatgagtatatgtgagcatgtgttcatgtgagtttgtgtacatgtaaatgagcatgtgtgcatgtgaatgagtgtgagtatgcatgtgcaagtaagtgtgcatgtgtgtgtgcgtatgcatgagtatgtgtgtgtccatatgtgtatatatatttgtgtgcatgtgagtacatacgaatgtatgtgtgcatgtcagcatgtaagtgaccatgcgcacatgaatatgtgtgtgcgtgtgtttttcttacagaaaaaaaatcatccaatagaacttcatcacgtcgtcatctctgtgtccccagaaatacctacattttcagcacaatgcgcttgctgtcttctagaaatcacaagctcattttcaacatagcacaggtggtatcttgccccctaaaacggtagtacttgtgtcgcaattgaatatgcatagcccaagaactcttactcagataagaggatttttcaaaatatggtagaaacagaagcccccagacactgcccacaggggaaccacaaagaggaagcctccttccagagagtgctgagtttgttcaacaatagggacgatgcaggagaacccaggagcggcctaagctgcagctgcagaacacaggggcctctccgggtggaggcatcatactacatggtcaagacacaggtcgggtatttggggcatgagcccctgaatcctcagtgtcaatgatggcagacaacaacacaaaacttgttccaggagctgatttaaggatttgtttgcaaagaaggcacagcactaaatataacacagtgtgggtgaacatctcaggcaccagcgtgaggtgtaaatgctcatttctgcgcagcaggaaccatggtctctcctggggacccagggtggcccccatctggcctctctgatcactttgtccagagcagcagtgtgggaaggggcaccatgttggattcacagctgcagtgcttggtgtccctgccttttatatggaagtgggctgggccccagaaagactccgtattttccagctacaagatgatggagaaggaagaagaatgccggctttgggagcagatcctgcctggaaattgggcagaacacagccgcaaaagagagaagcatgaaacagatcaataaaacctctttctgcgttgaaggctgccccagagaaagaccctcaaacaccatgggtgccttcacttggcccctgccttccctctccctttcctcctgctctgttctgtccttcctcccttcctctttccatccctttcgcctttacttttggtctttagatgcccagggcaagacacgggacacagggctcccctgcaagagccaagccatggcgcctgcatccgcccccgagatgttttcagatacagtctctctattagtctgttctcatgctgctaataaagacatgcccaagactgggtgatttatagaggaaagaggcttaatggactcagttccatgtggctggggaggcctgacaatcatggcggaaggtgaaggaggagcaaaggcatgtcttacatggcagcaggcaagagagtgtgtgcaggggagcggccttttataaaaccatcagatgtcatgggacttattcattatcatgagaacagcacgagaaagatctcccatgattcaattacctcccactggctccctcccttgacacatgggaattatgggagctacagttcaagatgaaatttgggtggggacacagccaaaccgtatcagcctccaaatctcccaggacactttgggtttgcaagatctctgggcacccctaggtgatttccagacttgggaagttctctagctccatccatttctttttaggcagcagaagagcagaggcaagtcagtgggaaacaatctcaggagtctggcagctctgttcctctactggggtccagccttcctgttccccttgctcggcacccagaggatgggctggtgggcacactggattgtctaccatgcctttccacgtcacactggctgctgaagtcaagaccaggaggcagtgaactgacagcagcagaatttctgaagtgactgggtgtcacaggccaccccacagagtccacccttttcctttttggagggtgtgtgcctgaactctcaccagtgctaggttttgccatgtggcccacactcatcttgaactcctggactcaagcagtcctcctgccttgttctcccaaagcactgggattacaggcctgagccactgcagtgctaggggcactggtgagaggtgaaatcagttcgggcaaatggatcatcactcccagaagactagaggggacataacaaaggcaatatctggtctttattcctggttctgtaacaaggaggagcttctaaaactctcgcaatttcacaaatgctagcaattccctggttgtataatgaggtgatatttgctgtttcctaaatggcttcaagatggggctggccaccagaaacaccaaccatgtcattaggaggttggaatttcaggccagcctgacctctggggaggaaagaggaactggaggttgaatctgattatgtggccaatgacttaatcatacctatgcaatgagaccccagtaaaaactctggacatcaaatgtcttagtctgtttgtgttgctatcacaaaacaacataggctgggcaaccggtaaacatttgttgctcacagttctggaggctggaagttcaagatcaatgcatggcagattctgtgtctggaagggacctgctttctggttcacagacggtgcctcattactgtgtccccacatggtggatacgttcaccagattcccagaagcttattacaagagacaacttctgaaacatcttcattgtgacagaagttaagatgcactgtgttggttcctggattattgcatcctagctctgaaggttctcaggtcccacaacttctaattcctctgagaatcctacatttcttccatcccactgaccatgaccaagggccaactcccactgcagaaaaccagggtgtgctgtgtttcaagattatcgccttccactagggtaaaatccccagtctttgaaaaacctttttctgcatctcaagttcctttttgaaacgtctgtttccatgaaacatacgatcacagctcataaatgcctcaattctccgatgtagcatgccttgctgaattgaaaacaagaatctttttgatgtcctgatgtttcatctaattgctaaatattgtttattaaatacagaagccaagcactcactcatctgcttctagtcaattaataagcatttcggtcccataaagagtgcgtgattaaatacgtacatcagggattttaatatgcatctgcctagtgagatggattaacccaccactgaaatgcaacccacttgggtacgttattgtcagtgcctgttgtaaagaaacccaacagcagaaaagctgtggttcagattgatcacccaacctcgctttttgcatacatttctcagtgcagctgatgagtatattccacctgtccctgcagcatccatgtgagtcctgagactcctgtttcctgctcagaaatttgactcatcgtagccttcttttcttcttccaccagacccccgatgaaggagcgtggacttccatctacgcagcagtcaccccagagctggaaggagttggtggccattacctatacaacgagaaagagaccaagtccctccacgtcacctacaaccagaaactgcagcagcagctgtggtctaagagttgtgagatgactggggtccttgatgtgaccctgtgatatcctgtctcaggatagctgctgccccaagaaacacattgcacctgccaatagcttgtgggtctgtgaagactgcggtgtttgagtttctcacacccacctgcccacagggctctgtcctctagttttgagacagctgcctcaacctctgcagaacttcaagaagccaaataaacattttggaggataatcaccccaagtggtcttcaaccataaactttgtgattccaaagtgcccagttgtcacaggtgccataaataattacattttccaacataaatgtgccattttccttgccgcgttaatacaactgagtacaaaagttccaagagagatgctctcttttcaggggctgcaatgtcctctctgagacctagtggtggatgaggtctcctgtttgattttgttcctgcactcactcatttttccagagacccagctgtgattcacaggtgtcagacatggggaggtgtgagccttgcttgctacagcctgtaggatgagtttgacgtggccagcagcaccatctggtcaacctcattccagaatggcacagtcacaagtgaagcatgccactgtcaaatccgagaatgtaaaccgctgaacagctatggatcaaatggtagccctcaaaagatatgttcatgccctaaccctcagaacctataaatattactttatttggaaaagaatctttgcagatagaattaagaattttgagatgggtcattatggatcatcccagtgaacctaatgccatcacgagggttcttatcagagacaggtagagggagatttgagtacagaagacaagatattcgtgtgatgatgcagacagagactggagtgatgccaccacaagccaagcaatgcctggagccaccaggagctgggacaggcaggaaggattctcccttatacccctcagagcaatcttggcccctctgacgtcttgactttagacttctggtccccagaacggagagagaataaatctttcttgttttaaggctccaacaaattggtagtcacttgttacagcaaccacaggaaatgtatacagcttctgatacttctgaaaacctcacacagccaaagggtacatccttggtatagaggctcactcttactcaccagccaggcaaggaaggctcaatcctttggtgttagagagatagatgttgggttttcaaatttcaacatagagaaatcagtcatttgcaatgcttttgagaaagtactgtgtataccctacgagcctgcactccttatgtgtgagactgatgaccattggttggcttattatccattccactaagtgacaaaatcccactgactattcaaatccaggctcctggcatgcctgtaccttagaatcacaaccagctgcaattccaggatggagttcaaactaattgtgggggcatgtgcttcttacatgactgctagattgttcccagatggggaaggttgccctgataagcaacttaaatgaaaataataaatgtattgtttggcctctt

SEQ ID NO: 2892 - DNA, 233880 bp, human
gtgcgcgctgggacctccccgccccgcgctttccgtccccgccggctcttctgcgcgcctggcccggcccgacccggcccgacccttccctccccgcgcgtgtggcctccccgcctgtcccgggtcgggctccaaccaagcagcccccgtgcagccgcccccccgcgcaccctgacacctccgggccatggccggggacccgggggctcgcacgccccgcgcccaagacatcaggcggctctgcctgccgcctgcggtcggccagtgaccgcgcgcccccgccaggccccggaggggaggagcgggcgtcccagggacctcgacccctacccaccccagggtaagtgaggatgggcccttctccggaggacgtctccagagggggcccagaggcggcttctcgggcactggggagccacggaggtctggtggggagggcaggcccgttaagtggcaactttgtttccttggcctttgtaaacatctctgagtcacagatctccaactttgcaggactcgttcactgtctgaactcatcagtgatgaccgccactgtgttttgtgtatgcagataacttctgttcctagatttgcaggttcagaatttattattattattattttttgtaataggaagtagagatgaagtcttgctctgttgccgaggctactctcgaactcctgggctcaagcagtcctcctgcctcagcctcccaaagtgctggcattacaggcaccagctactgcatccgactaatgttttaaagttttgtagacggggtcttgctatgttgctcaggctggtctcgaactcctgggctcaagcgatcttccttcctttgcctcccaaactgttgggattacaggtgtgagccaccacacctgtctaatgttttaatttttttgtgtagcaatagggtcttgctacgttgcccaggctggtctgaaactcatgggccgaagcaatcctcctacctgggtcccccaaagtgctgggtttacaggcgtgagccaccacgcctggctaatgttttaaattttttgtagagatggcatctcaccatgttgcccaggctggtcttgaacccctggcctgcagcaatcctccagtctgggcctcccaaactgctgggattacagacagagcgccactgtgcccagcccatattctcaatttaaacctagaaacctgtaaacaattatttgtgaactggaataaagggaatgttaattccatgttaggttaaatgatactttgtttcaaaaataacagttttccaaaacagagcgttcagagggtcagtgtggtgggggtgggggtgtacgttgccctgaatgtcttaaatgtccagcctaagaagagagctgttatttctgcctctgtagacagtttcatggcatgtcaggaggcctctggaagacactactgcacgcctctgggagactgggagtcagccaggcgaagcgcttgggtgccttattgtgaaatgacttttgacttccactctgcacccactgaaggaatcccaggggtcccagcgccaccctttgagaagcgtgcctggagtggatgttttaaaatgagcctctctctcccgcctctagccagagaaaaagagctttgagttttctgtgagctaagcttttctttttctgccaaactggccttcagtatttttttttaaacccacttagcataattacaaatgcatagaagaaggagagtaaagggaactgtagtcaggctttcggagggcaggagagcatgtttgtttgaagtaagtaatcagttgcaaggtgaacggtttacagctgctgaacaattgtgtggagtctcgcagaagattatgtttatccgggcagttttgcttacagaaaggtccccttaaacctccttaagggcctgtgtgggccctggcagaagaggccggggttcctgcagcagctcaccaaaatgctggcctttgaaaaacttgctctttgtgcattagaaaaagggctggaatcttttttttttttttttttcccatttactgattaaacaacaacagaaggttgttaaagaggacgagcttctggtgaagtcacgtgtctgccaagggaatctgtacccgggtgtgtatcgaaacagaatggccttctctaaagattaacttaagtggcttgccctcatcgagccccttcctatgtatggattaaaaataattttcgataccagtggaggaatgctgttgtccttggtctgctggtggccagcttcctaaacggcattttttatttgcttctctctggtaggccttcgctgttggtgaggaaacattgaactttgtccagggcatttgagctaagctgtttgaataaccaagagggccaatttccccactgcagattggaagcaagggcagttttttcttagaacttccaaatggagcgtgttcttcttaggtatcgtacaaaggaaatgcctgggttacaccttccacatgagttgacttacatggtatgagaaggaagaaattgtggctggaatccactcctaaatggtgtcttcttacagttcatcatggaaaaacaagataattacaaattaatcatagatgttggtcatgcctttacagagggggtttagaagcaaattgagaattcccataagagggtctgtctctgtgttcttaagactatatccatgcggcccattcagtaagttgtatctgttggttggattttaaaatagatgatttaatcagtgcatttaatatcctaatatggcatcaaaacttgaacattgatatggcctgaaatctgttgaaaatgatcatattgagtaaagaaagtctctacccaccggtattaataacagggtgatctgtttagaaattacattttctctgatacatcaatgagttttgcaaaggagagaaaattgatggtacctgtagtcaagtccagttccaatactgccacagaatttttcttaaaagttctattgtaaataataggccacagaatattccttcactttctgggatgcaaaatggattcgtaaatgctgtaccacaggagtgagtatttacaaaaaatatgccaactggcccacttacaaagctatttatagaagtcctacttttcaaactattttttttttaacctgtaaagggaaagttaattcttgttggttttatgagtagtgaacagtggctattagaaatcaggtagaagtaaaaacagcagttttccaacttcttcttctttttcttgagaccaagtttcgcttttgtttcccaggctggagtgcaatggcgtgatctcagctcaccacaacctctgcctcccgggttcaagcgattctcctgcctcagcctcccgagtagctgggattacaggcatgtgccaccatgcctggctcattttgtatttttagtgagatggggtttctccatgttggtcaggctggtctcaaactcctgacctcaggtgatagtccaccttggcatcccaaattgctgggattacaggggtgagcccctgcccccggcctccaattccttgatcatagaatctctttcaaaaaaaatgaggaccccagacagtttttgtttttgtggattataacagtcaataagtcatcctgttagacattaaaacagaaatttaaaacatatttaacaatctatttaaaagtaatggtaacaggccaattacatgttacatacaaaaatgtatgtaatatatttattgtttttatattttatttttattaaatatatatatttttagaataatttatacttttctataaatataaaatacaaataagttatatttatataatttagatgtaaataaaaacaattgatatttttatataaatatataaatgtgtacacttatggggcacagtgtgatgctttgctgtatgtttgcattgtggaataattaaactaatatctatcacccgctatttttcctttgcggtgggaacatttaaaatctcttttagctatttttgttttttatttccataggttattggggaacaggtggtgtttgattccatgagtaagttttttagtggtgatttgtgagattctggtgcacccatcacccaagcagtatacactgcacgcaagacatttaaaatctctattggcgggccgggtgcggtggctcatgcctataatcccagcactttgggaggctgaggcgggtggattgcctgagctcaggagtttgagaccagtctgggcaatacagtggaaccccatctctactaaaatacaaaaaattagctgggtgtggcagtgtgcgcctgtagtcccagctacttgggaggctgaggcaggagaatggtgtgaacctgggaggtggaggttgcagtcagccaagattgcgccactgcactcaagcctgggcaacagggcgagactccgtctcaaaaaaaccaaaaaaacaaaaaaacaaaaacaaaaataaaaacctcttttagctattttgaaatatgtaatacactattaactatcgccaccacgctgtgcagtaggtcactgaaacggattcctcctgtcgaacagaaacttggtaccctttggccatgtgctgtatgttttttaaaagaaaaatgattgtcatttccaaaataacaaaaacctagggagaagagtggctgagttttagggttttgtcagtctcatccataaagggacggatggcggctggctccttcctctgcttcttcacactggtctcttgcgacgtgtcgttctggtaagagtcatgtgaggcacatccactggcctctcatggatgtgcaattggaaacgtgaaatcgccggccccctgagagcgttttggggagtgtcccccccaaacccccctccccccgcactggggatgctgcaccagtcttgaagaatgaggcagtgagaggctggtttacagcaacctttattcgtggccttgtgtgctcggaagcgctgcaagggaggaggaaggaggaaggagggtactcactgcagaaggtcagctctgctgtggctgttacgtgggttcaggtggaacccacctactgtgtggacggttctttacctgggaatcccatggaattctgacagcaggagacgtgggagggagcttcttgtttctccttccaggagtcacttggttaggggtttgggaattttggctcttagtacaaaacttcactccaggtactagacctgtttcagccaaatgatgatcatcataatagaatagaaacctttgttcacctaaataataacaataatattaataataatagaatataaacctttgttcatggtactggggcgtctttcagcccaataataataacaacaataggaataatgataataatgataaaatataaacctttgcttcacgtcctggaacgtctttcagccaaataataataataatattaatgataatagaatataaacctttgttcagggtactgtgacttctttcagcccagtaataataataataatagtaataatgataataatgatagaatataaacctttgcttcatctcctggaacgtctttcagccaaataataacaataataataataatgacaatagaatataaacctttgttcagggtactgtgacctctttcagcccagtaataataataacagtagtaataatgataataatgatagaatataaacctttgctccaggtcctgggagctctttcagccaaataagaataataatagaatataaacctttgttcacagtaccaggacctctttcagaccaacaataatgacagtaataataattataatgataatagaatataaacttttcttctaggtactgggacctctttcaaccaaataataatagtggaatataaaacttggctctaggtaccagaaccttttttcagccaaatagtaataataagaatagtattaatagaaaacagacctttggtccaggtactgggacacctgtgagccaaataataataataatgataataatagaacataaacctttgactgaagtgccagaacctttttcagctaaataataataataaaatataaacttttgttccaggtacccggacttctttcagcctaataataatcatagaatataaacctttactacaggtcctggcacctttctcagccaaatagtaataaaatagaatataaacttttgttctgttactgggacctctttcagcctaataacaaaagtaataataatagaataaaaacctttgctccaggttctagaacctctttcagcctaataataataataatgatagaatgaaaatttttgttccaggtgtcgagacctcttccagcctaataataataataatgtaataatataagcctttgctacaggtaccaggacctgtttcagccaaataataataacagcaatgataatagaatataaaccttggccccaggcactgggacttctttcagtcaaacaatcacaataataataataataatagaatatggatgtttgctccagctttcaggacctctttcagacagataataataaccgagtacaaacttttcttccaggtatcgggacctcttccagcctaaaaacaatagtaataatagcatatatatctttttttttgttttcttctttctttgagacggagttttgcgcttgttgcccaggctacagtgcaatggcgccatctcggctcactgcaacctctgcttcccgggttcaaacgattctcgtgcctcagcctcccgagtagctgggactacaggcatgtgccactaccacgcccggctaattttgtatttttagtagaggaggggtttcaccatgttgtccagggtggtctcaaactcctgacctcagatgatccacccaccttggcctcccaaagtgctgagagtacaggcgtgagccgctgtgcctggtgccagcataaaaatctttgctacaggtactgagacctttttcagcctaataataataacaaccgtaacaataataattagaatataaacctttgttactggtactgggacctcttccagcctaatcttcataataataaaaataataataataatggaattgaaacctttccttcaggttccagaaccgctttcagccacataataataataataatgataataataataataaatagaatttaaacttttgtttgaggactgggacctctttcagcccaatagcacaaataataataatggaatgtaaaccttttcctcccaattaccaaaacctgtttcagccaaataataatatgatgatgatgatgatggaggatctgatacagctgtgtcctgtcactcaggtcggacttaggaggcctcttgagattcttttccccctccgttgactgtgtaatccaggggccccaccctaactcggctgcagaagatgcagtttgggggttcctcgttttgtggaagtcccggtcatgttattcattctctcagcaccttagaacaaaccagggtgctggcattggccacaggacccccctccttgcaccccagtcttgggaagtggcactgctgggctctggcaatgcccagctcacctggcacgtggcggcgtctccctaaaaagcactgggcgggcaccgttgacggaaagccagcaacgcaggccgcgactgcccgtgaagacggggggcctttctaagacctccactcattatttcgggcaaaattaaccttcagaataccttgctttaataaagtaccagaaaccggagggcttaaaaccatagcttattctctcccagttctggaggccagaagtctgtaatcaaagtgtctcagggctgcgctccctccggaggcttacgcggagggtgcttcctgcctctcccagctcctgggggctcctggcgtccctgggcttcaggccagccacatcatcactctagtctctgcctctgtctccatgtggccttctctgtgtctgtgtctcctcttctgtcttttataaggacatctgtcactgcatttagggctcactcaaatcccggatgatctcatctccagatccttaactcatgagatctacaaaatttctaataaccaagtaagatctcattccacatcctgggctttaggctgtggacagatctttctgcgggccactgttcaatccaccatgattttatccagttcattgtggaggctctagaggaggatccttcctgcctctcccagctcctgggggctccaggcgttctgggtttgtggccgcatcactccagtctcggcctctgtctccatgtggtcttctcctgtgtgtccgtgtctcctcatctgtcttctattaaggacactggtcactgcatttaggaccacctcaattgagaataatctcatctaaagatccttaccttcattattaatacatctgcaaagaccctttttccaaacaaggtcccatacacaagtaccaggtggatacagattttctttggtaggggaggacgcttttcaacccactatagtcatcattgaaatatgcctccttgcactgactgtatcccaacactctgaacgtgcctgggtggtgcattttgatatttaccctcctgagcactgtactggacacttggagacacaattacaccttttaacaaagcccagctgtcattttgggcaacccagtcacagaggtggcctcctgagtggcagctggaagggcctgtatgtgtgagcattcaacctcaacaggaaccctggggactggcttctgggtcatctaagcctccacaccgactgcctgatgtttgcacaggtgtgtgatatttgcccagttgggcctttctgcccacaggtgtgactggacacaatgggcattttgagaagttccagggattgagaaatccatgcttcttcagacgtgcttacagatcacggatgcacctgtgacgttccacatggcttcattttaaaccataaagtttgagaagagtgtgcagtgcctcttagccataggaaagctggctttagtcagatggaggtcctgtttggcttctttaatgcagtgaatgaagctcaggtggcattcagagagtcctgctgtgatggttggcagtggggggtctgcctggccacttgtggattcttctatgtaggcttcatccccagaaaagatctacgcagctttcccacgtggcaggtgcttgggaaactcttaggacaggaacaacaagcccctgcgatgacagaggcattgtcaggctgggcgcggtgactcacgcctgtcatcccagcactttgggaggccaaggcgggtggatcacctgaagtcaggagttcgagaccagcctgaccaacatggtgaaaccctgtctctactaaaaatacaaaaattagccaggcgtgatggcaggtgcctgtgatcccagctactgaggaagctgaggcaggaagatcgcttgaacccgggaggcggaggttgcagtgagctgagatcacgccattgcactgcagcctgggtgacagagcgaaactctgtctcaaaaaaaaaaaaaaaaaaaaactaaaggcacttgtcaggtacagccctgcaaaaatgccgtgctcactcgcaaacctgtatgttgacacgtgcggcatcgctgcagtcggattaacgtggaagaaagagcgtattcctgcgctaggttccctcctccactctgcaaaagtgacccgcaaggaaggtccagccgtccggccccagtgccctttggttgaaagcggagctgccccggcaccctgtctgtctccccggcagggctcccgtgcgtgcctgggtcccttctcatgctgtgtttgtcttggcccttctcagcaggtccccacgcatgagcagccgtccagcaggcaggctccggtggagaagcaatggagaataaaagcctggagagctcccagacagacctgaagctggtggcccacccccgcgccaagagcaaggtgtggaagtatttcggcttcgacaccaacgccgagggatgcatcctgcagtggaagaaaatctactgccgcatctgcatggcccagatcgcctactccggaaacacctccaacctgtcctaccacctggagaagaaccaccccgaggaattctgcgagttcgtcaagagcaacacggagcagatgcgtgaagccttcgccaccgccttctccaagctgaagcccgagtcgtcccagcagcccgggcaggacgcgctggccgtcaaggccggccacggctacgacagcaagaagcagcaggagctgacggccgccgtgctgggcctcatctgcgaggggctgtacccagcctccatcgtggacgagcccaccttcaaggtgctgctgaagacggccgacccccggtatgagctgcccagccggaagtacatctctaccaaggccatccctgagaagtacggggccgtccgggaggtgatcctgaaggagctggccgaggccacctggtgtggcatctccaccgacatgtggaggagtgagaatcagaaccgcgcctacgtcacgctggccgcccacttcctgggcctgggcgcccccaactgcctgtccatgggctcccgctgcctgaagaccttcgaggtgcccgaagagaacacggcggagaccatcacgcgagtgctctatgaggtcttcatcgagtggggcatcagcgccaaggtcttcggggccaccaccaactatggcaaggacatcgtgaaggcgtgctccctgctggacgtcgcagtgcacatgccctgcctgggccacaccttcaatgccggcatccagcaggccttccagctcccgaagctgggggcgctgctgtcgcgctgccgcaaactggtggagtacttccagcagtctgccgtggccatgtacatgctctatgagaagcagaagcagcagaacgtggcccactgcatgctggtgagcaaccgcgtctcctggtgggggagcacgctggccatgctgcagcgcctcaaggagcagcagttcgtcatcgccggggtcttggtggaggacagcaacaaccaccacctcatgctggaggccagcgagtgggccaccatcgaggggctggtggagctcctgcagcccttcaagcaggtggccgagatgctgtcggcctccaggtaccccaccatcagcatggtgaagccgctgctgcacatgctcctgaacaccacgctcaacatcaaggagaccgactccaaggagctcagcatggccaaggaggtcatcgccaaggagctttccaagacctaccaggagacgcccgagatcgacatgtttctcaacgtggccaccttcctggacccccgctacaagaggctgcccttcctctccgccttcgagcggcagcaggtggagaatcgcgtggtggaagaggccaagggcctgctggacaaggtcaaagacggcggctaccggccggctgaggacaagatcttcccggtgcccgaggagcctcccgtcaagaagctcatgcggacatccacgccgccgcccgccagcgtcatcaacaacatgctggccgagatcttctgccagacaggcggcgtggaggaccaggaagagtggcatgcccaggtggtggaggagctgagcaacttcaagtcccagaaggtgcttggcctcaacgaagaccccctcaagtggtggtcagaccgcctggccctcttccccctgctgcccaaggtgctgcagaagtactggtgcgtgacggccacgcgcgtcgcccctgagcgtctcttcggatccgccgccaacgtggtcagcgccaagaggaaccggctggctcccgcgcacgtggacgagcaggtgtttctgtatgagaacgcccggagtggggcagaggcggaacccgaggaccaggacgagggggagtggggcctggaccaggagcaggtgttctccttgggggatggcgtcagcggcggtttctttggcattagggacagcagcttcctgtagcgaggaagcgtgttgtcttacaagtcatccccgcagcagcccattggatgctttgctgtaaatacttacccggtcagcttggttttgaacctcagagaccatccactgtctttgacacctagaaggtggaaaaaggaaagagatttgagaagtgagagagggtcgggggcggtggctcctgtctataatcgcagcactttgggaggccgaggtgggcagatcagctgaggtcaggagatcgagaccagcctggccaacatggcgaaaccccgtctctactaaaaatacaaaaattagccaggactgatggcatgtgcctgtaatcccagcttctggaggctgaggccagagaatcgcttgaacctgggaggtggaggttgcagtaagctgagatcgctgcactccagcctgggcgacaagagcgagactctctcaaaaagaaaaaagaagacacaagagaggtggctttgagtgggtttcctttcctcccctattcccggggcccggacgacttctgcttgggaactgccaacgcttctgcttgggaattgcgtgcagcagagcctagaggagctgttccttccttcacagatacttaagacctccaccatgtctgattcgagttctccctgggagggtttagaagaaacgcaggaacattctgggtggcgtcgaaggagcctttcccgatcatcatgtgtgacttctgcgaggtccagatcactgaattcatgtttacattctcgtgcaagcagggacctcttgcttctgagaaatggggaagagaccttttagccaaaatgcccttcttaaaaagagagacctttttttttaatgttcggttaaaaatgtgacagatgagtacaaaaatgcagacacttaacaaaaagcaaacagaaaaaaaagtgtggaatgtgttgtattttcgacaggttgctgccagagagcctgcttcctgctgcctgccgaaatttcactttgcggagttggtccttaaaactgggcggtggccgggcgtggtggctcacgctgaggtcaggagttcgagaccagcctggccaaccaacatggtgaaacctcgtgtctactaaaaatacaagaaactagccagatgcggtggcacccgcctgtaatcccagctactcgggaggctgaggcggaagattcgcttgagcccaggaggtggaggttgcagtgagccaagactacgccactgcactccagcctggaggccagagtgagactccgtctcaaaacaaaacaaaagtgggtggctcacgggtccggaggttatgtcttcggtgtctcagccctaaaagtccagttcccccgtgcggccagcttttccacataaggtgtttttgatttgattaccggaaaggactcttgattcttctcttttaaactgaataccataggggaaatgaattttaaaatattgcccccggaggggttttccgtggctggattcctgcgagttgctttcagtcattcagggaaacagaaagacgttttccaacatgtagaactgctttttaactggaggaaaaatacttcaggaggcttagcatattgcttggattctacgtgcagcgggttctctgcctccgtgaagacaagctgggctggggagaacggtgtctaggagggatgaccccactcagctccaggcagtgttctgccgagaccccaagaactcggggtgtcagagggcaaaggaactacctgcctttcacggctgctgacttctcagggctgcaagcagcacagaatgttatccttacgtcctgagccggtttaagtctgtggaaaaggaagcacgggagaaatccacgtaacctttgctttctttttaagggaagcggttccgccgtgaacttggaaccctcagctccgggtgttctcggcagaagggcagctggaagggacacagtggggcaggctttggggttgctccctgttctgccccgaggccggggacgcagggcagcccacgcctccgtgggctccattctgtagcattgccagcgttctcttcacgtctctaacaatccttcgcttttcctcactcacgtggaaatgtgaactgtcccggctctgtcttcatttttatttttaagccatcgttcccctcctgaacggttgccccttatttaatgctgtaaagttggactgttgttcaataaaccagagcaatgcattagctcctcattcatttgtctgccgcgtgtccgtctggactgcagtttgtctgaaccccttgatcctgggagtggagggaggtttatcattattattatttttatttttgttgtggtccttgttgaaagcaactttttccagggcacccacggtcagttctgtgctcctctttcttgtctgtaaatcctcaagttatgatgtactttcgggtgttttggcatcaaaatttctgagtgaataaagccggcagctggtgaaagtgttccccgggagcagagatttttgccggttccttcacttagtggatagttgtataaacggaggccccatggacgaggcagcctggatggatccggatggcatcagcgccttccctctccccccagcctccttatcacccctctcttcctgtcttcctcacctcctctcacatggtctcttccttccctcctccttccgtccaaccctccctctcttcttcagccaacaaatccttcctttcttccttctttccttccttccttccctcccatccttgtctcttcttctctcccttccttccctcccttcccttctttctttctctcccttccttccttctctcccttccttccttctctcccttccttccttctctcccttctctcccttttctcccttccttccttctctcccttccttccctcccttctctcccttttctcccttccttctctccgttccctccctcccctccctctctgcctccctttcctcccctccctccttcccccatccctccctccctccttccctctcctccctccctccttccttccctctgtccctccctgtctccctcccttcctccttccttcctttcctccctccctctgtccctccctcccttttctccctccctcccttcctctttcgttttccttccatccctttttccttcctccctccctcttttcctccctcctgagaaaacaatggcccccaagaaacacaggaaggccgggatgtgcacctctgcccagacttgccctttccaagtgctgttggttgactgcctgtccttgggcatcattaaaatgccgaaatttctctttcttgcacgttttgggttgaaaggggttcattttcagtcctcataactaagcatttgcatcgtgatgttcatttaagtgggacatgtttacacgtttttcccattaggagtaattctagtccttgagggtttcttacagagacatttccctaaccccgacggttctcatcccagcctgtgtggcactccttccgcacagtggtgggatttttcggttcggttttgttttcacgcttgcatctggctgcacagccctaactctgagctggttgtttttgtttcccccccactttgcagaattgcctgcttcgaactgttttcccagcaggcctctgaagggtgaggaaaacagcttggggaaagtgagaaaaaggtttcggatgttttagtaaagaggcagctggtgggaaggagccggttgggctgtttctggggtgccgaaatctcggtggtgacgttcatttgctcgtgagtgcagaggaggcccagagaccgggttcctggcgcagccagctcctgcttttgttccgaccatcttcctgcgccttctgcgagtctcagatgtgcttgggcagcagttctactgttttcccctctgtgatctcaggcccgccgccccgtcctttcccagtgatttctgctccgtcaaatcgtggggctcacctgagagttttataaaatgaactcgccatgcccctgcctggtgaacagagaatgcaaactctcacaggaccgtctgcagcaaaacggcagtgttttgctcatttcttcagacgacgaaaacagcagggtttggctcgtttcttccagattttctcaaactgcatgagttcctttctgagcaacttctgggaagctttcgggtttcagggctttgcagccaggctccttcctagctgcggctgcctgtccttttgtgttgcagtcagatgcgggaggtccttggcatgagtaccctgatggtgtcaactttaaggggtcagagaggaaatatttttggctccgcggaccatgcattctctgtctctcaacaacttagttttgccgttgtgtctaaaagcatccattgctgggtgtggtggctcacatctgtcatcccagcactttgggaggccgaggcgggtggatcgcctgaggtcaggagttcaagaccagcctggccaacatggtgaaaccccatctctactaaaaatacaaacattagctgggcatggtggtgggcacctgtaatcccaggtactgaggctgaggcaggagaatcgcgtgaaccagggaggcggaggttgtagtgagctaagatcgtgccactgcgctccatcctgggcgacaagagcgagactccgtgtattccactcccacttcgtgggcactaaattttatataaatgttgtgtcaagaaatattattgctctgttgacttctttttttcccccaaccattaagaaattcagaaaaaaaatgtacgaatgtaaacactgttcttggtgagtgggccttccaaaaataaccgctggactttgttgaaactacttttttttttttttttttttgccactttttcccttttttttctcgaggcaccaattggaatccacttatttgtcctggtttgagaaacagctcagatcgcacactctgggctctgtgtttctttaggtaacacacgtgaggtttttgtcactggaattcagtaatctgtgttaatattatcacaaaagaaccggggggcatttgtgtcttctcagaattgctgattaaaacagctgcatggccaggtgcagtggctctcatgcctgtgatcccagcactttgggaggccgaggcaggcggatcgcttgagcccaggagtttgagaccagcctgggcaacatggccaaacctcatccctactaaaaatacaaaaaattagccaggcatggaggcgcatgtctgtagtcagtcccagctactcaggaggcgaaggtgggaggatcacttgagcttgggagttggaggctgcagtgagctgtgaacataccactgcactccagcctggaaaataaagcaagagatgctgcctctaaaaataataataataataataaaaattagccaaacatggtggcacgcatgtgtgatcacagctacttgggagactgaggtgggaggatcgctggagcccggaaagtcgaggctgcagtgagctgagattgcatcactgtcgtgcagcctgggcaaaagagtgagaccctgtctctaaataaataaataaatgagttcacgattaagcagaagttgtgcttgttctgccaggatttcagttgggttctttgtgccctaatttacgtgagctagtaggttgtgcgttatcttagagggcttgcatgaaagaaagagggtagcctttcttttccctgttttggtagcattgctgaggtggcttttggctgacgggtggacccgtgggtgcagatgttttgatgcagaaggaatgattgccttttcacattcaggctccaactggcttttagcttgtgcgttcttaccctggggtgttcgaggtcaccggactcctattttatttgtgtttaactggaaaggcaggaactctgagaacgtatcaaataggcagttactgcaggatttctagaatttaaattgcttccaaaactgtatccacaagctaagaattatgtttaggttttaaaaggtgttggtttgcttcttacatgtttaaattcttgagggaaagaaatgcaaagaataataaagtttcatgatacaaaaatggtatgagaccgggcacaatggctcacacctgtcatcccagcactttgggaggctgaggcaggaggatgatttttgagcctgagtttgagatcagcctgggcaaacagcgagatcctgtgcctacaaaaataaaataaaaataggctgggtgtggtggctcatgcttgtaatacctgcactttgggaggctaagtcagtaggatcacttgaactcaggggtttgagaccagcctggtcaacatactgagaccttgtctctagtaacaataaaaaaattagctggacataaggtgtgcatttgtagtcccagttacacaggaggctgaggtgggaggatcacttgagccagggagttggaggctgcagtgaaatgtgatcgcaccactgcactccagcctgtgcaacaaggagagagatgctgtctctaaaaaaaaaaaaaaagccagacgtggtggcacacgtgtgtggtcacagctacttgggaggctgaggctgaaggatcgcttgagcccaaggaggctgaggctgccataaactacgatcatgccactgcactccaggctgggcaatagcctgggcgactgtctcaaccaaaataaatttaaaaagataggaaatttcaatgtgaaaatcagtgtcccccagaacgttccatttcttcccagctgggctatttttggagttccatggggagccggctcagtgcagtttgcatgtactcgggaggatgagccctgccatggtgtgtgttaggggacagcctgatctcaccaaccctcctgagcaggcccagccctccgagtaataactgggaacactcgccgctttgtgagacgacctcgtgtgctcactggaaggtcatctcttctggtccatgctgcagtgtggataccattttttttttttaagacagtttcactcttgttgcccaggctggagtgcaatggcacgatctcggctcacagaaacctccgcctcctgggttcaagccattctcctgtctcagcctcctgagtagctgggattacaggtgtctgccaccacagccagctaatttttatatttttcgtagagacggggtttcagtacattggtaaagctggtctggaactcctgacctcaggtgatccacccgcctcagcctcccaaagtgctgggatgacaggcgtgagccaccgcgaccagcccagtgtggatacaccttgagcacataactggaatcctttccttggaaacttggagccccttgtgtcatggtcatataaactgttgaattaagaggagacaccattaaatatgtcacagctgtcctcgaaactgggacttgttttgctttctgcctggaaatgcgagctatctttatagaattattttatagaaaataattgtatacatatataggaggtacgacgtgatgttttaatccgagtacacattgtgcaatgattaaatcaagctggttaccatattattaacctaattaacatatcaataatcaagctaattaacacattaacattcaagctaattaacatattaacaagctaattaacatattcacataatcctaactctgacctatatcacctcacctacttttttttgtggtgagaatgtgtaaaatctacttttagtcattttgaaaaacgcaatgtattattattaatgataatcactgtgtggtgtggtagaactttgaatttatttcttctatctaactggaaaaatttaattttaatgtaatttattttttttgagacagtctcaccctatcacccaggctggagtgcagcatcatgttcatagctcatggcagcctccaactcctggctcaggtgaccctcccaccacagcctcccaggtagctgggactacaggtgcacaccaccacacctggttaattttttaagttttttgcagagatggggtcttgctatgttgctcaggctggtcttgaattcctgggctgaagcgatcctcctgcctcagcctcccaagtagctgggactgcaggtgcatgctaccatacccagctaatttttttttttttttttaaagatgcggtttcattatgttgcccaggcttgtctcaaactcttggcctccagtgatcctccttcctcagccttccatagcattgtgattccagacatgagccaccgctcctggcctccaactgaaattttatgttctttgacaaacacttcatgaagcattcttccctggcaaccaccattgcactctctgcgtttatgcgttcagcttttttagattctacatacgagatgatacagtatttgtctctctgtgcctggttcatttcacttcacattgtatcttccagtcccatccatgttgctgcaaatggcaggatttcctttttcatggctgcatactattccattgtgtgtctatgccacatttgcttgatacgctcatctgttgattgacacatgggttgattctatatcttggaaactgttagtagtgttggcagtgcacagggggtgcaggtatcccattgatgggctgatttcctttcctttgggcacacaccaagcggtgggatgactggatcctgcacaacattctttcctttggtgtttcgcaggcccgtttctggactttagtgaacgtcttcccagtgtccatggcgtccgtcccttggccacatgcttagggaacatcttcagtgtgtacatggcgacagtcccatagccacattcttagggaatgtcttcagtgtgtacacggtggcagtccctttgctgcatgcttagggaacgtctacagtgtggtccattggccacattcttagagaacgtcttcagtgtgtacactgtggcggtcccttggccacattcttagggaatgtcttcagtgtgtacatggcggcagtcccttagccacatgcttagcgaacatcttcagtgtgcacagggcagtggtcccttgggccacatgcttagggaacgtcttaagtgccgtcccttggccgttttcttagggaatgtcttcagtgtgcacatgtggcggtcccctggtcgcattcttacggaatgtcttcagtgcgtacacggtggtcccgtagccacatgcttagggaatgtcttcagtgtgcacagggccatattcttacggaatgtcgtcagtgtgcacatggtggtggtcccttggccacattcttagggaatgtcttcagtgtgtacgtggcggaggtcccttagccacaagcttagggatcatcttcagtgtgcacagtgcgggagtcccttgggccacatgcttagggaatgtcttcagtgtgtacatggtggtggtcccttagccacatgcttagggatcatcttcagtgtgcacagggtgggagtcccttgggccacatgcttagggaacgtcttcagtgtgtacagggcagcagtcctttggctgcattgttagcgaacatcttcagtatgtacatggctgtggtcccttagccacaagcttagggaacatcttcagtgtgcacacggtggtggtcccttgggctacatgcttagggaatgacttcagtgtgtacatggtggccatcccttggccccatgcctagggaatgtcttcagtgccttgccttggctgcattcttagggaacgtcttcagtgcgtacatggcggtggtcccttagccacatacttagggaacgtcttcagtgtgtacaccgtggtggtcccttggccacattcttagggagcgtcttcacttcttacatggtggtggtccccgggccacattctaagggaacgtcgtcagtgcctacacaatggtggtcccttggccgcacgcttggggaacgtcttcagtcacagccctggttggtcccttggccacattcttagggaatatcttcagtgcatacacggtggcagtcccctggtgtcattcttagggaacgtcttcagtgcggtccctcaaccacatgcttagggaatgtcttcagtgctgtttcttagccatattcttagggaacctcttcaatgtgtacacactggtggtcccttggccgcatgcttagagaacatctttagtgcagtcccttggccacattcttagggaacgtcttcagtgtgatcccttggccacattcttagaaaacgtcttcagtttgtacaaggtgacagtccattggccagaatgtgtccctgccacattcttctgagtgtctgtgtctgtgttctttccaccctgtaagctgcttttgcttcttcactgggtgtctgtgactctcatgtggaatccctttcctctgtcaccgcccatcccaggcacagtgagagacgcagccagcctgctcctctctgcacctcgccatcccagacatcctccagccaccgtgctgaccgcattcattccttctcctgccctgtccgcatccttcttcccctacacgtttgataccaagaaatggtctgaatcacagccaaggcttcatttgctttctggaactgcagctccccagccccacccagatcagagattcagaacctgaatcttcggatttctggagatgcccccatcctatcagagacttctagtgtgtttctttatatccgtgtagacttgggaggatgacaggagagaaaccttagaaggtggtctgtgcatttcccgggcccggggtggaaggggcttgtgtcctggctgcctctgtgcacctttcattcttttttttttttttgagacggagtcttgctctgtcaccctgtcacccaggctggagtgcagtggagggatctcggctcactgtaacccctgcctcccaggttcgagcaattctcctgcctcagtctcctgagtagctgggaatacaggcatgtgccaccacgctcggctaattttatatttttagtagagatgggtgttcttcatgttggtcatgttggtctcgaactcctgacctcaggtgatccatccgcctcggcctcccaaagtgttgagatgacaggtgtgagcccccgcgcctggccgcacctttctttcttgatccacctggttttaaactcacagataaactgtttccacctgtgacaaatgagtcatccaccttccatgtggtctggactttgtccctgttacaatattcctgtctcttgtttctggttttttgcatcccacatgttgtccctgtaacagtcctgtctgttgtttctggggtcacccgtgtggcgagctgactgtgccacgttcctgaggctggtgaggatgctgtgggcaccttaatcacggctgtgaacaaactggctagagctaggtgccatggagctttgcagtggacactaagtcgtggtacccattctttgatcagtgacggagccaggtgtcttattaggtcttggggatttgtggaagcccagagcagggaaacagcttctacattgaaaggaatccttctcacactcatgttggcatcgtgaagtccctgatttcctaagacactaccctaatattttaaaagacttacaaaaaatttagtaaaatattcctaatagcagcacatgtggtgtttttttgtttgtttgtttgttttcgagatggagttttgctactgttgccaaggctggagtgcagtggtatgatctcggctcactgcagcctccgtctcccaggttcaagggattctcctgcctcagcctctcaagtagctgggattacaggcatgcactaccacacccggctaattttgtatttttagtagagacgggtttttccatgttggccaggctggtcttgaactcccgacctcaggtaatccgcctgctttggcctcccaaaatgctgggattacaggtgtgagtctccacacctggtcaatcccattctttttcaagaatgcatagtattctgtggtgtatgtacaccaccttttctttatccagtctacgtggcgttgttttgaggaatggatgaaatgatttgcataaaaacagtgaatgctttctattggaatggtgtttgcctcctgggaaactgtggagtcattgcaattgcaatttcctagtagatttgattaattaagagcattgggaatttttggggtgcctgatgcactattacagatatttttttcacagtgtagatatctcagcatgaatatgtctgttttcttttcttttctttcttttttttttttttgagatggagtttctctcttgttgccaaggctggagtgcaatggctcaatcttggctcactgcagccaacatctcctgggcttaagcagttctcctgcgttagcctctggagtagctgggattacaggcatctgccaccatgcctggctaatttttttttgtgtgtgtgtttttagtagagacagggtttcaccatgttggcctggccggtctcaaactcctggcctcaagtgatccacctgccttggactccgaaagtgctgggatgacaggcctgagccatggcggccagctgtctgttttctttccataagaggtgctggtctcaccgtggctctgtgctgtgatgaaatggcattgtccaagttttactcctcacagcctgattttgtatgttaaagacgtcttccttggtgtgaatcaagtgggctgggcagagttaagggagccatttatttagaaggcgattagatcgaattatgtcttggtaattactgcagttacaccaccccattctttccgtggctctcctagctgggtttgtggctagtcatggaggtgccctgaagagcctcattttcccacagctgtaggaagtgtgtggtacacccacaatgtcttagcttttgtattagggaaggtcttcagtgcattcccttggccacattcttagggaacatcttcagtgtgtacatggcggcggtcccttaaccacattcttagggaacgtgttcagtgtgtacacggtggcagtcccttggctgtatgcttagggaacgtcttcagtgagtgtgatcccttggccacatgcctagggaacatcttcattgtgtacctggcggcggtcccttagccacatgcttagggaatgtcttcagtgtgtacacggtggcagtctgttggccccatggttagggaacatcttcagtgtgcacagggcggcggtcccttgtgccacatgcttagggactgtcttcagtgtgtacatggtggcggtcccttggtcgcattcttagggaacctcttcagtgtgtacatgtcggcattcccttagccgcatgcttagggaacgtcttcattgtgttcttggtggcagtcccttagccacatgcttagggaacgtcttcagttgtatacagtggggtcccttggtcattatgcctaggggaacgtcttcagtgccagctgcattcttagggaatgtcttcagtgtgcacatggcggaggtcccttagccacatacttagggagtgtcttcactgcacacagcagtggtcccttggttgcattcttagggaacatcttcagtgtgcacatggtagcagtccctcacccacattcctagggaatgtcttcagtgtatacatggtggcagttctttggctgcatgcttagggaacatcttcagtgcattcccttggccacatgcctagggaacatctttagtgctgtcccttccctgcatttttagggaacgtcttcagtgtgtacatggtggcggtcccttggccgcattcttagggaacgtcttaagtgtgtacatggcggcggtcccttagccacaagcttagggaacgtcttcagtgtgtatatggtggcagtctcttggccacatgcttagggaacgtcttcagtgccatcttttagctgcattcttagggaacgtcttcagtgtgtacatggcagaggtcccttagccacacacttagggaacatcttcagtgtgtgcacagcagtggtcccttggcctcattgttagggaacgtctttggtgtgtagatggccgccgtcccttagccacaagcttagggatcgtcttcagtatgcacagcgtggcagtcccttgggccacatgcttaaggaatggcttcagtgtgtacaccgttgtggtcccttggccacattcttagggagcgtcttcagtgccgtcttttggctgcattcttagggaatgtcttcagtgcgtacatgggggcggtcccttagccacatacttagggaacgtcttcagtgtgtacatggcagtggtcccttggccccattcttagggaacatcttcagtgtgtacatggtggcagtcccttaatcacatgcttagggattgtcttgattgtgtacatggcgatggtcccttggccacatgctttgggaacctcttcagtgcatacggagtggcagtcccttgtccacattcttagaaaacgtcttcagttcgtacacggtggcgatcccttggccacattcttctgagtgtctgtgtctgtgtcctttccaccctgtaagctgcttttgtttcttcattgggtgtctctgactctcatgtggaatccctttcctctgtcaccgcccatcccaggcacagtgagagacgcagccagcctgctcctctctgcacctcgccatcccagacatcctccagccaccgtgctgaccgcattcattccttctcctgccctgtccgcatccttcttcccctacacgcttgataccaagaaatggtctgaatcacagccaaggcttcattatctttctggcactgcagctccccagccccacccagatcagagattcagaacctgaatctttggatttctggagatgcccccatcctatcagagacttctagtgtgtttctctatattcgtgtagacttgggaggatgacaggagagaaaccttagaaggtggtctgtgcatttccggggcccggggtggaaggggcttgtgtcctggctgcctctgtgcacctttcattcttttttttttttttgagacggagtcttgctctgtcaccctgtcacccaggctggagtgcagtggagggatctcggctcactgtaacccctgcctcccaggttcgagcaattctcctgcctcagtctcctgagtagctgggaatacaggcatgtgccaccacgcccggctaattttatatttttagtagagatgggttttcttcatgttggtcatgctggtctcgaactcctgacttcaggtgatccatccgcctcggcctcccaaaatgttaggatgacaggcgtgagcccccgcgcctggcggcgcctttcattcttgatccacctggtttcaaactcgcagataaactgtttccacctgtgacaaatgagtcatccaccttccgtgtggtctggactttgtccctgttacaatattcctgtctcttgtttctggtttttggcgtcccacgtgttgtccctgtaacagtcctgtctcttgtttctggggtcacccctgtggcgagctgactgtgccacgttcctgaggctggtgaggatgctgtgggcaccttaatcacggctgtgaacaaactggctagagctaggtgccatggagctttgcagtggacagtaagttgtggtacccattctttgatcagtgacggagccaggtgccttattaagtctcggggatttctggaagcacagagcaggcaagcaccttctacactgaaaggaatccttctcacactcatgttggcaacgtgaagtcctgcctttggaaatccctgatttcctaagacactaccctaacattttaaaggacttaaaaaaaattcagtaaaatattcccaatagcagcacatgtagtgttttatttatttatttatttttgagatgatttgcactcttgtcgcccaggctggagtgcaatggtatgatctgggttcactgcaacctccgtctcccgggttccaaggattctcccatctcagcctgtaaggtagctgagattataggcatgcgccaccatgctcggctgattttgtatttttagtagtgacagggtttcaccatattggtcagggtggtctcgaactcctggcctcaagtgatccacccatcttggcctcccaaagtgctgggattatgaatcactgctcctggcctactttttaaactttcaggttcaggggcacgtgtgcaggttcattacacgggtaaattgcatgtcctgggggtttagtgtacagattaattcatcaaccaggtagtaagcctactaccatctgataggtagttttttgatcctctcatttgtcccaccctccaccctccagcaggcccctgcagctgttcccttctttatatccaccagtgcccaatgtttagctgtcacttatcagtgggaacaggtggtatttggttttctgttcctgtgtaagtttgctaaggataatggcctccacctccgtgcatgttcctgcaaaggacatcatcccattttttttttttttttgagacagtttcctttttgttgcccaggctggagtgcaatggtgtgatctcggctcaccgctaccaccagctcccgggttcaagcagttgtcctgcctcagccttctgagtaactgagattacagacacatgccaccacgcccggctaattttgtatttttagtagagacggggtttctccatgttgcccaggctggttttgaactcctgacctcagttaatctgccctccacggcctcccaaagtgctgagattataggtgtgagccaccacacccaaccaatcccattctttttcatgggtatgtagtattccatagtgtatatgcaccaccctttgtttatccagtttacatggcgttgttttgagaaatggatgaagcgatgtgcatgaaaacactgaatgcttcctactggaggggtgttcacctttccgggaaactgtggagtgattgcaattgcaatttcctagtagatttgattggttaatagcattgggaatctttggggtgcctgatgccctattgcagatcttttttcacagtgtagaaatctcaacgtaaatgtctttttttttttttgagatggagttttgctcttgttgcccaggctgcagtgcaatggctcaatctcggctcactgcagccaacatctcccgggtttgagcaattctgcctcagtctcctgagtagctgggattgcaggtgcctgccaccacacccggctaatttttgaatttttagtagagaaggggtttcagcctattgttcaggctgctctcgaactcgtgacctcaggtgatccacccacctcggcctcccaaagcgctgggatgacaggcgtgaccgcgcccagcccagtgtggatacaccttgagcacataactggaatcctttccttggcaacttggagccccttgggtcatggtcatataaagggtgttgaattaagaggaaacactgttaaatatgtcacagctgtccttgaaactgggacttgttttgttttctgcctggaaatgcgagtcatttttctggaaaattcatttttcgttaaaaaaagtaattgtatacacgtatatgaggtacaacgtgatgttttaatccacgtacacatcatgcaatgattaaatcaagctagttaccatattaacaatcacattaactaacatattaataatcaggctaattaacatattaacattgaagctaattaacatattaacaatcaagctaatttacatattcacataattctaactctaacctatatcacctcacctacttttttttgtagtgagaatatgtaaaatctacttttagtcattttgaaagacgtgatgtattattaactatcatcactgtgtggtgtgatagaacttggaattcatttgttttatctaactgaaaaaaattaattttaatgtaatttatatgttttttgagacagtctcatcctatagccaggctggagtacagcatcatgttcatagctctcagcagcctccaactcatggctcaggtgaccctcccacctcagcctcccaggtagctgggactacaggtgcacaccaccacacctggttaatttttaaattttttgtagagatggggtcttgctatgttgctcaggctggtcttgaattcctgggctaaagcgatcctcctgcctcagcctcccaagtagctgggactacaggtgcatgccaccatatccagttaattttttcagttttttttttatttgtttagagatagggtttcattacgttacccaggcttgtctcaaactcctggcctccagtgatcctccttcctcagccttccatagcacagtgattccagacatgagccacagcgctcctggcctccaactgaaatgttatgttctttgacaaacacttcagcattcttccctggcaaccaccattgcactctctgcgtttatgcgttcagcttttttagattctacatacgagatgatacagtatttgtctctctgtgcctggttcatttcacttcacattgtatcttccagtcccatccatgttgcgcaaatggcaggatttcctttttcatggctgcatactattccactgtgtgtctatgccacatttgcttgatgtactcatctgttgattgacacatgggttgattgtatatcttggaacctgagtagtgctgcagggcacaggggatgcaggtatcccattgatgggctgatttcctttcctttgggtacacacccagtggtgggatgtctggatcctgcacaccattctttcctctgatgttttgcaggcctatggctggacctttggaacgtcttcactatgtacaaggtggcggtcccttggccacattcttagggaacgttttcagtgtgtacatggtgtcggtcccttggctatatgcttagggaacatcttcagtgggtacatggtggcggtcccttagtcatattcttagtgaatgtcttccgtgtgtacacggtggcagtcccttggctgcatccttaggcaacgtcatcagtgcagtcccttggccacatgcttagggaacgtcttcagtgcatacacggtggcggtcccttggccacattcttagggaatgtcttcagtgtgtacatggtcgcagtctgttagccacatgcttagggagcgtcttcagtgtgtatagggtggcggtcccttggccacatgcctagggagtgtcttcagtgccgtcgcttggctgcattctttgggaacgtcttcaatgtatacatggcggcggtcccttggctgcatttttagggaacgtcttcagtgtgtacatggcggcggtcccttatccacattcttagggaatgtcttcagcgtgtacacggtggcagtcccttggccgcatgcttaggggacttcttcagtgcggtcccttggccacatgcctagggaacgagtcttcagtgccgtcccttggctgcattcttagggaacgtcttcggtgtgtacatggtggtggtcccttgggcgcattgttagggaacgtcttcagtgtgtacatggcagtggtcccttagccacatgcttcggaatgccttcagtgtgtacatggcggaggcccctcagccacgtgcctagggaatgtcttcagtgctgtcttttagcggcattcttagggaacgtcttcagtgtgtacatggtggtggtccctgagccacatacttagggaacgtcttcagtgtgcaacggcagcggtcacttggccttattgctagggaacttcttcagtgtgtacatggcggtggtcccttagccacaagcttagggaacgtcttcagtgtgtacatggcagcagtcctttggaccacatgcttagggaatgtcttcagtgtgtacacggtggtggtcccttggccccatccctagggaaagtcttcagtgccgtcctttggctgcattctttgggagcgtcttcagtgtgtacatggtggaggtcccttggccacattcttagggaatgtcttcagtgtgtacatggcggcggtcccttggccgcatacttagggaacgtcttcagtgtgtacatggcagtagtcccgtggccgcattcttagggaacctcttcagtgcatacacagtggcggtcccttggccacattcttctgagtgtccgtgtctgtgtacttttcatcctgtaaactgcttttgtttcttcattgggtgtctctgactcttatgtggtatccgtttcctctgtcagcgaccatcccaggcacagtgagagacgcagccagcctgctcctctctgcaagtggccatctcagacattctccagccagcgtcctgaccgcattcattccttcccctgcccggtccacatccttcttcccctacacccttgctaccaagaaatggtctgaatcacatcacaggcttcctttgctttctggaactgcagctccccagcccacccagatcagaggttcagaacctgaatcttcggatttctggagatgcccccatcgcatcagagacttctagtgtgattctttatattcgtgtagacttgggaggatgacaggagagaaaccttagaaggtggcctgtgcagttccagggcccagggtggaaggggcttccatccctggctgcatttgtgcacctttcattcttggtccaacattttttttttttttttttgagacggagttttactgtgtcgcccaggctggagtgcagtggtgtgatctcagctccctgcaacctccccgcctcctgggttcaagcgattctcctgagtggctgggagtacgggcatgcaccaccatgcctggctaattttatatttttagtagagatgaggtttctccatgttggtcaggctggtctcaaacccctgacctcaggtgatccatccaccttggcctcccaaagtgctgggattacaggtgtgagccaccacgtccggctgcactttttattcttgatccacctggtttgcaactcacagataaactgtttccacctatgacacatgagtcttccaccttccatgtcctctggactttgtccctgttataatattcctgtctcttgttctggtttttggcatctcacacattgtccctgtttcagtccggtctcctgtttctggtgtttggtgtgccgcacgttgtccctgttacagtcctgtctcttgtttctggggtcacccgtgtggagagctgactgtgccgcgttcctgaggctggtgaggatgctgtgggcaccttaatcacggctgtgaacaaactgactagagctaactgccacggagctttgcagtggacgctaagctgttgtactcattgtttgatcagtgacggagccagatgtcttattaggtctcggggatttgtggaagcctagagcaggcatgcaccttctacgtagaaaggaatccttctcacactcaagttggcgtcgtgaagtcctgcctttggaaatccctgatttcctaagacactaccctaacattttaaagggcttaaaaaatttcaataaaatgttcccagtagctgttacatgtagtcatgtagcgtttttttttttttttttgagatggacttttgctcttgtctcccaggctggagtgcaatggcgcgatctcggctcactgcaatctctgtctcccgcattcaagggattctcccacctcagcctgtcaggtagctaggattataggtgtgcgctaccatgccctgctacttttgtatttttagtagtgacagggtttcagcatgttgatcagggtagtctggaactccttgcctcaggtgatccacccgccttggcctcccaaagggctgggattatgaatcaccgcccccagcctacttttttcactttgatttcaggttgagggggacgtgcgcaggtaaattgcatgtcttgggggcttagtgaacagattatttcatcatgcaggtaataagtccagtaccacctgataggtagtttttcgatcctctcatttctcccaccctccaccctccagcatgcccctgcagctgttcccttctttgtatccatgagtacccaatgtttagctgccgtttatgagtgagaacaggtgatatttggttttcttttcctacgtgagtttgctaaggataatggcctccacctccatgcatgttcctgcaaagggcatcatcccatgttttctttttttctttttcttttgagactgggtttccttcttgttgcccaggctggagtgcagtggtgtgatctcagctcaccacaacctcctgttcctgggttcaagtgattctcctgcctcaggctactgagtcgttgagattacaggcgcataccaccacgctgggctaattttgtatttttagtagagacggggcttctccatgttggccagtctggtcttgagctaccgacctcaggtaatctgcctgcctcggcctcccaaagtgctgggattacaggcatgcgccgccacgcccaaccaatcccattctttttcatgggtccatagtattccatagtgtatatgctccaccctttctttatccagtctacatggcgtcctgttgaggaatggatgtaacaggcgtcgtgttcaggaatggatgtaacaatgtgcataaaagcagtgaatgttttctattggaatggcgtttgcctttctgggaaactgtggagtcattcgaattgcaatttcctggtagatttgattagctaagagcattgggaatttttggggtgcgtgatgccctgttgcagatattttttcacagtgtagaaatctcagcatgaatatgtctgttttcttttctctttttttttttttttttgcgatggagttttgctcttgttgcccaggctagagtgcaatggctgaatctgggctcactgcagccatcatctcctgggttcaagcaattctcctgcctcagcctctggagtagctgggattgtaagtgcctgcccctacaccctgatttttctttttttttgtatttttagtagagacggggtttcacctgttgggcaggctggtttcgaactcctggcctcaagtgatccacctgcctcagcctcccaaagtgctcggatgacaggtgtcagccacggtgcctggccgtctgttttcttttcataagaggtgctggactcacagtggctctgtgctgtgatgaaatgacattgccaaagttttactcctcacagcttgattttgtatgctaaacaggtcttctttggcgtgattgaggagggatggggagacttaagggagccatgtatttagaaagcgattagatcctgttatgtcttggtaattactgcagttacaacacgccattctttccgtggctcacctagctgggttcgtggctagtcatggaggcgccctgaagagcctcattttcccacagctgtaggaagtgtgtggtacacccacaatgtcttagcttttgtattagggaacgtcttcagtttgttcccttggccacatgctttgggaatgtcttcagtgtgtacacggtggctgtccctgggccgcatgcttagggaacgtcttcagtgaggtcccttggccatatgcctagggaacgtcttcggtgccatcctgtgactgcattcttagggaacgtcttcagtgtgtacatggcgggggtcccttagccccattcttagggaatgtcttaagtatttacacagtggcagtctgttggcctatggttagggaacatcttcattgtgcacatggtatcagtcccttgcgccacatgcttagggaattcttcagtgtgtacatggtggccgttccttggctgcattgttacagaacgtcttcagtgtgtacatgtcagcggtcccttagccgtaagcttagggaacgtcttcagtgtgtataaggtggcggtcccttggccacatgcctagggaacgtcttcagtgccctcccttggctgcattcttagggaacgtcttcagtgtgtacatggctgccttcccttagccacatacttagggaacatcttcagtgtgcacacggcagctgtcccctggacgcattcttagggagcgtcttcagtgcgaacatggcgggggtcccttacccacattcttagggaacatcttcagtgtgcacacggcagcagtcccctggacgcattcttagggagcgtcttcagtgcgaacatggcggcggtcccttacccacattcttagggaacatcttcagtgtgtatatggtagcagtcccttagccacacacttagggaacgtcttcagtgtgtgcacatcagcggcccttggccggattgctagggaacctcttcagtgtgtacatggcagcggtcccttaacccaagcttagggatcgtcttcaatgtgcaaagggcaatggtcccttgggccacgtgcttagggaatgtcttaagtgtgtacacggcggtcccttagccacatgcctaggaaacgtctgccatctcttcgctgcattcttagggagcgtcttcagtgcgtacatggcggccgtcccttagccacgtacttagggaacatcttcagtgtgtacatggcggtggtcccttagccacatacttagggaacgtctccagtgtgtacaggtggccgtctcttagccatattcttagcgaatgtcttcagtgtgtacacagcagtggtcctttggccacatgctttccgaacgtcttcagtgcatacagtggcagtcccttggacccattcttagaaaacgtcttcagttcgtactcggtggcgatcccttggccacattcttctgcgtgtctgtgtctgtgtccttttcaccctgtaagctgcttttttttcttcattgggtgtctctgactctcatgtggaatccctttcctctgtcaccgcctgtcccaggcacagtgagagacgcagccagcctgctcctctctgcacgtcaccatcccagacattctccagccagcgtcctgaccgcattcattccttctctttcccttgtccacatccttcttcccctacacgcttgataccaagaaatggtctgaatcacagccaaggcttcctttgctttctggaattgcagctccccacccccacccagatcagaggttgagaacctgaatcttcggatttctggagatgcccccatcgcatcagagacctctagtgtgtttctttatatccgtgtagacttgggaggatgacaggagagcaaccttagaaggtggcctgtgcagttccagagcccagggtggaaggggcttccattcatcactgccttcgtgcacctttcattcttgatccaaccgttgttgttgttgttttgagacggagtcttgctgtgtcgcccaggccggagtgcagtggtgtgatctcaggtcactgcaacctccgcctcccatgttcaagcgattctcctgccacagcctctctgagtagggagctgctaaaataaaataccttcagttgggtaatttataaactagagacatttatcactcacagttctgaaggctggaggttcaagatcatggcagattcagtgtgtggtggggatgcactccctggttcatagacgacgcattttctctgcctgctcacatggtggaaagggcgagggagctctctggggctccttttataaggacagtgatcctattcatgaggcttgatccccatgaagtcatcacctcccaagtctcccacctcctgacaccattgtcttaggggtgaggatttcaatgcaggaatttgggggaggaacacaaactttcagattgtagcaaataccattctttaaaaaaatgcagtaatagttaagctttttttttttaatttgataaattttccaagaaggaggagacacagaaaccctccgtgttttgaaggttaatattagtgctgtaaaatacacgtgggacttgggcttataaaaaattcctggtcatggcaaaatataggtggtttgcagtacctggggaagcccacctttcctgtttctgacatgtaacttttgtggaaattgcctgaaagttgtttctagttacccttcagtcctgtgtccaacccagcatgtccgatactatctaacattgttttttttttgagatggagttttgctcttgttgcccaggctgcagtacagtggcacgatcttggctcgctgcaacctccacctcccaggttcaagcgattctcctgtctcagcctcctgagtagctgggattactaaattttatataaatgttgtgtcaagaaatattattgctcttttgcctttttttcccttaaccgttgagaaattcagaaaaaaacatttatgaacgtcaacactgtttttgacaagtaaacattgttcttggcaagtgggccttccaaaaataagggctggcgtttgtggaaactgctctactgttctttttttttcttgctacttttttctttttttttttttttgaggcactaattggaatccacttattcgtcctgggtggagaaagagttcagatctaacactgggggctctgtgtttccttaggtaatacatatgaagtttttgtcactgtaattcagtaatctgtgttaatattatcacaaaagagcagagtggcatttgtgtcttctcagaattgcttattaaaacagctgcatggccagccgcggtggctctcatgcctgtgatcccagcactttgggaggccgaggccggtggatcgcttgagcccaggagtttgagaccagcctgggtaacatggccaaacctcatctctactaaaaatacaaaaagtgagagcgtgcctgtagtcccagctactgaggaggcagaggtgggaggatcacttgagcgtgggagttggaggctgcagtgagctgtgatcacagcctgggaaaccaagcgagagatgctgtgtctaaaattataaaaataaaaattagccaaacatggtgccacgcgtgtgtggtcacagctacctgggtggctgaggtgggaggatcactggagcccacaaagtcgaggctgcagtgagctgagattgcatcactgtcgtgcagcctgggcaccagagtgagagacaccctgtctctaaataaataaataagttcatgattaagcagaagttgtgcttgttctgccgggatttcagttgggttctttgtgccctaatttacgtgagctagtaggttgtgcgttatcttagagggcttgcatgaaagaaagagggtagcctttcttttccctgttttggtagcattgctgaggtggcttttggctgacgggtggacccgtgggtgcagatgttttgatgcagaaggaacgattgccttttcacattcaggctccaactggcttttagcttgtgcgttcttaccctggggtgttcgaggtcaccggactcctattttatttgtgtttaactggaaaggcaggaactctgagaacgtatcaaatagccagtttactgcaggctttctagaatttaaatcgcttccaaaactggatccacaagctaggaattatgtttaagttttaaaaggtgttggtttgcttcttacatgtctaaattcttgggggaaaaactgcaaagaataataaagtttcatgattcaaaaatggtatgaggccgggcacaatggctcacacctgtcatcccagcactttgggaggctgaggcaggaggatgatttttgagaccaggagtttgagatcagcctgggcaaacagcgagatcctgtgcctacaaaaataaaataaaaataggctgggtgtggtggctcatgcttgtaatacctgcactttgggaggctaagtcagtaggatcacttgaactcaggggtttgagaccagcctggtcaacataatgagaccttgtctctagtaacaataaaaaaattagctggacataaggtgtgcatttgtagtcccagttacacaggaggctgaggtgggaggatcacttgagcctgggagttggaggctgctgtgaaacgtgatcgcaccactgcactccagcctgtgcaacaaggagagagatgctgtctctaaaaaaaaaaaaaaaagccagacgtggtggcacacgtgtgtggtcacagctacttgggaggctgaggctgaaggatcgcttgagcccaaggaggctgaggctgccataagctacgatcatgccactgcactccaggctgggcaatagcctgggcgactgtctcaaccaaaataaatttaaaaagataggaaatttcaatgtgaaaatcagtgtcccccagaacgttccatttcttcccagctgggctatttttggagttccatggggagccggctcagtgcaccttgcatgtactcaggaggatgagccctgccatggtgtgtgttaggggacagcctgatctcaccaaccctcctgagcaggcccggccctccgagtaataactgggaacactcgccgctttgtgagaggacctcgtgtgctcactggaaggtcatctcttctggtccacgctgcagtgtggatactttttttgtttgtttgtttgtttgagaaggattattgctctttttgcccaggctggagtgcaatggcatgatctcggctcactgcaacctccacctcctgggttcaagccattcttctgtctcaacctcctgagtagctgggattacagtcgcccgccaccacacccggctaatttttgtatttttagtagagacagggtttcagcatattggccttgctgttctcaaactcctgacctcaggtgatccacctgcctcagcctcccaaagtgctgggatgacaggcgtgagccaccgcgcccggcccagtgtagatacaccttgagcacataactggaatcctttccttgacaacttggagccccttggaacatagtcatataaactgtattgaattaagaggagacaccgttaaatatgtcatagctgtcctcaaaactgggtcttgttttgctttctgcctggaaatgggagtcacttttatagaaaatttattgttcgttaacaaaaaataattgtgtgtgtgtgtatatatatattgtatgtgtgtgtatatatatatatatatatatatatatatacacacagacacacattctctctctctctctctctatggtacaatatgatgttttaatccaagtacacattgtgcagtgattaaaccaagctagttaccatattagcaatgaagctaattaacattaataattaagtgaattaacatattaaccattgacctaattaacatattaacaatcaagctaattaacatattaacaagctaatttacatattcagataaccctaactctaacctatatcacctcacttcgtttttttggtgatgagaatatgtaaaatctagttttagtcattttgaaagatgcaatgtattattattaactataatcactgtgtggtatgatagaactttgaatttatttcttttatgtaactgaaaaaatttaattttaatgtaatttatgtttttgagacagtctcaccctctatcacccaggctggagtgcagcgtcatgttcatagctcatggcagcctccaactcctggcacaggtgaccctcccacctgagcctcccaggtagctgggactacaggtgcacaccaccacacctggttaatttttaaagttttgtagagatggggtcttgctatgttgctcaggctggtcttgaattcctgggcagaagtgatccttctgcctcagcctcccaagtagctgggactgcaggtgcatgccaccatatctagctaattttttcatttttttttatttttagagatggggtttcattatgttgcccaggcttctctcaaactcctggccttctgtgatcctccttcctcagccttccatagcattgtgattccagacatgagccaccgctcctggcctccaactgaaatgttatgttctttgccaaacacttcatgaagcattcttccctggcaaccaccattgcactctctgcgtttatgcgttcagcttttttagattctacctatgagatgatacgatatttgtctctctgtgcctggttcatttcacttcacattgtatctttcagtcccacccatgttgctgcaaatggtaggatttcctttttcatggctgcataccattccattgtgtgtctatgccacattcgcttgatgcacttatctgttgattgaacatgggttgattctatatcttggaaactattagtagtgctgcagtgcacagggggtgcaggtatgccattgatgggcagatttcctttcctttgggtacacaccgagcggtgggatgactggatcctgcacaacattctttgctctgatgttttgcaggccaatggctggaccttagggaacgtcttcactttgtacaaggtgggggtcccttggccacattcttagggaacgtctgcagtgtgtacacgatgttggtctcttgaccacatgcttaggaaacatcttcagtgtgtagctggcagcagtcccttagccacattcttcccgaatgtcttcagtgtgtacacggtggcagtccctagtcctaattcttcgggaatgtctttagtgtgtacatggcggcagtcccttggccgcattcttagggaacgtcttcagtgtgcacactgcggtggtcccttagccacaagcttagggaatgtcttcagtttgtacttggtggcggtcccttggctacatgcttacggaacatattccctgccgtctcttggctgctttcttagggaacgtcttcagtgtgtacatggtggtggtcccttagccacaagcttagggaacgtcttcagtgtgcacaccgtggctgtcccttgggccacatgcttagggaacgtcttcagtgtgtacatggtggcagtcccttggccacattcttagggaacgtcttcagtgtgtacagggcggcagtcctttaaccacatgcttaggggaaccatcttcagcatgtccacggtggcggttcttttgcggcattcttaggggatgtcttcagtgtgtacatggcggctgtcccttagccacaggcttagggaacgtcttcagtgtttacatggtggcggtcccttggccacatgcctagggaatgtcttgagtgctgtcccttggctgcatcttagggaatgtcttcagtgtgtaaatggtagcagtcccttagccacatgcttagggaacgtcttcagtgtgcacacagcagaggtcccttgcgccacatacttagggaacgtcttcagtgtgtacatggtggtggtcccttggccacatccttagggaacatcttcagtttctacacagtggccatcccgctgccacattcttagggaacgtcttcagtgcctacatggtggtggtcccttggccacattcttagggatcatcttcagtgtggacccttggccacattcttagaaaacgtcttcagttcatacatggggacgatcccttggccactttcttctgagtgtctgtgtcatttgctccctgtaagctgcttttatttcttcattgggtgtctctatcatgtggaatcccactcatctgtcaccacccatcccaggcacagtgagagacacagccagcctgctcctctctgcacgtggccatctcagacattctccagccactgtcctgaccccattcattccttctcctgcacggtccacatccttctttccctacacccttgctaccaagaaatggtctgaatcacagccaaagtttcatttgctttctggaacagcagctccccagccgcactcagatcagagattcagaacctgaatcttcggatttctggagatgcccccatcccatcagagacttctagtgtgtttctttatattcgtgtagacttgggaggatgacaggagagaaaccttagaaggtggcctgtgcagttccagggcccagggtggaaggggcttgcatccctggctgcctttgtgcacctttcattcttcatccagctgttttttttttttttttttgaagaggagtcttgctgtgtcccccaggctggagtgcagtgctgtgatgtcagctcactgcaacctccgcctcctgtgttcaagccattctcctgccacagcctcccgagtagctgggattacaggcacctgccaccacacatggctaatctttgtatttttagtagagatggggtttcatcatgttggccaggctggtcttgaactcctgacctcaggtgatccacctgcctcagcctcccaaagttctgggataacaggcatgagccactgcgcccggccgcacccttcattcttgattcacctggttacaaactcgcagataaactgtttctacctgtgacaaatgagtcatccatcttccatgtggtgtcgactttgtccctgttataatattcctgtctcttgttctggtttttggcgtcccgcacattgtccctgttacagtcgtgtctcttgtttctggggtcacccctgtggtgagttgactgtgccctgttcctgaggctggtgaggatgctgtggacaccttaatcacggctgtgaacaaactggctaaagctaggcaccatggagctttgcagtggatgctaagtcgtggtacccattctttgatcagtgacggagccaggtgtcttattaagtctcggggatttgtggaagcccagagcaggcatgcaccttctacattgaaaggaatccttttgacactcaacgttggtgtcgtgaagtcctgcctctggaaatccctgatttcctaagacactaatctaacattttaaaagagttaaaaaaaaatcagtaaaatgttccccatagaagcatgcagtgttttgtgtgtgctttttattgttttttttttttttttttttgagacgaagttttgttcttgtcgccaaggctggagtgcagtagcacaatctcggctcactgcaacctccgtctccagggttcacgggattctcccgcatcagcctgtcacgtagctgggattataggtgtgtgccaccatgcccgactaattttgtatttttagtagtgacagggtttcatcatgttggtcagggtggtctcgaactcctggcctcaagtgatccacccgccttgccctcccaaagtgctgggattaggaatcactgctcccggcctacttgtttttacttttatttcaggttgaggggcacatgcgcaggttcgttacacgggtaaattgcatgtcctgggggtttagtgtagagattatttcatcaaccaggtaataagcctactaccacctgataggtaatttttcaatcctctcgtttgtcccaccctccaccttccagcaggccccggagtctgatcccttctttatatccacgggtacccaatgcttacctaccacttatcagtgagaacaggaggtattttgtcttctgttgctgtgtaagtttgctaaggataatggcctccacctccatgcaggttcctgcaaaggacatcatcccgtttttttttttttgagatggggtttccctcttgttgcccaggctggagttcaattgtgtgatcttgactcaccgcaacctctggctcccgggttccagtgattctcctgccttagccttctgagtagctgagattacaggtgcatgccaccacgcccagctaattttgtgtttttagtagagacagggtttctccatgttggacaggctggtcttgaactccggacctcaggtaatccacccgcctcggcctcccaaatttctgagattacaggcgtgagccaccacgcccaaccaatcccattctttttcatgggtgcatagtattccatagtgtatatgctcccacctttctttatccagtctacatgacgtcgttttgaggtatggatgaaatgatttgcataaaaacagtgaatgctttctattagaatggtgttggcctttctgggaaaccgtggagtcattccaattgcaatttcctagtagatttgattggttaatagaattgggaatttttggggtgcctgatgcacactattggagatcttttttcacagtgtagaaatctcaacatgaatatgtctttttttttttttgagacggagtttctctcttgttgcccaggccggagtgcaatagctcaatctcggctcactgcagccaacatctcccgggttgaagcaattctcctgcctcagcctcctgagtagctgggattacaggtgcctgccaccacacctggctaatttttgtatttttagtagacacagcgtttcagcatattggtcaggctggtctggaactcctgacctcaggtgatccacccgcctcagcctcccaaagtgctgggatgacaggcgtgagtcacagcgcccggcccagtgtggatacaccttgagcacataactggaatcctttccttggaaacttggaaccccttgtgtcatggtcatataaactgtgttgaattaagaggagacactgttaaatatatcacagctgtcctcgaaactgggacttgttttgctttctgcctggaaatgcaagtcatttttatagaaaatttatttttcgttaacaaaaaataattgtatacatatatatggtacaatgtaatgttttaatccaagtacacattgtgcaatgattaaatcaagctagttaccatattaacaataaagttaattaacatattaaaataaagctaataacgtattaaccaagctaattaacatattaacaatcaagctaattaacatattcacataatcctaactctgacctatatcacctcacctagttttttttgtggggagaatatgtcaaatctacttttagtcattgtgaaagacgcgatgtattattaactatcatcactgtggtgtgatagatcttggaatttatttgttttatctaactgaaaaaaattaattttaatgtaatttatgtattttttgagacagtctcaccctatagccaggctggagtacagcatcatgttcatagctctcggcagcctccaagtcatggctcaggtgaccctcccacctcagcctcccaggtagctgggagtacaggtgcacaccaccacacctggttaatttttaaattttttgtagagatggtgtcttgctatgttgctcaggctggtcttgaattcctgggctgaagcgatcctcctgcctcagcctcccatgtagctgggagtacaggtgcatgccaccatacccagctaattttttgttttttttttttagagatggggtttcattctgttgcccaggcttatctcaaactcctggcctcaagtgatcctccttcctcagccttccatagcattgtgattccagacatgagccaccgcttttggccagcaactgaaattttgtgttctttgacaaacacttcagcattctttgctggcaacaaccattgtaccctctgcatttatgtgttcagcttttttatattctacatatgcgatgatatggtatttgtctctctgtgcctgtttcatttcacttcaccttgtatcttccagtcccatccatgttgctgcaaatgacaggatttcctttttcatggctccatactattccagtgtgtgtctatgccacatttgtttgatgcactcatctgttgattgacacatgggtttattccgtctcttggaaactgagtagtgctgcagtgcacagtggggcaggtatcccattgatgggtacacacccagtggtgggatgactagatcctgtacaccattctttcctctgatgtttcgcaggcccatgactggacctttggaacgtcttcactgtgtacaaggtggtggtcccttggccacattcttagggaacgtcttcaatgtgtacatgacggccgtcccttggccacatgctcagggaacatattcagtgtgtacttggcagtggtcccttagccacattattagggaatgtcttccgcgcgtacacagtggcagtccgttggccgcatgcgtagggaacgtcatcagtgcggtccattggccacatgcttagggaacatcttcagtgtgtacatggtggtctcttggccacattcttcgggaacgtcttcactgtgtacatggcggaggtcccttgggcgcatggttagggaacgtcttcagtgtgtacatggcggaggtcccttatccacattcgtagggaatgtcttcaatgtgtacacggtggcagtcccttggctacatgcttagggaacatcttcagtgcggtcccttgaccacatgcctagggaacgtcttcagtgccgtcccttggctgcattcttagggaacgtcttcagtgtgtacatggtggtggtcccttagccacctgcttagggaacgtcttcaatgtgcacatggcagcagtcccttggccacattttttgggaacatcttcagtgtgtacatggcggcggtcccttagccacattcttagggaatgtcttcagtgtgtacacggcggcagtcccttggccgtatgcttagtgaacgtcttcagtgagtacatggcggcgatcccttagtcacctgcttagtgaacatcttcagtgtgtatatggcggcagtcccttaaccacatacttagggaacgtcttcagtgtgtacatggcagtggtgccttagccacatacttagggaatgtcttcaatgtgtacatggcagtggtttcttagccacatgcctagggaacgtcttcagtgttgtcttttagttgcattcttagggagcgtcttcagtgtgtacacggcagcagtcccttggccgcattcttagggaaccttttcagttcatacacagtggcggtcccttggcaacattcttctgagtgtcagtgtctgtctgtgtccttttcaccctgtaagctgcttttgtttcttcactgggtgtctctgactctcatgtggaatcccatttctctgtcaccgcctgtcccaggcacagtgagagacgcagccagcctgctcctctctgcacgtggccgtctcagacattctccagccaccgtcctgaccgaattcattccttcccctgccccgtccacattcttcttcccctacacgcttgctaccaagaaatggtctgaatcacagccaaggcttcatttgctttctggaactgcagctcccagccccacccagatcagaggttcagaacctgaatcttcggatttctggagatgcccccatcctatcagaggcttctagtgtgtttctttatattcgtgtagacttgggaggatgacaggaaagaaacctttgaaggtggcctgtgcagttccagggcccagggtggaaggggcttgcatccctggctgcctttgtgcacctttcattcttgatgcaacttttttttttttttttttaaagatggagtcttgctgtattgcccaggctggagtgcagtgctgtgatctcagctcactgcaccctccgcctcccgggttcaagcgattctcctgccacagcctcctgagtagggagctgctaaaataaaataccttcagttgggtaatttataaactacagacatttgtcactcacagttctaaaggttggaggtttaagatcgtggcggattcagtgtctggtggggacccacttcctggttcatagatgatgcattttctctgcgtggaaggggcgagggagctctctggggtcccttttataaggacactgatcccattcatgaggctcgatccccatgatctcatcacctcccaagtctcccacctcctgactccattgtcttaggggtgaggatttcaatgcaggaatttgggggaggaatacaaactttcagactatatatagcaaataccattctttaaaaacatacagtaatagttaagctttttttttttttaatttgataaattttccaagaaggaggagacacagaaaccctccttgctttgaaggtgaatgttagtgctgtaaaatatacgtgggacttgggcttataaaatcttggtcacggtaaaatataggtggtacgcagaacctgggaaagcccacctttcctttttctgacatgtaacttttgtggaaattgcctaaaattgtttatagttagctcttcagtcctgtgtccaacccagcatgtccgatactatctaacattctttttttttgagacagagttttgctcttgttgccaagcctggagtacagtgacgcgatcttggctcgctgcaaccttcacctcccgggttcgagcgattctcctgtctcagcctcctgagtagtttggattactaaattttatataaatgttgtgtcaagaaataatattgctcttttgactttttttccctaagcattgagaaattcagaaaaaacatttataaacataaacactgttcttgacaagtgggccttccaaaaataagggctggagtttgttgaaactgctctactgtgttttatttatttatttatttattggtacttttttccttttttttttgaggcactaattggaatgcacttatttgtcctgggtggagaaacaattcagatctaacactgggggctctgtgtttccttaggtaacgcatgtgaggttttcgtcagtgtaattcggtaatctgtgttagtattattacaaaagagcaggggggcatttgtgtcttctcagaattgcttattaaaacagctgcatggccaggcgtggtggctcacgcccgtaatcccagcactttaggccggtggatcgcttgagtacaggagattgagaccagcctgggcaacatggccaaactccatctctactaaaaatagaaaaaattagtatgtgcttatattcccagctactcaggaggcagaggtgggaggatcacttgagtgtgggagttggaggctgcagtgagctgtgaccacagcctgggcaaccaagcgagaggtgctgtgtctaaaaatacaaacataaaaattagccaaatgtggtggcacgcgtgtgtggtcacagctacttgggaggctgaggctgaaggatcgcctgagcccaaggaggttgaggctgcagtgagctagcatcatgccactgcactccaggttgggcaatcgcctgggtgtgaccctgtctcaaccacaataaatttaaaaagataggaaatttcaatatgaaaatcagtgtcccccagaatgttccatttcttcccagctgggctatttttggagttctatggggagctgtctcagtgcaccttgcatgtactcaggaggatgagccctgccatggtgtgtgttaggggacagcctgatctcaccaaccctcctgagcaggcccggccctccgagtaataactgggaacactcgccgctttgtgagatgacctcgtgtgatcatttgaaggtcgtctcttctggtcagggtgcagagtggacacatttttttttttttttgagacagagttttactcttgttgcccaggctggagtgcagtggtgcgatcttagctcactgcaacctccacctcctgggttcaagccattctcctgtctcagcctcctgagtagctggcattacaggcgcccgccaccacacccagctaatttttgtatttttagtagagatggggtttcagcatattggtcaggccagtctggaactcctgacctcaggtgatccacccgcctcagcctcccaaagtgctgggatgacaggcgtgagccaccgcgcccggcccagtgtggatacaccttgagcacataactggaatcctttccttggaaacttggaaccccttgtgtcatggtcgtgtaaactgtgttgaattaagaagagacaccattaaatatgtcacagctgtcctcaaaactgggacttgttttgctttctgcctggaaatgcgagtcatttttatagaaaatgtattgttcattaacaaaaaataatcgtatacatatatatgaggtacgtgatgttttaatccaagtacacattgtgcggtgattaaatcaagctagatactatattaacaatcaagtcaattaacatattaataatcaagctaataaacacattaacaatcaagctaattaacatattaacaagctaattaacatattcacataaccttaactctaacctatatcacctcacctacttttttttgtggtcagaatatgtaaaatctacttttagtcattttgaaagatgcgatgtattattaactatgatcactgtggtgtgatagatctttgaatttatttcttttatgtaactgaaaaaatttaattttaatgtaatttatatttttttgagacagtctcaccctatcacccacggtggagtgcagcgtcatgttcatagctcactgcagcctccaactcctggctcaggtgaccctcctgagcctcccaggtagctgggactacaggtgcacaccaccacacctggttaatttttaaattttttatgtagatgggatcttgctatgttgctcaggctggtcttgaattcctgggctgaagtgatcctcctgcctcagcctcccaagtagctgggactacaggtgcatgccaccatacccagctaatttttttgtttttgttttttttttagagatggggtttcattacgttgcccaggcttgtctcaaacttctggccttcagtggtcctccttcctcagccttccatagcattgtgattccggacataagccaccgctcctggcctccaactgaaatgttatgttctttgacaaacacttcatgaagcattcttccctggcaaccaccattgcactctctgcttttatgcattcagcttttttagattctacatacgagatgatatggtattctctctgtgcctggtttatttcacttcacattgtattttccagtcccatccatgttgttgcaaatggcaggatttcctttttcatggctgcatactattccactgtgtgtctatgccacatttgcttgaggcactcatgtgttgattgacacatgggttgattctatatcttggaaactgtgagtagtgctgcagtgcacagggggtgcaggtatcccgttgatgggctgatttcctttcctttgggtacacaccttatggtggaataactggatcctgcacatcattctttcctgtgatgtttcacaggcccatgactgaaccttggggaatgtctttactgtgtacaaggtggcggtcccttggtcatattctttggaaacatcttcagtgtgtatacggcgttggtcccttggtcacatgcttgggaacatcttcagtgtgtacatggcagcagtcccttagccacattcttagtgaatgtcttcagtgtgtacacggtggcagtcccttggctgcatgcttagggaacgtcttcagtggtgttccttggccacattcttagggaatatcttcagtgtgtacacggtttgtgtacagggcggtggtcccttagccacaagcttagggaacgtcttcagtgctgttccttggccacattcttagggaatatcttcagtgtgtacacggtttgtgtacagggcggtggtcccttagccacatgcttagggaatgtcttcagtgtgtacccgtggcggtcccttggcctcatgcctagggaatgtcttcagtgccgtcccttggctgcattcttagggaatgtctttagtgcgtacatggcttcagtgcgtacatggcggcggcccctcagccacatacatagctaacatgttcagtgtgtacactgcaacggtcccttggccccattctttgggaacatcttccttgcggtcccttggctgctttcttagggaatgtcttcagtgcctacacagtggcagtcccttgtccacattcttagggaacgtcttcttctgtacatggtgtcgatcccttggccacattcttagggaacatcttcagtgagtacatggcggtggtcccttggccacatttttagggaacttcttcagtgtgtacatggctaccgtcccttagcccatgcttagggaatgtcttcagtgtgtacatggaggtggtcccttggccgcattcttagggaccgtcttcagtgtgtacatggcggtggtctcttggccgcattgttagggaccatcttcagtgtgtacatggcggtggtcccttagccacaagcctcgagaccgtcttcagtgtgtacacagctgtcgtcccttgggccacatgcttagggaacgtctgcagtgtgtacacggtggcggtcccttggccacattcttagggaacgtcttcagtgaggtcccttggccacatgcttagggaatgtcttcagtgcctacacagcggcagtcccctgtccacattcttagggaacgtcttcagtttgtacatggtgtgggtcccttggccacattcttagggaacatttttagtgtgtacatggcggcagtcccttagccacattcttagggaatgtctttagtgtgtacatggtggtagtcccttggccgcacacttctggaacgtcttcagtgcggtccctttgccacgttcttcgggaacatcttcagtgtgtacatgatggcggtcccttagccacaaacttagggaatgtctttagtgaatacacagcagcggtcccttggctgcattcttagggaacgtcttcagtgcggtcccttgaccacattcttaggaaatgtgttcagtgtgtacatggcgtcggtcccttggccacattcttagggaacatcttcagtgtgtacatggcggagtcccttagccacatgcttagggaacgtcctcagtgtgtacacggtggcagtcccttggccacatgcctagagaacatcttcagtgctgttcctttgctgcattcttagggaatgttttcagtgtgtacacggtggcagtcccttggctgcatgcttagggaacgtcttcagggtggtcccttggccacattgttagggaacatcttcagtgtgtacatggcggtggtcccttggccgcattcttagggaacctcttccttgtgtacagggcagcggtcccttggccgcattcttagggaaagtcttcagtgtgcccacggcagcggtcccttgggggtgaggatttcaacgcaggaatttgggggaggaacacaaactttcagatagtagcaaataccattctttaaaaaaatacagtaatggttaagcttttttttttcttgattgataaattttccaagaaggaggagtcaaagaaacgctccttgttttgaaggtgaaggttagtgctgtgaaatacacataggacgtgggcttatataaaaatcctggtcacggcaaaatataggtggtacgcagttcctgggaaagcccacctttcctttttctgacatgcaactttttcggaaattgcctaaaagttgtttatagttagcccttttcggccctgtgtccaacccagcgtgtccggtactatctaatgttctttgtttttgagacggaattccactcttgttgcccaggctggagtgcagtggtgcgatcttggctcactgtaacctctacctcctgggttcaagcaattcccccgcctcagcctcctgagtagctgggattaccggtgtccgccaccaggcccagctaatttttgtatttttagtagagacggggtttctccatgttggccaggctggtctcgaactcctgacctcaggtgatctgcccgcctcggcctcccaaagtgctgggattacaggtgtgagctactccgcccagcctaattttttattatttttaatttttaacattttttttttggagactgggtcttgctgtgtcccacaggctagagtgcagtggcatgatcatggctcactgcagctttgacctcctggactcaagccatgctcccacctcagcctcatgatagctgggactccaggtgtgtgccatcatgcccaggcaagtttttaaaaaaattatttgtagagatggcgtctcactatgtttcccaggttcgtctggaactctgggcctcaatggatcttcccacctgggcctcccagagtgctgggattacaggcatggggcacagtgcccagtccctcatgtgtgtaattgttcaacagctagagaaacccaaacacataccctcagacactgtcccgtctgccgcccaggtctcctcacctgcatggtttgctgttgccacttgatttaatggagggcataatgaatgacccttaaacacggcctctaagagtcctcgtaagtgccttcctcattaaaattcaagaggaatcaaatacctgttactgaatataaatgtttagaggagaaagcctgtgagctgagagtcatatcttaaggggtgtgtgcttgcagaattatcacattttcaatttcatgtgtgaataaattgttgtatttgggatcaccaagaaggcagaaacatgtatcaatgaaatttagtagacggctaaaaacaaacagtagcagcctactgaggggctgtggaataagcagattttagatttttagagggaaaacggtgatggtaggttatttccccaatggcttccaggcctccaactcaggcttggaattggccatggtcattggccctttttttttttttttttctttttgagacggagtctcgctctgtcgcccaggctggagtgcagggtgtgatctcagctcactgcaagctccacctcccgggttcacgccattctcctgcctcagcctcccgagtagctgggactacaggcttccgccaccacacccggctaattttttgtatttttagtagagatggggtttcactgtgttggccaggatggtctcgatatcctgacctcgtgatctgcccgcctcggcctcccaaagtgctgggattacaggcgtgagctaccgtgcccggcccattggctcttttttttaccatctcatcttctctcacacgagttattctcactgttggaaagaacttgtccttaaagcattgcttccaggtgagtgtaacggtgcccagcatgtgatacaagttaaaaataagagcagagcccaaatgctgtcattgcttgatccatcatttcccctgtcatgcagctcatttgagtaacagggtctcgtttcggggtgctgtgtccggagaggcagaactccccttggagaatgggtagagaatgtacatcacttgccaagtatggtggttttgcatgctgccttgactggacttgtttgcctttggttttctgtaagaatcttaggatatctgcccaggagttagacccctgggctaaagtaaggttgagggccagccacggtggctggtgcctgtaatccctggactttcggaggctgatgtgggaaaatcacttgagtccaggagtttaagaggagcatgggcaacgcagtgagacccccgtctatataaaatttaaaaaaaattagctggacatggtggtgtgcatctgctcccagctactttggaggctgaggtgggaggatcactggagcccaggaggtggaggctgcagtgagccatgatcacaccactgcactacagcttgggtgacagagccagaccctgtctctacgaaacacaaataaaaagtaaaatgaggttgagaaactccgcctccctcttgatttcaaggtaatactcagcttctagattgacacacacacaagtcattgtcttatcatagtgacatgtgacggaacacgcacgtgtctggtgacagatggtgcattgaggggaacattccttaagctgtgtttccttggggaaagaggcaatagcattctctgttagtacagaacccttcagtttgtacaaatgtcttcggaaagggaatattcctgagagcttctacgtggcagttaacaagtcacacttttcatctcagatgtctcaatttccagaagatggtacttgattacatttcctggggttcttgtttctaggaaatcgcggctgggtttttctagaaataatgcagtgatttggggacctgtggcactgggaagggtatgatctcaggcacaggactgcaaagacacgttgtttaccggccagcatgataactaggcgtgacgctgatggccagtgtgttgcatacgtactgggctttattatccatacctggatggaactgaatatatatatatacacacacacatagacacccataatatattatacaatgtaattatatatcatcatatatcatatatattataatatatacagttgacctttgaacaacacaggtgtaaactccataggtccatttatatgtggattttctgccacctctgccacccccgagacagcaagaacaaccctttttgttcctcctcctcctcctcagcttcttcagcatggagacgatgaggatggagacctttaggatgatccacttccactcgatgagtagtacatatgttttctcttccttaagattttcttaatagcattttcttttctctagcttactttactgtaagaatgcagtatataatacatagaaacacaaaataaatacaaacatgtgttgagaatgtagtatataatatatataaatacaaaatacatgttgattgacagtggcatgatctcagctcactgcaacctctgccttctgggttcaagcaattcttctgcctcagcctcccaaatagctgggcctacaggcgcacgccaccacacccagctaattttttttgtatttttagtaaagacggagtttcaccatgttggccaggctggtcttgaactcctgacctcgtgatccacctgcctcagcctcccaaagtgctgagattacaggcgtcaaccactgtgcccagccgtgtgagtctttatggtagaacaatttatattcctctgggtgtgtacccaataatgagattttcagtagactttgagtgaagccgatagctgttcataatgtgggtgggccttgcctaatcagtggaaggtcttaagaggtaaaaagagtccctcctccaaggaagagggaattctatctggaatccaccttcagacttgagctgcgacatcatgtctccatgggcatctggcctgctggtctaccctgcacattttggttttgcccctcccccacatcttgggagccagttctttaaaatctctttctctctatatatatatcctactggttgtttctctgcagaactgtcactcatgcagatctgtgtccacagatgacatcattgcaaagccactaagagagacatagcatccagggaatggaaggaccaggttcctttcagacttgaagacacgtcaaaacacattccaccgcgttgccttggagaacccagggaccaggcctcttcccctcctgtcaaatagtccttagcctttgttcttcttgctccttgtgaatttcacaggcttccttgactttgaattctgctccttggatgtctttgttggtgaacgtgatgagatagaattttggaaagctccgaggtgtgatcattgcaccctgggactgacacgtgctccgtcttcactgaagacagccggaagccgtggtgttccagaacttgaatgtggctgtggaaactagagtgtccatgcatcctgggcggtagctactggtgccgtctgcgtcgtctgtagctcctcattgctgattctcattcggctgcctcagtcaggacagggctggttacagcgttgctcttcatgctgttcaagtcagggtgatctacagggacagaacgaataggactgatgtgtatatgaaggggagtttactaggataattgactcacacgatcacaaggtgaagtcccacaataggccgtctgcaagctgaggagccaggaagccagtccaaggcccaaaacctcaaaagtaggcaagctgagagtgcggccttcagtctgtggtcgaaggtccaggagcccctggcaaatcactggtgtaggtccaacggtccaaaacccaaagaccctggggtcttgatgttcgagggcaggaagcatccagcatgggagaaagatgaaggctagagatcccgccactgcactccagcctgggtgacagagcgagactccgtttcaaaaaaaaaaagaaagaaagaaaaacatttaaaaagcagaaatgagctggatgcggcatcttctgcttgtaatcccagcattttgggaggccaaggtgggtggattgcttgagcctaggagctcgaaaccagcctgggcaacatacggagaccctgtctctacaaaaaaacacaaaaattatctggccatgctggtgcacacctgtagtcccagctactcaggaggctgagatgggaggtttggttgagcctgggaagttgaggctgcagtgagccatgattgccccactgcactccagcctgggtgaaagagtgagaccttgtctcaaaaaaaagaaaaagaaaaaagaacaaataagaagacagacacacctctcttctttgtgtgggtacagccgttggcaaactttgctgacagatgctactgaccttgttttcctttctgcattctgttcatttcaaaagtgggtaaatcagaagtgggactcactgtgaccttcagtgactcaatgctgaattcacaagattaattggagagtgtgaagaatgcagggcatccgtggacccattttaatgaattttagcatctcttgcatccttgtatccttgcatccagtaccggtccccagccttttagtaactgggctgtgcagcaggaggtgagtagcgtgtgagtgagcaaagcttcatctgtattgacagctgctccccatagctcatattacctcctgagctctgcctcctatgagatcagtggtggcattagagtctcataggagcatgaaccctactgtgaactgaacatgtgagggacctaggtggcgtgctccgtatgaaaatctaatgcctgatgatctgtcactggctctcatcacccgcacgcagatgggaccgtctagttgcaggaaaacaagctcagggcttccactgattctacacgatggtgagtttcataattacttcattctctattacagtgtaataataatagaaataaagtgcatgataaatagaatgcacttcaatcatccccaaaccatcccccaccccacatcagtggaaaaatggtcttccatgaaactggttcctggtgccaaaaagcttgaggaccactggacaaaggaacttgtcagagtatggattgaaggtctttattgatgctttgctgtcactcttactttaagatgaatgcgtatatatatgtatatacattctgtaatgtgtgaatatatgaagctccagctgctctctccctctctttcctctgcagtccaattctcgtagatcagtcttttcctgaaatgaatgacctcttaaattttattttatattttaagcttttatgttattttactttatttttaagctgtttttattttttaagcttttttttttttgagacaaaaaagtctcgctcttgtcacccaggctggagtgcaatggcatgatctgagctcactgcaacctccacctcctgggttcaaaaaattctcctgccccagcctcctgagtagctgggactacaggcgccagccaccacgctgggctaatttttgtgtttttagtagagacagggttttaccatgttggccaggctggtcttgaactcctgacctcatgatccacccacctcggcctctcaaagtgttgggattacaggtgtgagccaccacaactggccagtttgcaggtctttgttgatgctttgctgtcaatcttactttaagacgaatgcatatatatgtatgtgtatacattctgtaatgtgtgaatatatgaagctccacctgctctctccttccctctcctctgcagtccagtactctcctagatcattctgttcctgaaatgaacgaccattttttttttttttattttgagatggagtcttgctctgtcccccaggctggagtgcagtggcgtgatctcggctcaccgcaatgtccgcctcctgggttcaagcgattctcctgcctcaccctcctgaggcaggattacaggcgccagccatctcgcccggctaattttttaatttttagtagagatggggtttcaccatgttagtcaggctggtctcaaacttctgacctcaggtgatcagcccaccttagcctcccaaagtgctgggattacaggcgtgaagccactgcacgtggccggtttgcagtctttattgatgctttgctgtcaatcttactttaagatgaatgcatatatatgtgtgtgtgtgtgtgtgtgtatgcattctgtaatgtgtaactatatgaagctccagctgctctctccctccctctcctctgcagtccaatactcctagatcattctgttcctaaaatgaatgaccattcaggttttttttttttttttctgagatggagtctcgctctgtcacccaggctagagtgcagtggcatgatctcggctcactgcaatgcccacctcccgggttcaagcgattctcctgcctcggcctcccaaagtgctgggattacaggcatgagccaccgcgcccggccagaattcagttttttttttttccccatggttatccaatagcacacaggctcgtgaagccttcaaggtgcttcatctgaggttcgcttagaatggttgccacatattgttctgccggtgagttttcatgaattggactctgaaggttcttaattatggtggttgagtgacacggtctttcttctataagaacctaagttacactgcatatcaggaaaatgtgttcctgggaccagctttgttgggtttttggctgctggtcatcttcactttactctcccaaatttgaggactgtgacacacacacacacacacacacacacacacacacactctctctctctctctctctctctctctgtctctcttaggaaacaatggtatatcaacaatgaaatgatgcttttttttcttcttcttttttttttgagacagggtcttgctctgtcacctaggctggagtgcactgatatgaacatggctcactgcagccttgctctcccaggctcaagcaatcctcccacctcagcctcctgagtagctgggaccacatgggcacaccatcacacctggataatttttgtatttttagtagagacggggtttcactatgttggtcaggctggtcttgaacttctgacctagtgatttttctacctcggcctcccaaagtgctgggattacagacatgagccaccagactcggctgagcatcttttcaatatgaccttgtgtccgggcatggtggctcacacctgtaatcccagcactttgggaggctgaggtgggcggatcacgaggtcaggagatcgagaccatcctggctaacacggtgaaactccatctctactaaagatgcaaaaaaaattagtcaggtgtggtggcgggcacctgtaatcccagctactcgggaggctgaggcaagagaatggcatgaacccaggaggcagagcttgcagtgagccgagattgcaccactgcactccagcctgggcaacagagcgagactcggtctcaaaaaaagagaaaggattcaaggcagtgtataccaaacatgaaagtaaagttcaggaacctctttgatggaggagatgacggtggggtctgtagcctgttcatgcctataattgcaacacgtcgggaggccaaggtgggaggatcacttgaggccaggagtttgagatcagctcggccaacatagtgagaccccatctctacaaaaataaaaataaattagtggggcatggtggcacacacctgtagttccagctacttgggggactgaggcaggaggatcacttgaaaacaggagtttgagatcagcctgaacaatggagcaagaccctgtctctacaaaagattaaaaaaaaaactggcagatgtgctggcacgtgcctgtagtcccagctgcctaggaggctgaggcaggaggattgcttaagtctgggagtttgaggctgcagtgagctgtgttttcaccactgcactccagccggggtgacagagcaagaccctatcagtagtagtagtagtaataataataataataataataataataataataatatgttgctgcaaaagtaattgctgcttttgccattaacttttgcaccaacctcatgataaaacaacaaaaactcaacacctgtacctgccatgccctgaagctcatgacagtagacaaaactcactgtgtctccagccctcagtgttagatgaagggaccagggtgtgggaagatcagcagttcaaacgggaatcataaaacacatagtttttatttttttagttttgttttattatttatttatttatttttgttgttattatttttctgagatggagtctccctctgtcacccaggctggagtgcagtggtgtgatctcggctcactgctacctctgcctcccgggttcaagtgattctcctgcctcagcttcccgagtagctgggattacaggtgcgtgctaccatgcccggctaatttttgtacttttagtacagacggggtttcaccatgttgattgggctggtctcaaactcctgacctcgtgatccgcctgcctcggcctcccaaagtgctgggattacaggcgtgagccactgcgcccagcccccatgaaacatatagatattttcaaaacaactgtactaggatcaagaaggataggacttttgtttttcctgttttttaagaatgaaatatcatatggcgtaagcatagatttatttatttacttacttatctattcatttatttttagagacaggatcttgctctgttgcccaggctggagtgcagtaatgcaatcatagctcactgcagccttcaagtcctgggctcaaacaatcctcccatctcagcctcccacgtacctgggactacacatgcaagccaccatgcctggctaagttttaaatttctttgtagagatggggtcttgctatgttgcccaagctgatctcaaactcctggcctcaagtgattgtctcaccctgacctcctaaagtgttgggattacaggtgtgacccactgcttcctgcctagactttttttttttttttccaattaaggtttttactttgagatcattgtagatttataagcagttgtaagaaataataggaaagaatcttgtgtctacttcccccagtggtaacatcttggaaagcaataataccatgtcacaaggaggatattcacattcaggcaataatgcattgatcttatgttttactcgtatccgtgtgggtttttgtaccgagttctgtgcaatttcatagtgcgtgcaggtttgtgaagccagcattgtccgcaacacacagagcatttctttcaccaacaacccctcctgtttctctctctgcatcctacctcaacctcctctcccgtcctgaacccctgagaattactagtctgttctctatttctgtaccaacctgcatcctacctcaacctcctctcctgtcctgaacccctgagaattactagtctgttctctatttctgtaccttttctcatgtcaagaatgtcatataaatggagtcatacagagtgtaacccctttcaaatcacgtgtgtctttttttccttcactcaatagaattccctggagagccatccaagttgttgctaagaacaataagatgtttctttttaagtaacacctgcaaaaagtcttttataaaatggcgatgaaactaaatggtttttgattctaaacaaggcagccatgaatggttttctcgtatatcttagcatatgtgtgggagtgtatctgtgcaagtaattcttggaagtggaatagctgagccaaaaagaaaatgcatgtaaattttcttttctttattttaaagagacagcgtcttgctctgtcacccaggctggagtgcagtggtgcaatcatagcttgccgcagcctcgacctcctgggctccagtgatcctcccatttcagcctccagggtagctgggactacaggcgagcatcaccacgtctggctaatttatttttatttttgtagaggtagggtcttgctatgttgcccaggctgggcctcgtgctcctagcctccgctgatcctcccaccttggcctctcaaagtgttgggattacaggcataagctaccaggcctggctgcctgtcacctttcaggagtcattgtcaacttatctcctaagaaaatgcagtcttggtgggtacatttgaactgagtatgtaaacttctaacttctccaaggcatacgcattctggataacaaccctactttttaacctattccatgtgattgatgaaagctcacaattgctttattcattatttcattgtcagcgagactgaactttgtttcatatgcttatgttttatttcatatctccaaattgcatattcatttcctttacccatttgtggagggactggggtttggttagaagagctctttatagaccgggcgcggtggctcacgcctgtaatcccagcactttgggaggccgaggcgggcggatcacgagatcaggagatcgagaccatcctggctaacacagtgaaaccctgtctctactaaaaatacaaaaacaaaattagccgggcgtggtggcgggcgcctgtagtcccagctactcgggaggctgaggtgagagaacggcgtgaacccgggaggtggagcttgcattgagctgatattgcgccactgcattccagcctgggcgacagagcgagactccatctcaaaaaagaaaaggttagaaaaatacaccatggaatactacgcagccataaaaaggatgagttcatgtcctttgcagggacatggatgaagctggaaggcatcattctcagcctaataacgcaggaacagaaaaccaaacaccacatgttctcacttacaagtaggagctgaacagtgagaacacagggacgcagggagggggacatcacacaccagaacctgctgggggctggggaacaaggagagggagcgcattaggacaaatacctaatgcatgcagggcttaaaagctagatgatgggttgatgggtgcagcaaaccaccgtggcacatgtatacctatgtaacaaacctgcgcgttctacacatgtatcccagaactttaaaaaaaaaagaaatagtatttcaatatggtctgaattaggatgtctgttattagatataaaggagaacatatgtgttgagggccatttgagcctgttctgtatataaactcttatttttgcccttttctttgtagcatgtttggggtttttctggagttgaactttttagatatctgaaaaatagctgttaatatttctgatggaagttgcaaattttcttccagctcattatttattttttactttgcttatggagatttgttttgttttttaccatgtgattttttttttgagatagtgtcttgttcctcctggagtgcagtggcacgatcttggctcactgcaacctccatcccttgggctcaagtgatcctcccatctcagcctcccagcttgctggaactacaggcacgcaccgccacacccggttaattttttaaattttttgtagagatgaggcctctctctgtttcccaggctggtcctgagcttttggcctcaagcgatacccccacctcagccctcaaagtgctgggattacaggcatgagccactgcccggcctgttttttaaacaagtagttttttaaatagtgaaatctatctaaccatctttctgaattttcgtttaggaagcattttctttctgtggaggttaaactaatgattcctgctttcttgcaatcttctcatggtttaactttgtttttgccttggagttcactcatgcatgctatgaggtctggcactaattttatctgtttcctaatgtggcttcacgtgccccaacacggtttattaaaacgcccatcttttgccccttttgtcgtgtactcaatttccacatgcagttggcctatttttggaaattgtaccctgttccttcctccattaatgcctgtagtacctcccgtttaattatagaagcttctcaaatgttttaatctcctacagggccattgtgttctcaatctttgtacatatcagaattttcctctttgccgcctcatttggaattcttttccccacagcaattttcgaatcgattcgtccagtttgcctaaaagaaattctgtgaactatctttattggatcacatcaaatttgcatattgacttgggtcattctgacacctttaggattgtatcagtttagattttttttccccctccaacttctattttattttttaaattaaaaaaaattttttttttgagacggagtctggctctgtcgccctggctggagtgcactggcgtgatctcagctcactgcaagctccacctcccgggttcaagcgatcctcctgcctcagcctcccgagtcgctgggattacaggtggcacacaccaccacgcccagctaaattttgtatttttagtagagatgcggtttcaccatgttggccaggctggtcttgaactcctgacctcgtgatccacccgtctcggcctcccaaagtgctgggatgacaggtgtgagccaccgcatctggcctcaacttctattttaggttcgggggtacatgtgcaggtttgttccctgggtatattgtgtgatgttgaggtttggagcacaaggatcccgtcacccaggtagtcagcacagcactcaatagttttccaacccttgccccatcccttccttgccccattgaattgctcagtgtttattgttcccatctttatgtccatctgtacttgatgtttacctcccagtaagaagtgagaacgtctgatatttagtttcctggttctgtgttaattcacataggagaatggcctcctcttgcatctatattgctgcaaaggacatgatttcattctttttaatgggtgcatagtattccatggtatagatgcaccatgtcttcctaagaattgaattaacatttgagccagcaatcccattactgggtatctacccaagggaaagtaagtcattctaccaaaaagacacacgtactgtgtgttcatcgcagcactattcataaaagcaaagacatggaatcaaacttaggtgtctgtcaactccggattggacaaagtttgggggttttttttgtctttttttttttttttgtgagatggagtctagctctgtcgcccaggctggagtgcagtggcacaatctcggctcactgcaagctctacctcccaggttcacgccattctcctgcctcagccttccgagtagctgggactacaggcgcccgccaccacgccaggctaattttttgtatttttagtagagaccgggtttcaccgtgttagccaggatggtgtcgatctcctgacctcgtgatccacccgcctcggcctcccaaagtgctgggattacaggcatgagccaccgtgcccggccgtcttttttttgttttgttttgagacagtcttgctctgtcacccaggctggagtgcagtggtatgatcggagctcactacagcctcaacctcccagtcttgcgtgatcctctgaactcagcctcccgggtagctgagatgacagccgtgtgccaccatgcctggctaatttttttgtacctttttttttgttttgtagcaatggggcttcactatgttgcccaggctggtcttgaactcctgggctcaagcgatctgcctgccttggcttcccaaagtgctgggattacaggcatgagccactgcgcctgacccatttgggtctttggagaagcacacaccaagaaggaacatgatgggccagagatttactaggggaactgtgtgtgaagggtcaaacaggcgctggcagaagagtggaggaaggcttgcaggtgatggtgtaggtgcctcacacctgtgaagaaagagacggcgaggaattgggtagaaggagcgtccagccagttctctggtcatgccgagtcattggctgtgaaaacccaaaaccctgaggaagcccgatcttgcgaaacatgttccccatctgcagaggcaccgggtggctggtgtcaggcgattgttgcaacctgttgtgtgcgggggtgtctgtgtgggtacatacatacttctcagccccaatgccagcttcctggtccgtaaggaaaacactaaactcttctagctaaagttacaaatgcagcaagggtccattctgcaatctgtgatgcttttttttttttttttgagctggggtctcgctaccttgcccaggctgcggtgcagtggcacaatcacggctcactgtgcgttttcagggaagaccccacgggcacctccaaaaccatgtggcatgacatcctcaccgagacccgagggcatctttccatggcctcaactctacttttatgtctttaggtttcctgatataggttttgcacactctcgatgaccaagtctcatttcagtgttgctgttgtttctatattataagcaggactgtctcttcccctacctttttaacctgccaattgtttgtgtatgtatggaagctattgatatttgcttctgagttttctatctgactaccttcctgaattctcttcttggatttatttaatgttgattttgttagttttttcctggcataccatcatatcatctgcaaagtatattttgactctccctctgccgttcttgtgtctgttgtaattatttgtctgaccatgttggataagatctccagtagcatgttaaatgacagggtgcactcctggaatccagctctttgggaggccggggtgggaggatgacttgagccccggagatcaagaccggtctgggcaacacagcaagaccccatctttacaaaaaaaaaatagtaaaaaaaattagccaagtgtggtggctcacacctgtagtcccagctacttgggaggctgaggcaggaggatcatttgagtccaggaggtcgaggcttcagcgagccatgattgcaccactgcactgcagcctgggcaatgtagtaagaccccagctcaaaaaaaaaaaaaagcatcacagagaacaggatggatacttgctgcttttccaagtttagctggaagattttagagatttctttattgactaggaagttggcattggggctgagaaatatgtatgtacacacacagacacacccacacacagacacacatgtatacatacacagtatatatgcatactgtgtgtctgtaattacaatttaataatacattcctatttttaaaataaacttagtaaattaagaacatcaatacatctactgatactacatatagtatttgcaagtccctcagcttgggtcaggaacacgggaatgtcattgtacaggttctatcttcaggttacgagggatacaccagaaaacctaagcatatggaaaacttattcggcaattttctaagtgaacataccttttcatcgattcatgcgtgtatcaagaaaaacaaaatgaaagtcttacacaccaagaggattgttcgcacaatactgacaacgaaatgtacgggctgacaaataacagattatatgttgaagcctcctccacaggccccacctcctgataccatcaccctggcgattgtatgttctcaacataggaattattttggggggagaggagacacaacattttatacttggaaaggtgaaatggaaaagcagcataggctttattgttttattttattttattatactttaagttctggggtacatgtgcagaacgtgcaggtttgttacataggtatacacgtgccatggtggtttgctgcacccatcaacccatcatctacattaggtgtttgtcctaatgctctccctcccctagtccctcacctcctgacaggccctggtgtgtgatgttcccctccctgtttccatgtgttctcattgttcaactcccacttgtgagtgagaacatgtggtgtttggttttctgttcttgtgttagttcgctgagaaggatggtttccagcttcatccatgtccctgcaaaggacatgaacccatccttttttatggctgcatagtattccatggtgtccatgtgccacattttctttattcagtctatcgttgatgggcatttgggttggttccaagtctttactattgtgaacagtgctgcaataaacatacgtgtgtgtgtcgttatagtggaatgatttataaacctatttctatttaaattacctttgtatttttatagattttgtgggtatgagtacacttgtgttacatgaatatattgcatagtggtaatgtttgggctgttagtgaggccatcactcaaataacgtacatggtagccaataggtaatttctcatccctcatcccatcccaccctgtgagacttctgagtcctcgatgtctattttttatgctctatgtcgacgtgtacacattatttaattcccgcttataagggataacatgtggtacttgactttctgtttctgagccatttcacttaggataatggcctccagttcccttcgtgttgctgcaaaagacacaacatcattccttttcatggctgtgtagtattccatggtatatatgtgccatattttaaaaaatcaaattgtctgatggtggacacttaggctttatattttaataaagaacattccaaatatgttgaacaaaataatctcctaacttgaaaaagatcatatgtgcctataataattcacagaaagggactttcctgactacctgcctgcaaaatccacttttccctcagtctttctttctcaagggaattcatggaaattccctccttgaattttctcagcccccagtacaaggagtcattcttgcctcatcatgtccccctctctgtccttgtcttgtgatttctttttattttgaacgcgagaagtctgactcccaccagcacccctgtggccagtacctgtgagacatattctgaatccagcacctctcataccacctgtgctgaactgtggcggagctcccccgtcagtccctgcagctgcttcaggagacccttgatagccttgtcttcctccagctcaagtggattctccatgaatctattccttcctgtgaaacatatcacagattggctcagagccccgtgatgacgccctgtctgccagagagaagctcacgaactctggggtgcccctactccttcttccctcctctcttccctccttccatgtgcttggctccagctagccagccagccgccttcctcttcctggaatatcccaggcctgctagacttttgctctcaccgtcacaacatcagctcaggagcccctccttggaagattgttctctaaccctccgtccagaatcactgcttctccctttcctcttcttcctttgaagttcattcataactggaagatgtgagatctggaaagttctgcattattgccagacacatctgtgtatttagagtggttggtatctttcccaggggaaccaaatgtccttgaggcagacaacatgtttatctttgtctaattcatttccctgtatgctgggcacagagtgtgggctctacacatattttataaaagaaggagggaagggttagaagatggacagaaggaaggaggaagaaaggaaggaaagagggaggaaagaaaggaaagagggagggaaggaaagagggaaagaaggaaggaaagagtgagagaaggaagtaaagaggaaaggaagggaagggaaggaaggaaggaaaaagtgagagaaagaagtgaagaggaaaggatggaaggagaaaggaaggaaagggagggaaggaaaaaggaaaagaagaaagaaggagtgagacaaggaagtaaagaagaaaggagggaaagaggaaaggaaagaaggaaagagggagggaaggaaggaatgaagaaaagaaagagggaaggaaggaaggaaagaaggaaggaggaaggaaggaaaaagggagggaaggaaggaatgaagaaaggaaagagggagggaaggaaggaaggagggagggaaggaaagagggagggaaggaaagaatgaaggaaggaaggaatgaaggaagaaaggaaaaagagaaggaaggaggaaggaaggaaagagggaaggaaggaaggaaagatggagagaaggaagggaggacaagtggaaggaagaaaaagaaatacaaatctccctcaaaatgtggatcactcgtcttaaccagaaattcaagtgagatgctatctgcacgtgtgataccagcagctatgaagcaaactgtattaaccaagtcttttattttctgtgttctgatgcatgactttcatggccttgtcaaccctagagaccctgcccctcccatagctagcgaatccccagaggtggtgaagagcccacctatgaacctgtctttcatatgcaaacccatcaatccagaatccaccccccagccatctcctttattggggttgcatattccacgtcactctccacctgccctaaccaccccaaagccaggtaccagagagtcagggacagcccctatgccccagagcctgctgaaatcattcacactagccaactgtaagcctactcgcctgttccttcccttggaaaccacagtgagagctctggtctcctttgtcttcccacctgaccaaacttggtgcgcccctgtgtggtcctgagtggtgtcaacacgcccctcctcttgggacctgtgagtaacaaaccacttgcttaacggcagtctcctgatctgttggccccaccatacctacatcataataaagtctacattttacaacgcaaacgaacaaaaatgtcctgctcagtgctgccctgagagcagaggttattccaggattcttgctcgcctctgtaaagggtatccgttctgcagacctttctgccggtcacactgacggcatattgcagagcctgccagggactcacaggggatgacaggggatttatcaggtggttttttactgcactgtcattactgggggcgaatccactttaatacattcatgcctcctgagcctgtgggaattcaagaggaacagaaccagaaataaatgaaccataactccctttggcatcttgcctctctggaggcttaattcttacaaatatgtgctctgctttcaaatcttagtttgatgattttctcttcttctttttcagttttccccccacgacctgaccgtgtcgctatagtgacgggagggacagatggcattggctattctacagcgaagcatctggcgagacttggcatgcatgttatcataggtgatgacttttacagttacttgtgttttttgttttttcggtttttttttttttctgagacaggatcgcagtccgtcaacccgtgctggactgcagtggtgcaatcttggctcactgcagcctccacctcctgggttaaagtgattctcctacctcagcctcccgagtagctgggtttacagacatgcaccaccacgcctggataatttttgtatttttagtagagacagagtttccatatgctggccaggctggtcttgaactcctgagctcaagccatccgcctgccgtggcctcccaaagtgctaggattacaggtgtgagccactgcgcctggcagagttagttgtgtcttatacctaatgtgagctacttaggtgtcgattcagacatgtatgcaaatgttgatgtgcatatagaaaattcagtcagatccagaaagctcatgaaggtgatattcacaacctagaaaacacagaaaattgttgtacccttttggaagtagatatatattctgcttaaatattgatcctgtgtttctttcacatggtttactggaaaaaaataaccatatatctttatgactttactagggctgttataacaaagtatctcaaggagactggaggttgcttaaaaagccaaaatttatttttcacaattccagaggctggaagttcaatatcacagtgtaagtagggctggttcctcccaattccagaggctggaggttcaatatcacagtgtgagtaaggctggttcctcccgacacctcactccttggcttgtagacaccatcttctccctgtgtcctcacagggtcgtccctctgtgtgttttcatctcctcttctcctgagatgtcttagtccatttcaggcgctataacagaattaccatagaatgggcagcttatatacaacagacattgagtttcccacagtcctggaggctggatgtctgagatccaggtgtgggcagggctggttcctcctgaggcctctctccttggtttctctctgtgtcctcacagggtcatccctctgtgtgtgtccgtgtcctcatatgctctccttataaggacaccagttcaattagatcggggcccactctggtgacctcattttaccttaatcaccactttaaagaccttatttccaaacacagtcacattctgaggccctgggctttaggacttcaatttatgaattttgttcaaacacaagctcctaacagaatctgaacaatgttgcgggatacttgtttcttctgcaaccatgacctatagacactcacggtttgatttctgctcttctttttgaaaatttctctaaaagcttatcgtgatctctgactcctcttcctctgtgacctcttcaggtctcccttcaactgggaatatgaggacagttcaaattaacccattccactactgccaatggagacggagtggggggcggggaggaggggagagagtctattgcatacctggggaagtctaaatcagctagcttaaatgatgtgtggagacgagcttggaaaaataaaagccttaatgtgtattatgcccactcttgacactatctgcatttaattaattattttcagacaggatcctactctgtcagcccagactgcagtgcagtgacataatcatagctcactgcaacctcaaactcctgggctccagcaatcctcctgactcagcctcatgagtcgctgatatgacaggcgtgcaccaccatgccaagctcattttatttatttatttattattgttttttttgagacagaatcttgctctgtcacccaggtggaatgcagtgacacgacctcggctcacggcatcccctgcctcctgggttcaagcgactctcctgcctcagcctccagagtagctgggattacaggcgcccgccaccatgccctgctaatttttgtatttttagtagagatggggttttgctttgttggccaggctggtcttgaactcctgacctcacgtgatctgcccacctccgcctcccaaagcgctgggattacagtcatgaaccaccgtgcctggccctggctcatttaaaaaagttattttggcggctgggcgtggtggcttatgcctgtaatcccagcactttgggaggtcaaggtgggcagatcacttgaggttaagagttcaagaccagcctggccaacatggtgaagccctgactgtcctaaaaacacaaaaattagctgggcttgggggtgagtgcctgcgtggtggtgggcgcctgtagtcccagctactcgggaggctgaggcaggtgaattgcttgaacctgagaggcggaggttgcagtgagctgagatcacgccactgcactccagcctgggtgacagagcgagactcagtctcaaaaaaataaacaaaatgttttggagatactgggtcttgctatgttgcccaggctggtcttgaactcctgggttgaagtgatcctcccaccttggcctcccaaagtgctgggattacaagtgtgagccactaggcctgggcaccctttgcttttaataacttttatggtgtctgcttttataaacatcatactgtaggtctggtttgagatatgcaggatcgtattgacttaacactttccaggacgggagcagtggctcatgcctgtaatcccagcactttaggaagccgaggcgggcagatcacgaggtcaggagatcgagaccatcctggctaacatggtgaaaccccgtctctactaaaaatacaaaaagtagctcggcatggtggcgtatgcctgtaatcccagctgctcgggaggctgaggcgggagcatcgcttgagccagggagccggaggttgcagtgaaccgagatcgcgccactgcactccagcctgggtgacagagtgagactctgtctcaaaaaaagactttccaaaaccaatgcccattattgattgacttcttcctctccgccattctctgtccttctttcccttgttgtcattatggaaagatgatcatggatcataaacaatgcttagggctggagatttcaacatgaatttgtctcagttcttccttatctttgaggagctctgtccaggacagacacttttctgggccttgaatgcctttgcgatagcccaaaaggctcaagcataagagcatgagtctgatctggtgaccagggctcagcaaagagtctttccaggccttgaacctctggacatctgttggtgctcattggacaggctaaaagtcatcatgttacgaatcgatgaagttgacatgcagataaaaggtataaggaaaaaatgaactctccacatcattgtatgcattacatctatacgataaaaactgtgatatactcatgcgtttaaatagctgctctggtcctgggcctcatgcgtttcaatagctgctagcgttctgagcctcgatggccatccacttggctttgagttagctctctccaaaaatctccatggcagtttctgctggggcaaatgcacggctgctgcccacacctctgtgttttctcatcttcatttacaaaagaagaaaatgctaaccttgctgatgctaacctcctgaatttcatgcaggaatccccaggagtctttgactcagatggggaaaccccatgttcagcccatgtggccttctggtctccctggagatgcgtggtccatgtcagcgcacatggctccttgctccgtccttcacttaagtttgagcctttttggcttttgcaaaacatgaatgcaaaacttgaaatttttctatgtcatggctcttcccaactttcacatttttgagacagcgtctcactctgtcacccaggctggagtgcaatggcgtgatctcagcccactacaacctctgcctcctgggctcaagcgatcctcccacctcagcctcccaagtagctgggaccacaggcgtgcaccaccaggcttggataattttttgtagttttagtagagatggggcctcaccatgttgcttggacttgtctcaaacacctgagttcaagcgatctgcctgcctcggcttcccaaagtgctgggattacaggtgtgagccactgtgcccagagtcttttaaaataataattttgtacacgcagttccattcctcatataaccatctttctctgatgcacttcagggtttgtaaaatagtatacagagatgtgtactgtttcacatgatgaagcttagttgtattagataatgataacatcgtgtttggctatgtcataatgaggcaattgagtagaatataatgaaatcttgttggattagttaatgacttgttgagcttcggaagcaggtgagcactttttggtctatatcagtctctttctttccatcaagcagttattttcctcaaagttgtgcctaactcccacttgagcattttttttatccattctttttttttttactttgacatgaagtctcactctgttgcccaggctggagtgcagtggcgcgatctcagctcacttcaacctccgcctcccgggttcaagcgattctgctgcctcagcctcctgagtagctgggactacaggagcacaccaccacacccagctaatttttgtatttttagtagagacggggtttcaccatgttggccaagatggtctcgatctcttgaccttgtgatccacctgcctcagcctcccaaaatgctggtattacaggcgtgagccactgtgcccggccccattctctttattttattttattattttattattattattattattattttttgagatggagtttcgctgttattgcccaggctggagtgcagtggcgcgatctcagctcaccgcaaactctgcctcccgggttgaagcgattctcctgcctcagcctcccaagtagctgggattacaggcgcgtgccagcacaccaagctaattttttgtatttttagtagagggggggtttcaccatgtaggtcaggatggtcttgatctcttgacctcgtaatttgcctgcctcggcctcccaaagtgctgggattacaggcgtgagccactgcgcccggcctcattctcttaatagactgggacaagttaaaactttatgacaatttcttgaaattgtcaagttcatccatgtccctaactctcctgtcttggtgtgtttgggctgctgtagcctgagtgccttgcaaaccatagaaactttttttttaaaattttattattatactttaagttttagggtacatgtgcacaacgtgcaggtttgttacatatgtatacatgtgccatgctggtgtgctgcacctattaactcgtcatttagcattaggtatatctcctaatgctatccctcccccctccccccaccccacaacagtccccggtgtgtgatgttccccttcctgtgtccatgtgttctcattgttcagttcccacctatgagtgagaacatgcggtgtttggttttttgtccttgcgatagtttgctgagaatgatggtttccagcttcatccatgtccctacgaaggacatgaactcatcatttttgatggctgcatagtattctgtggtgtatatgtgccacattttcttaatccagtctatcgttgttggacatttaggttggttccaagtctttgctattgtgaatagtgctgctataaacatacgtgtgcgtgtgtctttatagcagcatgatttataatcctttgggtatatacccagtaatgggatggctgggtcaaatggtatttctagttctagatccctgaggaatcgccacactgacttccacaataaaccatagaaacttattgtcctacagttctcaaggctggaagtcccaagaccagggggtcagtgtggtcagattctggtgtagtctgtcttctaggttgtggatggccactttctcctgtgtcctcacatggtggaacctggatggggtctcttttataagggtactaattccattcattgtgctccaccctcgtgacctaatcatcccgcaaagcctccgcctcccaacagaatcactggggatgttagaatttcaacataggaactttggagggatacaaacattcagtttattgcgccccctctagatgcaaaaggattgggtttagatgaggagaccccaggggagagggtgcccatctgagagtgtatttctagaacttcttatgaacttgagcacctccatgatctgtttacatctccctgggacctgagtaaattagagacaagatgtagggcagggggggttctgagatttagcttggagactgtgaggtggtgatggatggcaacccttggttttgaccatccatgctaggtggatatctgctgtatcattaacaacatgacaaactttccaggactttctatatctcagacttctgccaatatttgagatgactgggtcaaaatgatgctgattttttgaacagggagagcaataggtattctctgaaggttggctggatgtgagcctagtggcttcaatgatggtggagtaggatgaagagagaccctcaaggttgaacaaagatgggagggctcacatccattactggttatatttgatcttttgtctcctccagtgcaatgatctttttcatcttcttaattcttaatttagctaggcaatgtttaattattagtttaattcttaatcaaactaggaaaggaagaaaacaccccatttctttgtgcttttttgcctcattgtggtggtttaggtcatgatgaggtctagttgggcaggtcatgatgaagtctagttgtattaggttctgatgatgtctggttgagttagatcatgctgaggtacagtttggtttggtcatgatgaagtctagttgtattagatcatgataacgtctcctttggttatgtcatgatgaagtagttgagtagaatgtaatgaagtcttgttcgattagatcatgatgactggttgagttaggtcattatgaggtatggtttgattaggtcttaatgaagtctagttcagtaacagcatgatgagatctagttggattagacttgatgatgtgtgacttatttaggtgatgatgaaatcttgttgggctaggtcactttgagatctaattgggtaggtcatgatgaggtcttgttgagttaggtcctgatgaaatgtagttgagttaggtcacattgaggtctagttgggtaggccatgatgaggtctatttgtattaagtcatgatgaggtttggttgtattagatcatggtaaggtacagtttggttaggtcatgatgaagtctagttgtattagttcatcataatgtttagtttggctatgtcatgatgaggtagttgagtagaatgtgatgaaatcttgttggattagattaggatgactggttgagttagatcattatgaggtgtgatttaattaggtcttaatgaagtctacttcagtaatagcatgatgagatctagctggatcagatcatggtgatgtgtggtttggctaggtcatgatgaagtctagttgggttaagactcaatgagttctagttgggtcaggtcacattgacgtctagttgggtaggtcatgatgacgtctaattgggttagatcatgaggagatctagttaggaaggtcatgatgaggcctagtggatagatcatgatgaggtctagttgggttaggtcatgataaggtctagttggattaggtcatgataaggtccagctgggttatgtcatcatgaggtagttgaatagaacacaataaagtcctcttggattagatcatgatgacaggttgagttagatcatgatgatgtgtggtttggttaggtcacagtgaggtctagttgactgaggactttgtaggcacaaagcaatgaagacatgtgagcaagcttcttgttcatgtgcatgggaatctcaagtgttaccacttcatttagatgatgtttactgagcatcaggagcagtatatgtcagcaccaatgtgccttttttcttgagataaacagaaagtaaacaccacatctgcaccccacctgtgtctcctatcccacagagctcctgatgtcagtgtttaattttcactgtgagttacagttttgacccttcaggtcaatccaatcaattatgcagtcttatttcccctgtgtgactttgaggataattggatatattctgagagaggcattttttcattttgtatggcagtttgattcaaagtcaattaatgaaaaaatatcattgaacacaatgaattttatattaaatacaaaataagagatgggaaatttaacttcaaaattttaattaaaaatttattaatatttaaagaataatcaattacttgtaaaataattcagattataacctgggtccaactgaagcacattaatattactagacacatatatcagttgttcaaattcccatctgtccacaagatcttagttctcattgtttcaaaatattattttggtgggggatcattttttttcataatgctcaatggactgtcatctaagatgaaagtggggtgggtaaactttttctgtaaagagacagataataaatgtgttcatatgtttctctcataactatgagctctgccctagtagtgagtaaccacccataggtaatacttaaaacaacaggaaagtctatgttgctgtaaaactttttgtacaatatccagctgcaggccaggtttagccgcagattggtgactctggtttgggctcaaaatctttttatttagtaagaggaaattatactgcttttttccaatataagaaatctcttgtacagtcctcaggaagggtagataatgatgaggtctagttgggttataatgaagtttagttgggttatgatgaagtctacttgggttggtcatgatgagatctagttgtattagatcctgatgagatccagttgggtaaggttctgatgaggtctagttgattggtcatgatgagacttagttaggctataatgaggactagttgtgttggtcaggatgagatcaagttgtattaggtcatgacgagatctagttgggtcaggttgtgatgagatctggttggttggtcatgacgagatctagttaggttatgaggaggtccggttgggttggtcatgaggagaactaattgtattaggtcttgatgagatctagttgggttaggttatgatgaggtctagttgggttggtcatgatgagaactagttgtattaggtcatgatgagatctagttaggttctgatgaggtctagttagattggtcatgaggagatctagttgtattaggttatgatgtgatctaattgggtgaagttattatgaggtctagttgggttggtcatgatgagatctggttgggttaggttatgatgcgatctagttggttggtcatgatgagatctaattaggttatgatgaggtctatttgggttggttgtgatgagatctagtcatattcagtcatgatgaggtctagttgggttagattatgatgaggtttagttgggttaggtcatgatgaggtctagttgggttagggtatgaggagatttaattgagttaggttatgatgaggtctagttgggctggtctttatgagatctagttgtattaggtcatgatgagatctaattgaattatattacgatgatatctagttggttggtcatgatgagatctagttgtattaggtcatgatgtgatgtagttggggtaagttatgatgaggtctcattgagtttgtcatgatgagagctagttgtactagatcatgatgagttatagttgggttaggttatgatgagatctagttggttggtcatgttgagatccagttaggttatgatgaggtccagatgcggtggtcataatgaaatctagttgtattaggtcatgatgagatctagttgtggtaggatatgatgaggtctagtgcattggtcatgatgagatctagttgtattaggttatgatgagatctagttggattaggtcatgatgagatctagttgtggtaggatatgatgaggtctagtgcattggtcatgatgagatctagttgtattaggttatgatgagatctagttggattaagttataatgggatctgtttggttggtcacgatgtgatctagttaggtcgtgatgagttctagttgggtaggtcgtgatgagatctagttgtctcatgtcatgatgaggtctagttgggttaggttatgatgaagtccagtttggttaggtcatgatgaggtctagtgggattggtcattatgagaattagttgtattaggtcataatgaaatctagttggcctaggctatgatgagctctggtaggttgttcatgatgagatctacttgtattgggtcatgatgagacccaggtgtgttaggttatgataagatctagttcgttgtcataatgagatgtaatttgtttatgatgcagtctagttgtgttgctcatgatgggatctagttgtattaggtcatgatgagacctagttgggttaggttatgatgaggtctagttggtttggttatgatgaaatcttgttggattatgtcatgaggagatctagttggatggtcatgatgagatataattaggtcatgataaggtctagttgggttggtcttgatgagatatagttgtattaggtcgtgatgaggtctagtttggttaggttatgatgaagtctagtttggttaggtcatgatgagttctagttgggttagggtatgaggagatttacttggataaggttgtgatgaggtctatttgggttggtcatgatgagattttgttaggtcatgatgaggactagttttgttggccttgatgagatgtagttgtattaggtcataatgaagtcttgttgagttaggttatgatgtagttaagttgggttaagttatgatgaggtatagttgggttggtcatgatgagagttagttaggtcacgatgaggtagttgggttggtcatgatgaaatctagtcatagtcagtcatgattagttcttgttgggcttgtttataatgagatttagctgtgtcaggtcatgatgaggtctagttgagttggtcatgatgtgatctagttgtattaggtcatgatgaggtctagtttggttaggttatgaggtctagtgtcgttggttgtgatgagattcagttaagttatgatgaggtgtatttgggttggtcataaagatacctgtttgtattaggtcatgttgaggtttatttgggctaggttataatgagatttagttgggttaggtcatgatgaggtctagttgggttagggtataatcagatctatttgggttaagttatgatgaggtgtattttggttagtcctaatgagatttagttgggttagagtatgatgaggtgtagttgcgttggtcatcataaaatctagttttgtaggtcacaggaagtctagttggttaggttatctaaattgcaactgtcttttaaaaatgacttgtgccacatatactttgtattgtccatgaatagtacatgtgaaacgtgtaaaatatttaaacttgtatttaattatctatttacttattttaatagacaaaaacaagttacatatttttatggtgtacaaaatgtggttttgatatatgtttccatctggaatggccaattcaagctaattcacatatccattaccttacatgtttctttttgtgtgtgtttttggaaacacttaaaatctactctctttgcaattttcaaatattaattatagtcactgtgactaattatagtcaggttcaagattatagtcactaatttagtcaccttaagtacaatagatctcttgaacttataccttctgtcaaactgacatttggtgtcatttgaacaaaatctcagcaacccacccccctagcacctggtaatcaccataattctttttcttttctttctttcttttttttgagatggagtctcactctgtcaccaggctggagtgcagtggcgcaatctcggctcactgcaacctccacctcctgggttcaagcgattctcctgcctcagcctcctgagtagctgggactacaggtgcatgccaccgtacccggctaatttttgtatttttagtagagacaggcttttgccaggttggccaggatggtctcgatctcttgaccttgtgatccacctgccttggcctcccaaagtgctgggattacaggcatgagataccacgcctggccaataatcatcataatactttttcttgtgagttcaacttctggagactctacatatgggtgagatcatgtgggatttggttttatgtggcttattttacttaacatgatgtactcctggttgatccatgttgtatcacaggatagggtcctctggttttcaaagactgaatggtattccatggtgtagctatcccacattttatttatctacccatccttagatggacacttaggttggtttcatatcttggctcttgtgaatcatgctgcaacgaacatgggggtgtagatatctctataaggggctgatttcatttcctttggatctatacagaggagtgagattgctagatcctatggtaggcataatgatcattttttgaggaactcttaaaaaaaaaaaggccacccctttagacacaccttaaaatccaacctttctggtcaaagacatttgaaaaaaatgacgacaacatcaaactatagtctcctgtccaagcacgttcacttcctaagatgtgaaaaaaaccaggccgggtgcagtggctcatgtctgtcatcccagcactttgggaggcaaaggcaaacgggtcacccgaggtcaggcgttcaagaccagcctggccaacatagtgaaaccccatctccactgttttccataatggctataccaatttccattgcacatataacatgtaacgccctcccctgcccccccaaatacaaaggatgaagcagaaggcagatgcactgtgtttgggacgtgtgcggtgtttctgcatatgcagtacttgctcagcaaatgtaggaaccactccagcaaatgcatatgaggccaaatgtcccacgtccagttccttaaagcagctccctccaggtctgaggagacaattgctgaaggtgacattggccaaagaagataccgcacgtgccacctcaccttctccattcctccagtgtggtgcttctgtcctatgccagcgttgacggtgccaccatggaaaatggcctgcccatgaaggtggtcttcccaaataatcacttcacctggctttttttgatgctcccagctttttctggtcacttttgtctttcttgagaaggtggaggctcccatcttacttcgtcccagcttccggcatgtttccctttgtttttttttgttttgttttgttttgttttctttttgagatggagtctcgctgtgttgcccaggctggagtgcagtggcgcaatctcatctcactgcaacctctgcctactgggttcaagcaattcttctgccttagcctccagagtagctgggattacaggtgcctgctaccatgtctggctaacttttttttttttttttttttttgggacagagttgggctctgtcgcccaggctggagtgcagtggtgtgatctcagttcatggcaacctctgcttcccgggtcctggttcaagcaattctcctgcctccgcttccctagtagctgggattacaggcacacatcaccatgcccatctaatttttgtgtttttagtagagatggggtttcctcatgttggccaggctggtcttgaactcctgacctcgtgatccgcttgcctcggcttcccaaatcccaaagggctgagattacaggcatgagccaccgcacccggccgcaccctttgatcttgagatggctgatacggcagagcagcccagcagtggatgagtgcttacatttaaaaagttcatgggatttcataaataagctcatgaatgtacaagtccccagtgtaaaggttaccttgactttgaatttttttatcctttctttttttgttttgtgtttgatgcataggacatttatagatggaatatacctttcaggctatttcttcctctccctcccgtcgaaacccacctccctgaaatgcctgctgcctcctcagtgccaaaggactgtcaaagcaaaaatgtaataatggtatcatgttctgtttctttaaggaagtcaaaggtgcaaattacctttgcagcttcagtcttctgatgtctgcaactttgaattccttcaaggaagtgacaatttagatattccatttactctgccccaaaggatggactttgcactatttatcttagccgtctcccactggagccaaaaacatttccaacttcataagtttcactgcttctcctcttttatatattttttcactctttgctgaaaacattttcattgttttttgaaaagtgcattctaatagttaatttgggagcccatggccttaacacagaagaaagaataccgaatacaatgataggatatcaaacagcatggtctcttccttgtgttagagtgtgtaaattcaatacgccgtgttgactcagtattcaggaatgccaaagagagggattatttggtaatgtattttcatggagacccggggacggtgctgtactacagaacacctcactggcccgggctgggtgcaggtaggatggagatagaccggccccacccccttggtaactgctccttgcagatcagctgtttgaagctctccgggcacccaagacgttcttgttcaagcctgtgcgcttcccctgctagttctcatctcccttctctcaacactttttccgtgaccctccctgaaagggagttttgggcttggctcaccctggaaagcagctaatcccacatgttgccaacaggttaatgaaggatgaggctgaaggaggaaaaatttgccaaactcctttcccctaaagagccgccccttcagaaacaccttaaaatccaacctcccgggtcaaagacatttgaaaaaatgacgaagacaacatcaaactatagtctcctgttcaacgcatgttcacttcctaagacattaaagaaaccaggccgggtgtggtggctcatacctgtcatcccagcactgtggaggccgaggcgggaggatcacctgagatcaggagttcaagaccagccttgccaacatggtgaaaccccctctctactaaagatacgaaaaaattagctgggcatagtggcagtcacctctaatcccagctactcaggaggctgaggcagcagaatcacttgaatcagagaggtggaggttgcagtgagctgagatcgcaccactgcactccagcctgggcaacagagcaagattctgtctcaaaaaaaaaacaaaacaaaaaaacaaaacaaaaaaacccaattaacattctttcaccccggatttcctagtctttattttagctataacaagcaaaacacctctttccatccttctaaaggcgtgttcctgaaacctcacttggagagttttacggaagtgcagtgagaggagtaagaaatcctgagcacacagccaactaacgcaggaacagaaaaccaaagaccccatgttctccttcataagtgggagttgaacaatgagaacgcatggacacagggaggggaacatcccacaccagggcctgtcgaggggttgagggggcagggcagggagagcattaggagaaatacctaatgtagatgatgggttgatgggtgcagcaaactgccatggcacgtgtatacctatgtaaccaacctgcacattccgcacatgtgccccagaacttaaagtagaattaaaaaaaagaaacagaaagaaatcctgagcacgtagtaggaaccacggtctgtgatcacgtgcatcgtgcagtctgtgtgtgcacactgggatgtttccagcataaaagctccttcgaaaattcgtttccatcctgacattttaatgcacattttttatgcttatgctattctcagctctcacgtgcaaattacaccagcaggtgccccgggtccctgtcactattgaaaagtagaatgtcaaatgcatttgtactttttgccaatgcaggctaaagaaaatgactcttaaatggatagctttagtctgccaaaatggctgtcaagttagacgctaggataaagggaaagtccatcaaaggcacatttcagatttgtgttatacttctcttaaaacctctttttttttttgcagttaatagtttctggataatcctacaagtcaccgtatcttttttttctttttccttttagctggaaataatgacagcaaagccaaacaagttgtaagcaaaataaaagaagaaaccttgaacgacaaaggtaccgagagatactccaatggcttttttttgtttttttttttccttgggacaggtcgtttgcgtggttcatggctgagcttcagtcacgtgccaggtggcatttgggagagatggctctgatttttgcactcttcttttggggatttctggccccatcctagagcaggagatggtcaaggcaaggcgaagatagcatcactcagctctgacatctgctaggaaaggcatgcagatgtgctggtagcttgcactcttactcaaatgtgtgttccccagggaacaggagccattgtcctttcctgttgacctccagggcacatgccaggaggtgcctctgctggttgggagttcttgacttaagataaatcaggccgggcgcagtggctcgcgcctgtaatcccagcactttgggaggctgaggcgggtggatcacgaggtcaggagttggagaccagcctggccaacatggtgaaacccaatctctactaaaaatacaaaaattagccaggcatggtggcatgtgcctgtaatcccaatgacccaggaggctgaggcaggagaatcgcttgaatctgggactgcctgggagagagagcaagactccgtctcaaaaaaaaaaaagaaagaaagaaaaaaagataaatcaaacaggaatatgcttgcccttaagattttcgaccaggtgctagaccaaattctggtgtgctctttctgtctgttcacactaaggaaggtgtgcacacaactttctaatatccatctagattctcaatgctctgtccttttatttatttattattttatttttcatttgtatacaggtagggagtgcaagtacagttttgttaacatggatgaatggcgtagtggtgaggtctgggcttttagtatagctaacacctgaatcacgtacattgtacccgagaggtaatttctcatcccttgctcctcttccacctcccacccttctgagtctccagtctctgttattccactctttccatgtggacacattatttagctcctgcttataagtaagaatgtaggaggtcggtcagggtggtaggaaaaattgtagaagatgcaaaccttcttgggaggccagaaggttttgcaaatgctcccgaataagatttggctgaaggcagccagattctcttatccagtgcctgaaagcttaggttagataacgaggggatgtaaagaaactgatctagataagttagtttgcttaggcctcagaacctggcctttaatcatccacgcacagaactactctctccctctctccgggttgcgggggacgaccatatgaattgcccacgaatgtgttgactcaaggcctttgtcattaaatgtatactaaataaaggcccacagcagcagcttgtcaaagccgtggctgctgactctttaaaacaccctcctcagtgtctgtgagtggccccatcccctagcccacgctttcactggaaatctgtgtctgagtgcatttgttcatccgtcgctcagccaaagtctgcgagtcggacccagcaaattggactcgacctaagaagaatggtatttgactttcggtttctgagttatgtcccttagggtaatggcctccagttccatctgtgttgctgcaggagataggatttcctcctttttcatggctgcatagtattccatcaggtatagatatatattttctttatgctttcgtgtgttgttggacacctaggttgtttccatatcttggctcctgtgaatagtgctgcaatgcacataggaatgcaggcatctctttgatacactgatttcatttgctttgagtctgtgcctagcagtggaattgctgaattatgtggtgcttttatttttaatgatttgaggaacttctgtactgtttttcatagtgactgtactaattgacattcccaccagtggtgtacaagggcccccttttctctacaccctccccaacacttgtaattaactgtagaaatcatcattctggccagcgtggtggctggcacctgtaatcccagcactttgggaggccgaggcgggtggatcacctgaggtcaggagttcgagaccagcctggctaacatggtgaaacctcgagtctactaaaaatacaaaaattagccgagcgtggtggcaggggcctgtaaccccagctactcaggaggctgaggcaggagaattgcttgaacctgggagttggaggttgcagtgagctgagatcacacctttgcactccagcctgggtgacagagcaagactctgtctcaaagaaaaaaaaaaacaaaaaacaaaaaaacacaaacaaaaacacccttctgacaatatccattttagctggtgtgagatagtagctcatggtggttttcatttgcatttccctgatgattagtgatgttgagtaccttttctttgtttatttttttgtttctttttgagacggagtctcactctgtcacctaggctggaatgcagtggtgcgatctcggctcactgcaacctccggctcccaggttcaagcgattcttctgcctcagcctcctgagtagctgagattacaggcattggcgaccatgcccagctaatttttgtatttttaatagagacggggtttcgccatgttggccaggctggtctcgaactcctgacctcgtgatccgttcgcctcagcctcccaaagtgttgggattacaggcgtgagccactgcacccggccgactaccttttcctataagcaccttttcatatacctgttggccatccaaatgctaagtgcttttctcggccatgtttatgtgtggtaccttattttttttttttttttaaatgcacatcccttccttggctgtttgaatttgagatggtgttttgagaattcccccaagtgggggatgggtgtattttgattctttatttgtttgtttgttttttgatacagggtctcactctgttgcccaggctggagtacagtggtgttatctcggctcactgcaacctccgcctcccaggcccaagtgtttctcctgcctcagcctccccagtagctgggaatacaggtgtgcagcaccacacccagctactctttgtagagttggggttttgccttgttgcccaggttcatcttgaactactgggttcaagcggtccattcacctcggcctcccaaagtgctgggattataggtgtgagccactgtgcctggcctattttgatgatgatgacgattattattaatattttgagacagagtctcactctatcacccaggctggagtgcagcaatgtgatctcggctcactgcaacctctgtggcccgggttcaagcgattctcctgcctcagcctcccgagtagctgggattacaggcgcccacccaccaagcccggctaatttttgtatttttagtagagacggggtttcaccatcttggccaggctggtcttgaactcctgacctcatgatccacccgcctcagcctcccaaagtgctgagatgaccggtgtgagccaccgcgcccggccttgattctttttaaagccatgagagtgaaatgaacgctacacagagctgagcctggtcactgcctatgcccctatctcctcctttctaccctaagctgctgtgaaacaccttgttattacctctgccaagggctggggtatgttgaaatttcatagccggcattgcaggatccctgtgattttcaggaacacactcccacaggggctcccgctcagccagagccaagcccagtgtacaatgtcacagagtggcagcagcctggccagatcttttctcctcattaggatctgccttggggcaaaaggattggtttctgtgtagagggataattaaggaattagagacaccgaggggttgaggaggaattatttaattatttatttgtaccgaccccgtcggattaacatttaaaggaccgagttttgaacaaagagtttggttattttttaagtattttctggggcggggggagctctgtgtagggggaagtatatcatagaagtgagaaacaaagacagttgtttaattgacacatgcattatattattttttattttttaaggaataatatgttttatgatttgagattatttgcctagtgactttgtagctgtatagctagagaagcagagtttttataatgcttgggaaaggaagagacaaggcttattagccgcagaaaaacaggcagttaatttttaatggacttcaactctttctcttcctcagggagaactgggttttcttacatacaactgagtttttgcttatacatttttaaattttttaaaattcctgtttcatctgtgacagggggtcctattccctgccaccttggcccttcctcatttgcagcaggttttcaaaggagtggcattttctaacacaatgaatccaaaagtgccttctccgggcctgtcacatcagcatttccggggagtaaacaagaaatgcaggtgcccagggcccatctgtgaatcggggcctctgggggtgggggcggggccctggaatctgcattcttatgaggccgttaaatgatccccacgcaccttcaaatggtacacttgctgctgtcctgaaggcattcaaccatcaatctggagcccaaagagaagtttctggaaactgacaagtgaggcattcttttctcatgactttttgcttttaatctgaacggcttaaaaactatatatagttccccaaaattcacatatgtgatccacctaaccaaaatgacagccaagaaacaatgatttataatcaccaacttaattttattagattctgaaaatgtttcagatttagacaacatgaattttgaccaataattttttttttttttttttgagacagagtttcactcttgttgcccacgttagaatgcagtggtgtgatctcggctcactgcaacctccgcctcccgggttcaagcgattctcctgcctcagcctcccgagtaactgggatcacagacacccaccaccaggcccggctaattttttgtatttttagtagagatggggtttcaccgtgttagccaggcttgtctcaaactcttgacctcagatatccacccacctcagcctcccaaattgctgggattacaggcgtgagccactgcatctgaccacaataacaaatcattgctgttttcttggaaaagtttgtgtaggatattcgatcatcagtttttaaagtgcagtgttttgtggacaagtagcatgacgaatacatgatttgtccccaccattaaaaaatgttagtttacttgtggcatataaataccgatggcctttaagccaatcttacagaaaagaagaaaagaatcgtttgcactttctgtggctgtttaaaagctttaccatcttgtaagagggtgggaagatggggtgtgccgtggagatggttaatgggcacaaaaatatactttagatagaatgagtaaggtctcgtatttgatagcacaaaagggtgactacagtcaacaatccttcatggtccatttaaaaataactaaaagttgctggacatggtggctcacccctgaatcccagcactttggaaagccgaggcaggtggatgacttgaggtcaggagttcgagaccagcctggccaacatggtgaaaccccgtctctactaaaaacacaaaaattagccgggcgtggtggtgcacacctgtagtcccagctacttgggaggctgaagcaggagaattgcttgaatctgggaggcggaggttgctgtgagctgagattgtgccaccgcactccaacctggactacagagactccatctcaaaaaaaaaaaaaaaaaaaaagaaaccaattaaaggtgtaattggaatgttagtgacacaaacaagtgatgaatgctcgaggggatggataccctatttgccctgatgtgagtattacacattgcatgcctgtatcaaaatacctcattatcccataaatatatacacctactatgtgtgcatgcaatttttttttttaaaagaaaaaagtttaaaatctgaacaggtttggacattcatcagtggtggccctggtatgtccactgctgggggactctccagtccttgatagatgatgctgaggcccagctgggtggggacatttcggctgtggccattgagcctttacctcgactgagtctgcctccaggctcaggagcccccagatccgtggtccagccacacggcagggtctgccctctgcctgtgagtggtatctgctgcccacaacatcttatggacgaccacagctcctacaggcatcccttccctcctcagctgagacctgggcacacctccaccaaacccgtacgaaccttgctctaaattgtgcttctctctggactggcctgcacctgctggaactctgattcttgtccccacaacctccagttgcccagcgagggacagagggagctgaatgtgctgtttcgttcttgctctgctgggatcccggcatcgggtaaccccggttcagccatgtggatttatttttaagcaagtcggctcacgtcctgactccaggagcacagattgctgtggagtgtcagtcacacaattatttcaacatgctgggcgcctgtctagcctgctttcccctcctgcctttcctgctctcaattctctctccttagttcttgggttaatactctggcctgcgtactttgttgtactttctgtctttgaagtcgtgctcctctgagatcccacgctgggcagggcatgggaagctacgtgcccacagaaggacggctaattgagctctcggaattataaatgcgcgattgttttcaggaatctgggcgagatggctcatttcccaagctagggattttccagggaagcgttttcactccttatcatcacttagccattgtgcccacacctttgtggctcctgggtaattatgtgctgatgaaagctgtcttacttagaacaaatagtctcattcacttaccgaaactcctccaaatataaataaatcaaaccccagcggctccatgaaagcaaacacagaaaggcatagccgtgttcaaatgaactcagatggggagagataaccagttaaacactcttaaaagcactgaaggcaggcccattctcttttgcagctcgtacatgccatggtggaacccctgtaatcctaaatcctaagagagatcagactagacacgtgctgtgtatcctctttggaaggtgcacggtgtcctcattttctataatgattgtgtaactttaatcacaaacagcatcttctgattcatttagcttcctggctaggcacgatggctcacgcctgtcatcccagctctttgggaggcctaggcgggcagatagcttgaggtcaggagtttgaaaccagcctggccaacacggtgaaaccccatctctactaaaaatataaatgttagtcaggtatggtggcgggtgcctgtaattccagctactcaggaggctgaggcaggagaatggcttggacccgggaggcggaggtttgcggtgagccgagatcatgccactgcactccggcctgggcgacagagaaaaacttcatctaaaaaaaaaaaaaaaaaaaagcttcccaaatattattcttccagtagcttgtgccgtcttcatcagaagagggactagctgtttggttcatgtgcttccacccagttattagaccaagtttgttttcaataaaagaaatcactggtcaatgccttctgtaattgatgggtgtcaagaaggtaaattttgcacgccgccttgggaggcacttctactttgaaaatagatctttgtgaaccatcattttggcctatccaatgacctataaaatacttgaatttatcatgaaaacagaatactgtgaaatcaggatgaaggttgataacaggtcatcaacgtaattgagtagattgaaaatacaagagtcagtgaagtgtaggatgaatgcttgttgtcagtaagagagctctttgtgacccgttccacgtgcaagagatgagggttgttgttttgggaatactcaccctcctcatcgcctgtccctgctaaaatcagagctttgtgagggcagagatggattctgtgcacaggtatcttctgagtctctgattcagtgcctgaaacacagtggctcccgagacaatctacctcagtgcctgttttacaggctcacctgtgacacatgactgggacatatgttattcatgatgacatgcaagagtctctgtgtaggtgtctactggtcttcatcatcaaacagagcgagaactccaagtcaggaggcagacatatcttggggcaagaagacacctagaatttttcttcaacctgtagactttcggattgggtagaaggattgttaaggaggttgcgaaacttggaaaaaggatgatgtgagtgttgatggcatggaattctccccacacccctgggtatccatttttaatgtacagaattcttgtgacatgattttagggcatagaatccttgagagatcatgtctgtgctgaagttggaatcacagcactttatgtgaatgtgttcgccaacgattaattatgtttattcccgagaagttttaaccagattgtggatgtgtattctggttcagcatatattcacaattacctttgttttttgttttgttgttttggagacaaggtcttgctctgtcacccaggttggagtgcagtggtgtgatcatagctcactgcagcctcaaactcctcagtaggaaacttcctaccccagcctcccgagtagctgggactagtagcatgcaccactacacatggctaattttgttttttaaattttttctagagacggggtctcattatgtcgcccaggctggtctcaaactcctggcctcaggcgatcctcccaccttccaaagtgctgggattacaggtgtaagacaccaagctcagcccctgtgtttttttgtttttttttttttttttgctttttgtttgtttgttttgagacggagtcttgctctgttgcccaggctggagtgcagtggtgcgatcttggctcactgcaacctctgactccctggttcaagccattctcctgcctcagcctcccaagatgctgggattacaggcgtgcaccatcacacccagctaattttttgtatttttagtagagacagggattcaccgtgttagccaggatggtcttgatctcctgactttgtgatctgcctgccttggcctcccgaagtgctgggattacaggcgtgagctatcacgcctggcctgtgttttttttttttttaaacataaaatggcccttattgactgttttccttttcatagtgagtccttttgtttctttcatgttttcgagaagtgtcccgagtcaggctgtagacaggcatatgcgtagataaacagatagactcatgcgttcctgttggtaatttttccttgaggtcaccgtatgtgttctcatgcgtgggcatagatgtcccacactctctgaaagtttaattggtcctcgcaggtctcattgtgttccttctcttcagggctcttcatatctcagggtggtaataaccttccaaatctctatggccgaggcgggcagatcacgagatcaggagatcgagaccatcctggctaacacagtgaaaccccgtctctactaaaagtacaaaaaaaattagctgggcttggtggcgggtgcctgtagtcccagctactcgggaggctgaggtgggagaatggcgtgaacccgggagggggagcttgcagtgagccgagatcgcgccactgcactccagcctgggcgacagagcgagacaccgtctccaaataaataaacaaataaatagaaatacaaaaattagccaggcatggtggcgcatgcctgtaatcccagctactcaggaggctgatgcaggagaattgcttgaacctgggaggcggagttttcagtgagccgagatcgcaccactgcacttcagcctaggtgacacagcgagagtccatctcaaaaaaaaaaaaaaaaaggaatatgcatttaacgtttctttgcgtcttttcgtggctcgatagagcccagtatatattttcactaaagagcaaaagcgcctttccatgggcctttaaatacttaagaataagcacatccacacatgggcctcccagatagtcggtgcgtttccagaaatgacggtgtgttgtggttcacagcctctttgggttttggtctccaactcccagcctcaggcgatcctcctacctgagcctcccaaagtgctgggatgacaggcacagtgagccaccatacccagctattttttgaaaactcatagtctcatatttccctaatatttagggttagggctagagttaggtagaggttagaggtgctctgacgagtgtttcccaagtcttggagcccacctctggccaaatcaccgcctgcagttggaagcaaggctgtttctgagatgagtcatactgacatattttgctattgaatgcacggttgccctgatccattcagagatacttctgcagcaccatgagctccttaatccctgcccctgttcacctacaagggtctgcaagcgagcccccttccgcaactcatctctttgtgtaatccttctccagaccctgaatatatcagcctgttggcatatgtatctatgtgtgtgagatcagcctgttggcatatgtatctatgtgtgtgagatcagcctgttggcatatgtatctatgtgtgtgtgtgtgtgtgtgtgtgcgcgctctgaggatattggcactttttaatcttcttccattagacgacaaggctgagggcttccacttgccgccgacttgccggcacacctggggcatgtttaataagtaattgtgtatggtctgctttgcaaatgcgctacttcacatttttccatcccgcccgtaacgaggactggggttgttttacaagttaattacccaaaagattatcgagtgggtttagaggcacaaattctacgcgctatttaacagataagaattaatgagtgttgttaaaatgggaaaaaaaaaatgtctctgtcagtggagggagttatctctaccctgcctggctgtgttactgttgtttttttttttgtctgtgaatgagaaccgaggtagagaaacaaggcgagtgttctcattgctcttctcccaccagagcacaggcggcacgtgtgaaaataactattcacagtttctttcccaccgtgtctcaagaggggtgaatgccagggtcgggcccggtggctcacgcttggaattccagcactttgggaggctgaggcaagaagattgcttgaggccaggagttcgacagcagtcagggtggcgtagagagactccgtctctacaaaatattaacaaatcagtctggcttggtggggtgcactgtggtcccagctactcgggaggcagaggcaggaggatcgcttgagcccaggacttcaagaccagcctgggcaacatggcaagaccttgtctctacaactaaataaaaaaattagtcaggcgtggtgtgcgtgcctggagtctcagctactcaggaggctgaggcaggaggatcgtttgagcctggaggtcaaggctgtggtgagccatgatcgcgaccctgtactttagcttgggcgacagagcaagacccttttctctaaataaaaatggaataatagtaaaaagaagctgaatttcagctgttttcagccattctctttattccttcaaatgcctctgtattctgcagtatcctttaaaatattaagagcaattttagctaatcaggaggctgagacaggagaatcgcttgaacccaggaggcggaggttgtggtgagccgagatcgtggtattgcgctccggcctgggcaacaagagtgaaactccatctcaaaaaaaaaaaaaaaagggagacacagataaggccatgtggagacagagactggagtgatgcggccatcaacttagggataccaggagctggaagaggcaggaaggatgccccctagagtcttcagaaagtatcagacacctttgggaggccaaggcgggtggattgcttgaggccaggagttcgagaccagcctggccaacatggtgaaacctcatctctactaaaaatacaaaaattagccaggcgtggtggcgggagcctgtcatcccagctcctcgggaggctgaggctggagaatggcttgaacccgggaggctgaggttgcagtgagctgagatattgccaatgcactccagcctgggagacagagcatgattctgtctcaaaaaaaaaaaaaaaaaaaagaaaaagaaagaaagcatcaaacacaattgcaaggggttgaatgctgatctccaaaagatatgtccatgtcctaatccccagaacctgtgaacaggaacttatttggaaatagggtctttgcagatgtaattagttaaggatctcaagatgagatcattctggattagggtgagtcttaaatccaatgatagctgtccttgtaggagacaggagaggagacacagacacagaggagaaggccttgtggagacagaggcagagactggagcgatgcggccacaaacccagggactcctggagcccccaggaactaggagaggcagggaggccccttcctgagagcccccggagggagcatggtcctgagacacctgatctcagacttttggtctccagagccagtagaggatgaattcctgttgaattaagttccccaggtgtggtcatttgtcacagcagcctcgggagacgagtagagacatagatcgggcaggaatagaatatctagttgcattgctgatagaggcatactacagctgtgtgacatggtgtgacatcagcacactgtgtcctgaccccaggtcatgggacaagaacttggggagacatagtcacccccctggctcatcagggaaatgcatggcttccggtaaggtgaccctgaacatgcgtgtgtcactctgaagtgttggcctcagactctgcctccaaattccaagtcccctgggggttccgctggaggtggacacgcccccatccatgccttccttgcagtcacgggaacatcccttactcagtcctctctggtcaccgatggggcatgacaggaggcgctacatgtttccaagcagccggggttccagatgcttggaaattctgcgtgcggcctctctatgggaaaaagggaggtctgccaggagtggaaccccagtgagaaagtaaactcaaaacagaaatgaaaggtttctagacacagtacaagccccctttgtggtgcgcgcagggacttacgtagctcggcccctccaccccctggctggccccagtggccgaggtgtgttgggtgctgatctgtgacaccctcctgcttcacacgggcagggaggggttctggagagagtgcaggtgggctggagagctgagctccctgcagcaggtgagtgtgagtcctgaacagactcgttccaaggaaacaggtgcaggaaagaacacaggtcttggaggaatcagggttgagccagccctgtgacctcgggctgtccttggccccagtgatggcttatctttacctggaacttcaacctcttatcatcacctataacgctgaccactgatcctcacctgggactcgaacctctccccatcacctgtaactcggaccacttgtcctcacctaggactccaacctccctccatcacctgtaatgctgaccactcattgtcacctggaagtccaacctctcatcactacctggaactccaactccaactcttttttttttttttcatgagacggagtctcactgtgttgcccaggctggagtgcagtggcacaatctcggctcacggcaacttccgcctcccaggttcacgccattctcccgcctcagcctactgagtagctgggactacaggcacgtgccaccacgcccatctaatttatgtatttttagtagagatggggtttcaccatgttggccaggacggtctcgatctcttgaccttgtgatctgcccgcctcagcctcccaaagtgctgggattacaggcgtgagccactgtgcccggccccaactccaactcttatcctcatctgtagctctaacctgttatcctcacgtgtaaatgtgatgtcatcctcacctgtagctgtaatctcatcttcacctggcattctgacctcttaccctcacctgtagctctaaccggctatcctcaccgatagctctgacatcatatcacctgtagctgtaacctcgtcctcacctggaactctgacctggctgacgtgcttgcagcatgtgggtggggccgatttccctcctgccccagctccctgctgctgccaagtccaggtctctcctgtggggcaggtatacccctccctgggtctcagctgggcccactggccttcacagggagcctgctgtctgcactcccattcttgtcctgccctctcctccggcgccctgtctgctcagatgtcctcatggcctaggcacctgcagccgccaggacagtgagcccggacacaagcagccttccatccggttccccctgcatctgccaacccatcttgcccacagccaagcttctgtgaaaaatcatagcagtcatgaaactcatgagtgctcgggcaaatcagaaaaattgccagggatcctaccatggacacgcgtccctgaaccccgaatggtccctgtgtgttgtgtgtgcgcaggagacgggcaggtcactgtgtgtcgtgtgtgcaggagacagggaggtccctgggtgttgtgtgcccaggagatggggaggtccctgtgtgtcgtgtgtgcaggagacggggaggtccctgtgtgtcgtgtgtgcaggagacagggaggtccctgggtgttgtgtgcccaggagatggggaggtccctgtgtgtcgtgtgtgcaggagacggggaggtccctgtgtgtcgtgtgtgcgcaggagacagggaggtccctgtgtgtcgtgtgtgcggaggagacggggaggtccctgtgtgtcgtgtgtgcaggagacggggaggtccctgtgtgtcgtgtgtgcagaggagatggggaggtccctgggtgtcctgtgtgcgccggagacagggaggtccctgtgtgtcgtgtgtgcggaggagacggggaggtccctgtgtgtcatgtgtgtgcaggagatggggaggtccctgtgtgtcatgtgtgtgcacaggagatggggaggtccctgtgtgtcatgtgtgcgcaggagatggggaggtcgctgtgtcttgtgtgtgcacaggagatgggaggcgtcaacacacatttcatgctcacatttccattcactgtccacactgcacacttgtacatggtcaatgtctagacatttatagtttgtttatgtgttatattcatctactttatatatattcatattttaggttcatatatttattgtatacacatttatatatttgatctatattaatattttaggtttatatacttactatatatttattattataaagcatatacattaaattataatgtattattatatatgatgtattatgttcaatgtatatattaaatacataatgacataatatgaatttatattataatgtatatacatatgaattcacattcatatgtatgttacattttgtaatgtatatatattttgtaacatatatttgtaatataaaattatatacaagatatactttgatatattttatttatatatttatatataaaacataatataatatgcacaatacattttgtgtatatataaaatatatattacataaatatataatgataactataaattatatttgtgtcattataaataatttatattaaatatttatgctattctataaatagtatatatatttagtatatatttttatatcatactttataataaacacgaatttataatatataagtataaactatagttattggatgtttaattttatgtatatattattttatatatatcatactatgtaacacataatatataataaatataatatataataagcatatatcataatatataatataaataaacattgtaacatataatatataatacatatatatcagtatacaaaatataaaattaatatatacataaaattatatacctacttattttattttattttttaagagacgtgagtcttgctgtgttgcccgggctggctttgcctctggaactcaagcgatcctcccacctcagcctctcgaggagctgggactacaggcgtgcaccatcatttcctcctaaaattgtatgtgctgcatatataaaatgataaatgctttacatatactttatgaaattatatatgctttagataaaagcagaggtttcataaaactgaactgtaacatgcatggcatttaaatcccattgaagtgaagggctgggcttgagggtagcgtcaccctccctgaccgtcatacccatttccatttccccaggaaggaccaggatgctttgtttaagcagcacgtttgaattgctggcattgcctgtggcctccctgtggcgagggatggtgaacgacagcgttttccctcctccttcctcaccttgcaaacctcacttcgttggatgcataattgctgactcatccccatggatcgccttggactgtgtagcaatcactgctcttttcacagtccctcttgaatttctttcctttttttttcttttagtcggaatttcgctctgtcacccaggctggagtgcagtggtgcaatcttggcccactgcaaccttcacctcctggattcaagcaattctcctgcctcagtctccccagtagctgggattacaggtgtgtcccaccacacccagctaatttttgtatttttagtagagatgggaatttcaccatgttggtcaggctggtctcgaactcctgacctcaggtgatctgcccacctcggcctcccaaagtgctgggattacaggagtcctcttgaatttcacttaagatgggctgggtgcttcgtggcaggcttttcacatcagcctttgcatttctgggtgtgacccctgtgtctgctgccttctatattcctctcttacttggcaggattccacccctaggtgggtttattttttcccccagtcccctgcctgcctgagaattcctacctatggctcctcctgggaaagggctcttggctgcgtcttaaatcttgggttatgccttggtgcatactggtgttgcaccagtggtgcaacgttgccggcatcccttttgcctgagggcaggtcacttgtattctgtcttgaaggaacctgacttttaaggagggacgacctggagagtttctttattattgaacttcactgactccctgaggatagactgatcctgccaaattcttgggtccccaataaaacagcattccatgaaataaaaagtaagaacagatggcaccaggaattccactgctgggtatatacctcaaagaattggaaacagggtctccaacagatatttgcacaaaccacgtttgcagcagcagtattacttacaataacccgaaggtggagagaaactgtgtccttccagaagcaaatggataagcagaatgtggtatatccaaacggtggaatattacgcagccataaaaaaggaagggtattcagatgcatgctgcgatgtgggctaaccttgaggacattaatgctaagtgaaataatccaatcctaaaaggtggagagaaactgtgtccctccacaggcagatggataagcaaaatgtggtgtatccaaatgatggaatattacacagccataaaaaaggaaggatattcagatgcatgctgcaatgtgggctaaccttgaggacattaatgctaagtgaaataaaccaatccccaaaggacaaatactgtaggattccactcctatgaggtacacagagtacctttaaatttttagagacagaaagtagaatggggtagttataggggttgggcgaggaaaaggtggggacttaatgtttaatgggaacagagtttccatttggcaagatgaaaatattttggagatgcatggcagtgatggctacataacaatatgaatgtatttaataccactttactgtgtacgtaaaaatggttaaaatgctaaactttatgtgatgtgtatttttccacaattcaaaattataaaaaaaaaaaatgcagctgggcatggtgactcatgcccgtaatcccagcactttgggaggccgaggcgggtggatcacctgaggtcaggagtttgagacgagcctgaccaacatggagaaacctcctactaaaaatacaaaattagccgagtgtggtggtgggcgcctataatcccagctatttgggaggctgagcaggagaatcgcttgaatccgggaggcagaggttgtggtgagctgagatcgcgctattacactccaggatgggcaacaagagcaaagctccattaaaaaaaaaaaaaaaaaaggttaaaatgctaaactttatgttatgtgtatttttccacaattaaaaattattttaaaaatgaggccgggcacggtggttcatgcctgtaatcccagcaatttgggaggctgaggcgggtggatcacttgaggtcgggagttcgagaccaccgtggccgacatggcgaaaccccttctctactaaaaatacaaaaactagcctggcatggtggctcaagcctgtaatcccagctcctcgggaggctgaggcagcagaatcacttgatccccggaggcggaggtcgcagtgagccgagctcatgccactgcactccagcctgggtgacacggcaagaatccatctaaaacaataaaaaaaaaataaaataagtaattgcccttaaattggaaatgctcaacaacccacgtgattctgaatctgaaaaggccagatcagggagatacagagaagaataaataaaacacaaggcaagagaagatttatctctggagcatccttgtgcagctgttggtgagtgactcgtgtgtgtcaattgatcatacactcatgagtggataaaagtacccatgttttaggtcaagaaagactgtgacacacgtgtccagcacgccaagcacacagcccgtggggtgtcatccatgtgctgtgccctccctgtctccctctcccaagctcctgcatggaaacagaggtggacacgaaacctacctacccaccccctcccaggttaccgccatcactttcatcacaaaacagagtctggattcagggattcagcccagggcaggagctcaggtcatcttcctctttcagaagggagatttctgctgcctctggcccagcctttccctctctttccccccatgagctgccattggagcacccacctgggtgcaggtgagagagaggaggaaggagaccaggtgaccccttcctggctggttaccctatgtcccggtaacagacggttagagctgattctcatggcagaagcgtgactgccagagaccacctgcggcgcttctaatgctctggtccgtgtattcgtcttgtagcgttgccgagtgttacagagatccacagaccaggtggtttaaacaaaagatacttattctctcacagctgtagaggctacatgtctgaggtcaccgtgtcggtaggcttgctttctctctggcttgtagacgccgtcttctccctgtgtcctcacagagtccttcctctgtgtgtgtctgtgtcctcatctcttcttatgaaatgtcttagtctatttcaggctgctgtcacagaataccataggctggatgacttacaaacaagacatttattctcccacagtcctggaggctggatgtctgagatcagggtatgggcaaggctgattcctcctgaggtctctctcctggacttggagatgctgtcttctccctgtgtcctcacagagtccttcctctgtctgtgtctgtgtcctcatctcctcttcttatgagatatcttagtccatttcaggctgctatcacagaataccataggctgggtggcttagaaacaatagacattgattctcccacagtactggaggctggacatctgagatcagggtatgggcagggctggttcctcctgaggtctctctgctggacttggagtcaccgtcttctccctgtgtcctcacagggttgtccctctgtgtgtgtctgtgtcctcatctcctcttcttataaggagccagtcccattggatcagcctccccccaaccccctgaaacctcattttaccttaattgcctctttaaagaccccatatccaaatatgatcacattctgaagtcctaggggtgaggatctcaatgtatgaatttgagggggacaaaattcagcccatgacaaccagtgtttctttccaaggggctacctgaaaacgtttctgcaacccccagcaagctggcatcgtctcagcatcttgccatggggttccctccatgcctcccaatggctcctttgagtaagaccaaggacaaacccataccactcccttctcctgttttctctgccctcattgtcccctcaagccctgaggctgatcagtccccacaggaccacagctaccctgtagctatgagcagtggcttcctcaggagtgagccaggctcctgtaccccatgcctccctggcacagaacaagatttaggttctgggggtacctgagggaatcccgttttttttttttttttttttgcaggggagggtggaggctcagagtagggaatttttttttttttccgcctgctgtgaggaaattcacccctgttatctgatccatgcacactctggagctggctgaggtcctaactatttcctctgtaaacttctgcccttggaatgggttctgcgatgattaatacttagagtaaacttgattggattgaaggatgcaaagtattgatcctgggtgtgtctgtgagggtgttgccaaaggacattaacatttgagtccgtgggctgggaaaggcagacccacccttaatcatctgggtggccaccatgtcatcagcaggccagcgaggctagactataagcaggcagaaaaacatgaaaagactagactggtctagcctcccagcctgcatctttctctgtgctggatacttcctgccctggaaaactggactccaagttcttcagctttgggacttgggctggcttccttgcccctcagcctgcagacagtctattgtgggaccttgtgatcgtgtgagttaataccgaataaatgcccctttctatatatctatcctgttagttctgtccctctagagaaccctgaccaatacagggtccgttccttaccccctacatctataaccctgctgcctcagttgatagggaagcagaaagagccgcttttttaatgtttaattttattaagtttgcagtttcccagtgcccaaactcatgttgatttcaaaaactgtccttttaaagcatgtgggcagggtgacaattcatagcaggtgacaaaaatgttttataaataatatccatggaaatggaagctgtcactgtctgcagaatgcagccaaaatattcagaagatttgtatcactctaagttctcgtgctagtaagaaataaaaaagcaaatgatgactgggcctctaagaaataaagtaaaattaggaagcaggagtatgaaaataatgacattgtgcagaaataaatacaaaaggaaagtagcagagaagcaaaaaaaaaaaaaaacaaaaccatcaatagtagtttccttaagaaaaatgaaagaataatatcccaccatttattcatccttcattccacacacaaaagaagcaaggacagattagcatgaattggaacaagaaagaggaaataacatgtaataaaaatatgatttaaacttatgcaaaaaaagtaatttattcttaactcaactaacatatttgattacctcctcctgggcaaaggatgaaaggctgtcttattgcaaaaaattagaattttgctaaattcatgcaaatggaattacagatcacagataaaacaacatgctgaaatttcaaccgtcagaactttccaccaagtgttcctaatgaattcttgaatatctggttgggtgcagtggctcacgcctgtaatcccagcactttgggaggctgagttgggcgggtcacctgaggtccagagttcgagaccagcctggccaacatggtaaaaccctgtctctactaaaaatacaaaaattagctgggtgtggtggcacaggcctgtaatcccagctacttgggaggctgaggcaggagaattgcttgaacctgggaggtggaggttgtagtgagctgaaatcatgccactgcactctagcctggtgacagagcaagactccgtctctctgtctctctctttctttctctctctctctcacacacaaaataaataaataaataaataaataaataaataaataaataattgattatctatatactttttccaaaccatcaaggacaatctagatcaagaatctggaaactgttgaccctggaacatatctgacccttaacttgtttttctcattaaagttttcttgaaacacagccatatacattcatttacttattgcctgtgactgtttttgccttaggtacacaggtttgaagagttgcaacagagaccttatggcccacaaatcctaaggtgtgtagtatttggccatttatccaaaaatctactggctgtactcttcaaagtgaccagagccaccaacctgtgtctgagtaaaccgttttactcccaaatgaacacttttcaaagaagcatcatcggctggttctacttaccaacctaaataaagaaaatctagtttaatcttatccactgaatagacttccaggttaaaaaaaaaattactcctgacttagttgcaactcatccacctgtagaccaaaggatgcttctcattaggtaacagggaagcatttgggataattcaacatccattaattagtaaacctctgaaggaattaatctcataacagcagccggaatgcaggagatgctctacacccgaatcacaaattgaatggatggcaagtggattttccctcctaaggctgattgattggttctggctgccagcaccctgagataagaatgatcctgcagcaaggaatagtcatcaattagtgatgcctgctgtggctatggaatgagaattacggtctgtgtgctacattctttccattcttggtggttctctcataaaccacaataaagcatgcatcttttaaagcaaccatgaccatcactagccaccaccatagccctctggctgattcatggatgaatttccaaattcaaatgtgaatttccagtgtcacatttgtgttcctttccctaaatgatgatgatggtgatgatggtgatggtaatgatggtacttgttggatgtgtgtatgtatgtatacacacacacacatatatatacacatacacacacacacacacacacacacacatatatatttgagatggagtctcactctgtcgccaggctggagtgcagtggcacaatcttggctcactacaacctccgccttccaggctcaagcgattctcctgcctcagcctcccgagcagctgggactacaggtgcgcagcaaatgtatatatatatatttttttttctttttttttttaaatttatttattttttattattatactttaagttttagggtacatgtgcacattgtgcaggttagttacatacgtatacatgtgccatgccggtgtgctgcacccaccaactggtcatccagcattaggtatatctcccaatgccatcccccccctccccccaccccacaacagtccgcagagtgtgatgttccccttcctgtgtccacgtgatcccattgttcaattttaaatacaaccaaataagcttgcttcttgcctgtgtggaatttatagtccagctggagtgaggaattaaataatcatccacttatctgagtgagcaaaattatgataaacactcttaaaaagtgtcctttaacagctgtcttgaaagattcaattccatcctctcatgaggttccaccctctgggtttgctttctccaagacctaccctcctgtgtggcttctttcttgactgtttcttttatgctgcctttcctcagcgtttcctcgtagcatctcacactacacacctttccttaggtcttgcaaccacgtccgtgttctccaaaactctgctctgctagttctcaccaatatatttgtttccaaactcctgcctcctacacctccctgcttccacagcaagtgcaggaatgtatttgacattttccttctctctgtgtaagtcagtggactaccatcctctcagctgcctacagtcgatcctagagtgtctgagatgcttttctccaccttggcattcctctccctggtggcaactgagagctctgtagaccacctacatgcttatcaaaaacactccgtcattttcggtatcactccctacagcaggtcacacctatcccttacctgcttcataactctgcttcctggctagtctctcggcttccaggtttccctccctgaactgtctacactgcagtcagagagatcctgctgagtcacactgttgtcttaacctgcttaaacccatatgggcagaatgcccttcatgcctccacctgtttgctgtagctgtgcacatgtggttcctggttcttgagaattcttcccctcctctgcctcctgaccatccaagtccctttcatgctagtcttctcagcttttatagcatgctgtaaagcagttgtcctgaagccaggtgccttacaactccctgctcccttgggacacttaatcccttctatcgccaacctcacacattgtatcgttggttgtttaattgtgtcactgatttccccagccccatgatggtccatggaacatcactgggatataaaaagtactggccaaaggaataaaatacaggaaaatattttgtgcattgtgggatctcatgaatgacagctgccacaatgatgatgttgatgataatggtgattctgatggtgatgatggttgtgatgatggtggtagtgatgatggcaatgatgatgacagtggtaatggtgatgatggtgataattatggtgatggtgatatagtaatgactgtgatgatggtgatgatgatgatgatggtgatgatcatgacgatggtgatgatggtgatgataatgattatgctgctgctgctgatgtgataatgatgatggtgatggtgatgatggtgtttatgatggtgatgatagtgatgatgaaaatattggtgttgatgatgctgatgctgatggtgatgatgatggggtgatagaaatgataatgatgatggtgatgaggatggtgatagtgatggtcatggtcatgtgatgatgatgatggtcagtgatgatgatggtcatgatggtgatgacaatggtggtggtgatagaaataatgatgatggtgatggtggtgatgctgctgctgctgatgatggtgatggtggtgatgatgatgatggtgatagtggtggtaatagaaatgataatgatgttggtgatggtgatgatgctgctgatgatggtgatgatggtgatggtgatgatagaaatgataatgatggtgatgatggtcatgctgctgctgctgctaatgatggtgatgatggtgatggtggtgatgatgatgatgatagtgatgatgatggtgataatgatgatggcgatgatgatggtgatgatggtggtgatgacggtgatggtgatgatgatggtgatgatggtgatggtgatgatgatgatgatgatagtgatgatgatggcgatgatgatggtgatgatggtggtgatgatggtgatggtgatgatggtgatgatggtgatggtgatgatgatggtgatgatggtggtgatgatggtgatggtgatgatggtgatgatggtggtgatgatggtgatggtgatgatggtgatgatgatggtgatggtgatgatgatgatggtgatggtgatgatgatgatggtgatgatggtagtgatgatggtggtgatggtgatgatggtaatgatgatggtggtggctatgatgttggtgatggtggtgatagtgatgattatgaaaatggtaatgattgctgttcatggattctgtgaaagaaccaaccccttttcctgaaacaatcttgctctacttgactatctgtggactgttctgtgtccttcctcccaagtctctgtggcttgcatgtcctccttctggtgggtaggttggccaagtctgacaccctcaactctgccctccttccatagctaacaacagccctaatatccgaagactcagggattctgctgtcagctcccttggctcagccaagcaaagactgtgcttgtgggagcccagaaagagggaatggaatacttctccagagagtaggtgttgcatttctgaatattgtaattaagccagatgagtctaggcaggcccacaggacctcttcaggcatcttcttgtccatgttttgcactatgcaggagaagtgatgctgtcagccatgcaagccatggccccccatacagcagactctcctacgaagccatgtagcttgcaaacaatgccatgttttagtttcatgttacccctcctgcagatttgcacatctaggctctgcttttaaaataatcatgcacctgtcaggctggaagttttcaggaaaatccttctcacctcatgtgtgttgctggctttttttttttttttttttttttggttgtggcttcctgagaacggggatgctacagcctgccactgttggaacaaaggtgcttttagtcactctacctgtcgctcttagggaacgtacgtgccctcaggggaaataggcggatgcacattttgcttctggctcttttgcctctttatttttttcatttttatttttttgaggcagagtttccctcttgttgcccaggctggagtgcaatggtgtgatctcggctcaccacaacctctgccctctgggttcaagcgattctcctgcctcagcctcctgagtagctgggattacaggcatgcgccaccatgcccagctaattttgtatttttagtatagacggggtttctccctgttggtcaggctcacacttctggaggctagaagtccaagatcaaagcatgccacgttcagtgtctggtgaggacctgcttcctggttcacagacggtgccttctcactcttgtcatcacgtggcagaagggtcgagggagctctctggggtcccttttagaaggacactcatctcattcctgaggccccaccctcatgacctcatcacgtcttaaagggctccacctcttaacactatcaccttgtaggttatgtctcaagacagggatctggggccgggtgtggtggctcacgcctgtaatcccagcactttaggaggctgaggcaggcggatcacctgaggtcaggagttcgaggccagcctggccaacatggtgaaaccctgtctctactaaaaatacaaaaattagccgggtgtggtggtgcacacctgtaatcccaagctactcaggaagctgaggcaggagaatcgcttgaacctcggaggcggaggttgcagtgagccgagatcacaccactgcactccagcctggcgactgtgtgagactccgtctcaaaaaacaaaacaaaacaaaaaagcaaaagcaaaaacaaaacaaaacaataaccaaaaaatggggatttcgagaggacacagacattgaaaccatagcacatggcgaccttgagtctttgagtttacgtgtgcagcatgaatgctcggtggtgatggatgaagagagagcaaggggggaatgccacacacttctaaactgtcagacctcgtgagaactcactcactatcatgagaacagcaagggggaaatccgccaccatgatccaatcacctcccaccaggtccctccctcaacgctgggaattacaattcaacgtgagatttggatggggacacagagccaaaccataacagcagcaatagtaaactcatacatcatatctatacatctctcctgaaccatccctgctagactcagtaggacctgtagagaccatctttccctgtattccttcaacatcctgcttccttatcatatgtttctaaggttgtatagttccatgagagattacagctacttttttttttttaagacatctcatcctgcaatgcagtcttttttttttttttttttttttttttgagacggagtcttgctctgtagcccaggctggagtgcagtggcatgatctcagctcactgcaacctccgcctcctgggtcccggttcaagcaattctcctgcctcagcctcccgagtagctgggattatggggacgtgccaccatgcacagctaagctctgtatttttagtagagacagggtttcaccatgttggccaggctggtcttggactcctgacctcatggtttgcccgcctcggcctcccgaagtgctgggattacaggtgtgagcgaatgggcccggccaatgcaatcttttagcaggaaatccatccaggattttggaatcaacagaaaagaaaaaccttgggttttggagtctcagattctggcggtcctgctagatgtgttgacgagtgtgttgggccagttaattaccctcataattgttctaattgcttttatcctgcaaatatccctctgtgttcattagctttgccattacgactgagcccaagtggattaaagaaagcctgtgatgccaccagacatcatttttgtttcggcaaaacagctttctctaggaatctggccttaatgtgttttggatgccccccacactgacagggtccttcatgagctctcctggatagaataacacaaaaaactcaaagcccattttaagaaacagcagcatcattaaaaaaaaaaaaaaaaaaaaaaaacctccactgccagcccacaggtcgctcattttcttcctagaaataaattccagttgagtggacacgtcttttacgggggaatttcagtcgtgattgatcatccgttgacctgtttaaaatgattgtcaagtgactgggctatcctcattcacagataactcaggcaggctcagattaattaacccttcgtttgtttgccatgtaggactaattagtcatcatccatctactgggaatcagacgtcattggcacagttatcaaggacagggactttgccggcttatcatgtagaaggaagaattaatggtgttggtgatatatggtcttgtgtagtggtagggtattcctctccctcttttcttcatgttcttctttctttgcttgccacacattcatttacaggggactctgaagccacgtgagggttaggggcacgtgaagaccttgtgtaactcttcactcccccaaaacttaactaatagcttgctgttggctggaagcctttcctgcaactagacggtcccatctaggggtaatgggagacagtgacagatcatgaggcaggtcattattgcaccagacacaaataatatagtaatattcttacaataaagtaagccaaaggccgggcgcggtggctcacgcctgtaatcctaacactttgggaggttgaggcaggcgaatcacctgaggttgggagttcgtgaccagcctgaccatcatggggctaccccgtctgtactaaaaatacaaaaaagtagccaggcgtggtggtgcgcacctgcaatcccagctactcggggggctgaggtaggagaatcacttgaacctgggaggtggaggttgcagtgagccgagatcgcaccactgcactccagcctgggtgacaagagcacaactctgtctcaaaaaaaaaattaatcaagagaaaaaaatatagtatgtattatatactatattcttacaatgaagtaacctagagaaaaatatagtaaatattctatattatattcttacaataaagtaagctgtgattttccttaagaaaatcgtaaggatgagaaaatatctttactgtttatcaggtggaagtggctcatgataaatgtcttcatcctcgtcatcttgacgttgaggaggaggaggaagagaagggggtgtctcgggtggcagaggcagaagaaaatccacatataaggggacacccattcaattcaagcccgtggtgttcaagggtccactgtcataggggaggctcaatattttagtttcctggagctgctgcgacacaattctacaaaccagctggctgaaagccacagaagtcaaatctctgacagctctgaacaccagaagtccacagccaaggcaggctgaccacctggtcatccaagggcagagcccgtgtcaaaggacattcctggagcagaaagccaacacatccgggtggaaatacaaccttccagtcactaagtatatttgcaaatctccagcaggtcactattgcaccagacacaaagaataagcgttcagtaagttgaagtattgtgtgcacacggccgggcgcagtggctcatgcctgttatcccagcactttgggaggccgaggcaggcggatcacgaggtcaagagatcgaggccatcctggccaacatggtgaaactccatctctactaaacatacaaaaaattagccgggtgtggtggcacgcacctgtagtcccagctactcaggaggctgaggcaggagaatcacttgaacccgggaggcggaggttgcagtgagctgagatcatgccactgcactccagcctggcgacagagcaagactctgtctcaaaaaaaaaaaaaaagtattgtgtgcacactgcaattatgaaatgcatttcattctggagtattaaggcagggctgtgccccttgcggaggctctggaggaggatcctccgctatctcttctggcttccttcgctagctagcaatcctggttgtttcttgtcctgtagaacagaggactccaaccccctggctgtggactggtactgagcaaagcttcatgtgtgttcacagccacttcccactgcacgcattaccgcctgaggtcacctcctgtcagatcagcagtggcattagattatcagaagattgagaaccctattgggaagtgggcagaccagggatctgggttgcatgcttcttatgagaatctaatgcctgatgatctgccactgtctcccatcaccccccggatgggaccatctagttgcaggaaaacaagtttggggctcccactgagtctacatggcaatgagttgtattgtagaattacttcatttaacgtatcatcatagaaataaagtgcacaataaatgtcatacgctcaaatcatccccagatccttccccctgcactcacagtgactgtctttctatgaagacagtttttgtgtgtgtgtggaaaaattgtgttccatgaaactagtctctgtgccagaaaggctggggacggctggtgtagaagcatcaatacagtatctgcctttgtcgtggccatctctgtgtctctatgccacagtgttcctcttctccttttttttttttgagatagagtttttgctcttgtcacccaggctggagtgcagtggtgtgatctcggctcactgcaacttctgcctcccgggttcaagtgattctcctgccttagcctcctgagtagctgggactacaggtgtgcaccaccgtgcccggctaatttttgtatttttagtagagacagggtttcaccatgttgggcaggatggtctcagtctcctgacctcaagatctgcctgcctcagcctcccaaagtgctgggatgacaggcgtgagccactatacccggcctccaatgttccttttcttataaggacaccagttattcagttaacagcgtacactactctaatgcaacctaattgtatgcaatgacaacctagttgtatgcaatgacactactctagtgcaacctaattgtatgcaaagatctgatatccaagtgagctttcattcctaggttctgggtggacacatcttggtgaggtcacagttaaacccacgtcacccaaggctaggggcagaatcagagtggatgttagatctccaggctcttgttctgggagtgtcattcaaagcctttcttcatggccacctgaatgacgatgtcatcctctgtgggtaacagacaccagcattgtgaatgatgctggcttcctttgctggtttctttctgacatttcccttttgtgctttcgtttatggcaagtgtagacatacatgcacactcagacacatacacacacgcacacatgcactcttgccatctacaatgcctcagatccgtactgcaattggccccagccaccctgtagaatttagatttagcgaaaaaagacttcacgtgttcgccaaattctgcgtttcctcctgagtcagaggcacctgcaatgcaggcagcgggaagttgttcttctaccagaacaagagcccctaggaaaattgccccttttattactgttttggtcaaaatatggcaacaacattggtgactccaggcgagttagtaaaaatcacagagaggcacattttgtgtccggggaatgctgggatgctcctaaaacccactgagccggccgggtgcagtggctccagcctgtcatcccagcactttgggaggccgaggcaggtggatcacgaggtcaggagatcgagaccagcttggccaacatggtgaaaccccgtctctactaaaaatacaaaaattagccaggcgtgggggtgcacgcctgtagtcgtagctactgaggaggctgaggcaggagaatcacttgaacctaggaggcggacgttgcagtgagccgagatcgcactactgccctccagcttggcgacagagtgagactctgtctcaaaaaccaaccaaccagccaaccaaccaaccaaccgaccaaccaaccaaccatcccatcgagccgttctcttgctgactcaagagagaataaatcaagaaacaaacacacaaggaaaccaaaacaaccctgtagctgaggattctcccctaggaggaagaaaacgggcatccacacggcgtgtgcccagctaaatataaactgcgaggggaagggaggagacagtgatgacaagccccagccttttccacaagaagaaaaaggtttaagttttcaatgctgcccatgatatccaagaacgaaccgcatttcacagccgcggtgtgcataccatactttcacttatcggaagctcattcattgtgtgatgtgcactaattacccgctggagatttgagaacgcacctgctgactgggagggcgtattcccacctgatgtggttgctttctgcactccagaaattccctttgagatgggctccatccttccatgacagcgtgaccgcttgtcctgtagtcacagtgttgtctgaagaatgcaggatagtttattttcatttttgtttatttatgtttctgttttagaggcaggttcttgctctgttgcccaggctggagtgtagtggtgctatctggctcactgcagcctctacctcttggactcaagcgatcctcccacctcagcctcctatgtagctgagactacacatacatgccaccaacacccagctatttttattttttatagagacagggtctcactatcttgccctgggtggtcttgaactccagggctcaagggatccttccaccacggcctcccaaagtgctgggattacaggactgaacctggccttgctgtggtctgtttcgagaagactttgtttttcgttttttgttttttggtttttttgagatggagtctcgctgttgtcacccgggctagagtgcaatggcgtgatctcggctcactgcaacctccgcctcccgggttccagcaattctcctgccttagcctcccaagtagctgggattacaggcatgtaccactatgcctggctaatttttgtatttttagtagagatggggtttctccatgttggtcaggctggcctcgaactcccgacctcaggtgatttgcctgcctcggcctcccaaagtgctgggattacaggcgtgagtcactgtgcccggctgctcacccagctatttttattttttggatggggtctcactatgttgccctgggtggtcttgaactcctgagctcaaggaatcttcccaccacggcctcccaaagtgctgggattacagccctgagcctggcctcactgtggtctgttttgagaagcctttgtttttaaacagaaccacatgttggtatttcagagccaactcttctgtcaagaatccaaatcagccaggcacggtggcatgcctgtgtagtcccagcaattccagaggctgagacagaaggatcatatgagcccaggagtttgagatcagactgggcaacatagtgagactccatttctttagaacaatactaatcacatgagggtggtaggccattgcctgggctggacaggtgagtagagggcaggtgtgcaggtgcagaggtctttttttgtcctcattccatgcacgactgtttctcaaacttgctatgctaagatgctacaggaacttactttacgtcacaatatcattgaccttttttcttccttcctgtggcttcctcttcccccactctctcacctgtgtgccctattttggataaccctcctcctgggttcctttctcaccatctcctgctgtcaacatctcacctctatttcctggccggatgatgcctcctccaggaagcctgcctaggtttcctgttggcttgcaaactctatgtgggtgcgaactgtccacaccgcgtcaggtacgcaggggcccttgaagtatcacacgttggcagctcagccctgaaaacttcagctccagatacaacaaccccttccccttttctccaacctgataatttataactccagggtgactcggttcagcggcactgcagtccctcagctcttccttgcagcagccgtggtttccatgggatgtagagggttatcctgcttggaaagcattagagctgggggactagagaccccctaattctggcgtggggagaatggaggccccagaggaaatggagcaggtgttttagtggaaaagctggttttgaaattccagcctcgcctcagaacacagcatagcttccctagatgatgtttcttttgaaaggtctcctctgaaaagagtgtgaggattctggcaaacttgcaacaatctctgtaacgatgggatggctgtgtccccacccacatggcacctggaattgtaatgattcccacctgtgaagggtggggccaggtggaggaaattgaatcatgggcgcggtgacccgcatactgttctcgtggtagtgagtgtgttctcacgagatctgatgttttataaatggaagttcccctacaggagccattttgcctgccgccgtggaagatatggttttcgtcttccgtcgtgattgtgaggcctccccaaccccgtggaactgtgagtccattaaagctctttttctttataaattaccccgtctcgggtatgtctatcagcagcgtgagaatgaactaatacagatgcaaagtagagccgcggtttatgagccacaagaaataccaacccccagccaggcgcggtggctgacgcctgtaatcccagcactttgggaggccgagaccggcggatcacctgaggttaggggttcgagaccagcctcgccaacatgatgaaaccccgtctctctactaaaaatacaaaaaattagccgggcagggtggcgggtgcctgtaatcccagctactcgggaggctgaggcaggagcatcgcttgaacccgggaggcggaggttgcagtgagccgaggttgcgccattgcactccagcctgggcaacaagaggaaaactccgtctcaaaaaaaaaaaaacaaagaaggaaaagaaaagaaataccaacctctccctttcaaacctaaaaccccaacatgctggatgctctagggggtctctggggcttcgctgcttacgtttgcccttgttgggtcctgggtttttatactcaacgggatcctggaatttatgtttcatttgtgattcggttccaatttgacacaactgcctgccttcccccagcggttcgtgtgatagacacactcacgctgtcaatcatggagctgtggggcgcgtctgggagatctatagcaaaactccatccactccggttcccttgtataatacaaaagggttttatcagtcatgtatttcgcctcaaaactagaagcatggatttcccaacccgattcaccattaaaattgtgaatttttctggttctggtaaggatacgttgactgtataatggattacataacagtgtgttttcttcaccttagtaagtagccctgggagtttgtagcaaagaaagaagaaacccgagcctcaagaaaatttctccgacgatggtgcccagaacaggggtcaggggtcacgtgtgatgcgcgaaaattaaataagtgataattaagggaaaagaaaaactcagtgcctcattgcactaactgtctggcaagcgcccagtgtccagctgtggacagcacagttgtctggggcagggaagatatggactttcctgcagagagtgctactctgcagcagtgaggtacacctttcagggatgtcccatgatggtgacagagacaccagatacacaggtagcaacagtttcatttgaaaagatcattcccacagatgggagcttttgcaataagaggaggagggactactgtaatgggaggaggaggggctgtgataatgggaggaggaggggctgtgataatgggaggaggaggggcggtgataatgggaggaggagggactatggtaaggggaggagtgtggactatggtaacgggaggaggaaggactggtaacagaaggagggactctgctaatgggaggaggtactatggtaatggaaggagggactatggtaacagaaggacggactatggtaacggaggaggggctgtggtaacggggagggtctacggtaacgggaggaggagggtctatggtaacgaggagggactatagtaacgaaaggagggtctgtggtaacagaaggagggactatggtaatgtgagaaggggggactgtggtaacggagggtctatagtaatgggaggagggactatggtaacggaaggagggactatagtaacgggaggagggtctatggtaatggaggagggactatggtaacagaagtagaagggtctatggtaatggaggagggactatggtaatggggagggactacggtaacgggagaagggactgtggtaacggaggagggtctatggtaacggaaggagggactacggtaatggaggaggggggactatggtaatggcggggagggattatggtaataggggaggaactattgtaacaagaggaggagggactaatgcaaccactggtggacgctgcctatagcaccatgaagcacacccgagcagtgacatctgggagcctcttggagcgcaggcagcataccattttcttttctagggacaggcacgtgatgctcggaacaaccgtgattggggtcgttcgatgtggggttcagtcatggataaaagctgccaaaccctgtggctgcatagctaattttgagcaggtcctaaggaagcgttgcttgatcctctgacgtttgctccaggtgaggctggcccaacatcccggggcctgataggaggagagaaacccaaccaaaatgtgatcacgttagatgggaattttgttcaggtcaaggaagacgaggaattcagtccatccctgaaggggcaaataaagaatgtgaatttggaggatgtggccagccttgtcctaggctgacttggaagcatctgtgagtaatgaggaagggaattttttttttttttttttcagtaaaaccattttctggaagacaaaggcagtggggaattcttaaccttcacagattcccaacagcacagttgtgtggaatgatggactgattgtgtctccgtaaaatacaaagccctcagctgggcgcggtggctcagactgtcatcccagcactttgggatgccgaggcgggtggatcacctgaggtcaggactttgagaccagcctgaccaacatggtgaaaccccatctctactaaaactacaaaaattagccgggcatggtggcgggtgcctgtaatcccagctactggggaggctgaggcaggagaatcgcttgaacccaggaggcggaggttgcagtgagccgagattgcgccactgcactccagcctgggagacagagtgagactctgtttcaaaaaaaaagacgaactgggactcctcaaactgggggaatggtgcatttgtagacaaaactcatggtgtgccatctgcaggtgtcattgtcaggaaggtgagcttggttcatctgtgcccacttgcaagctctttggagagtgaggagcaggttgggaagcatctatcctcagtcatgaacccggagctcctgctggaaaagacagccttggggtctctgtcatgcacatttcagtaggggagtccgggccgggcacaggggctcatgcctgtaatcccagcactttggaaggctaaggcgggcagatcacttgatgtcaggagtttgagaccagcctgaccaacatggtgaaacccgtctctactaaaatacaaaaaatagctggggctgggtgctgtggcttaggcctgtaatcccagcacttggggaggccgaagtgggtggattacttgaggtcaggtgttcgagaccagcctggccaacatggtgaaaccccgtctctactaaaaatagaaaaaattagccccggctaattttggtggtgtgagcctgtagtcccagctacttaggaggctgaggcaggggaatcgtttgaacctgggagatggaggttgcagtgagctgagatcgtgccactgcactccagcctgggtgacagggcgagactctgtctccaaaaagaaaaacaaacaaaaaaaaacaaaaactaaacacataggagagtcccttagcccctcacgaatactccacacacacatctagtccagctgcatcttgttgactcacaagacatcaagataagcctgattcaatgaagttcttcaaaatcagagttcatttgctcattttcttttcttctctccaccaattagtggtgagagtttcgcctgaatcacagtacctgctgtctccagttctgatgttggtatcacccatcttcagacaagatttcttgtgttatttccacatcagcttagccactgtctctcaacatgaaatgctggctggggggaagtttcaaccgcagaagcaaagctcttaaactcattgaaaagacaagctctttcccccttggtagggtcacgaaggctcctcagtgaagggtgtggtaggtttgcttctatagggtagaaatgagacaccctgaaaatcaggaggctttcattggcttttaatttacacagaaggcaatgtgtagtttcaaaatattcttttttatttacttatttacttttatttatttatttgagatggagtcttgctctttcgcccaggctggagtgcagtggtgcgatctcggctcactgcaagctccacctcccgggttatttatttttttgagacagagtcttgttctgttgcccaggctggagttcagtggcacaatcttggctcactgcaacctccgcctcccaggttcaagtgattctcctgcctcagcctcctgagtagctgggattacaggcacctgtcaccatgcctggctaatttttgtatttttagtagagacggggttttgacatgttggccaggctggtcttgaactcctgacctcaagtgatccgccctccttggcctcccaaactgctgggattacaggcgtgagcttccgcgcctggcctcaaaatattcttaatgagtaaatacccgtaagcatttgaatacaaccatttatgttttttgttgtttagcaattgtttgaacttcaatgtgcctcataaaaatgtttcattataaaacatttcacacatttgaaagacgcagagaataatttgaacagcatttgtgtacccaccatccagttgtatcaaatcgtaatgttttgccaaattagttataaattacgtatgtgacttgggtacccctctccaattattttgttattacataaaaaatgactttataacatgggtcaataggagaccttttttcttttttttttttttgagacagagtcttattctgttgcccaggctggagttcagtgccacaatcttggctcactgcaacctctgcctcccaggttcaagtgattctcctgcctcagcctcctgagtagctgggattacaggcacacggcaccacgcccggctaatttttgtatttttagtagagatggggttttgacatgttggccaggctggtcttgaactcctgacctcaagtgatccaccctcctcggcctcccaaagtgctgggattacaggtgtgagcctccgtgcctggcctcaaaatattcttaatgagtaaatacccgtaagcatttgaatacaaccatttatctttttcattgtttagcagttgtttgaacttcaatgtgccttctaaaaatgtttcattataaaacatttcacacatttgaaagacgcagagaataatttgaacagcatttgtgtacccaccatccagttgtatcaaatcataatgttttgctaaattagttataaattatgtatgtgtctttgtgtgcctgagtgtacatgaaataagacatttcagagactattgtgctcttgggtacgcctctccaattattttgttattacataaaaaatgactttataacttaggtcaataggagacatttaaaatattattttccatgcatctttgtccttgtttattttctctagaaaagaaaaatgtatttccctgttcttattttcaattcccaaatgaagcttcaatgtaaaactaattttctgagaatgtagcatcgttcttttttttttttcttttttctttttttttttgagacagtcttgctctatctcccaggctggagtgcagtggcacaagcttggctcactgcatcctctgcctcccaggttcaagcgattctcttgcctcagcctcctgagttgctgggattacaggcacctaccaccacgcgtggctaatttttgtatttttagtagagacgggatttcaccatgttggtcaggctggtcttgaactcctgactttgtgatccgcccacctcagcctcccaaagtgctgggattataggtgtgagccactgcgcccggctagcatctctctgtatttgctgaagccatgtgtgctgtgaagattgtagttttagccattgtggttcctcttgaaagggggccctatatcttcctgatggggaatggcttaactgaagcctggggaatggctggtgttcgtgaaatggctgcattcagatgagaaaccgcacatacacatcctcacaaagtctcagagtcagctttccagggggctgggttttattccggtgcaaaggagtgagaatattgtacacacgaatgatccatggtggctcctgcctgtaatcccagcacttttgggaggccaaggcgggagcatcacttgagcccaggaatttgagactagcctgggcaacatagcaagatctcgtctctacaggaaaaaaaaaaaaaattatccgggtatgatggcatatgcttctggtctccctctcaagatgctgaggcaggaggattgcttgagcccaggaggtggaggctgcagtgagctgtgactgctccactgctcttcagcctggctgatggaatgagacagtgtcacagaaaaagaatgagaaaaataagcccaggatgcagcaaagaatgctatcctttatttattaaccccctaccctggttgtatattgatggtcatttaaatattagagggtataaaaatacaatttccaagaattacctgaactattttctttttcttttcttttctttttttttttgagactgagtttcgctcttgttgcccaggctggagtgcagtggcgtggtctcggctcaccgtagcctccacctctgggttcaagtaattcttctgtgtcagcctcccgagtagctgggattacagccatgcccaaccactcctggctagttttgtatttttagtagagatggggttttactaggttggccaggctggtctcaaattcctgacctcagatgatccacctgcctcggcctcccaaagtgctgggattaaaggtgtgtgccaccacacccggcctattttcttagaattaatattttatcctctgccatcagccgtcgtaggggtatgagcagtttcctgcctattgtaagggtttagagaagggtttgtgataaattggccgtgtggtgaagagattcccattcgggaaagacattgggcagagggtaggatgtcatgtgaagacagcattcatttcaggcagggagagggggttcatagaacgctagtgttcagtgaactgttcctagaactagttcatatgtatacatgtgccatggtggtttgctacacctatcaacccgtcatctaggttttaagcccagcatgcattaggtatttgtcctaatgctctccctccccttgccccccacctcccgacaggccccggtgttcacagagctctagtatccacccaaggctcaccaaaggcagtcaccctttgctatggtggagtatcctgggagccataggtatccctgagctacctcaggttaaagactgcatacctgtgaaagcatgtgaggatttacccatttctgtgtattttgaggaaatctcacttccatcttcagagcttggtagccccaaggtaaaattttaagaagtaaagagattgtaagtttgcatattctgggaggtgatatgaggacaagctcttaggatgaactctctaggcatacaggagaaagaagtaaaggtcaaagcaaagtggcatcaaaaaggccaaaacctggccaggcacggtggctcacacctgtaatcccagcactttgggaggccgagatgggtggatcatttgtggtcaggagttcgagaccagcctggccaacatggtgaaaccctgcctctactaaaaatacaaaaatcagccaggcgtggtggtggctgcctgtagtcacagctaccagggaggctgaggcaggagaatttatttaagttccttgtagattctggacattagacctttgtcagatgaatagattgcaaaaattttctcccattctgtaggttacctgtttgctctgatgatagtttcttttgctgtgcagaagctctttagtttaatgagatctcatttgtcaatttttgaggcaggcattgttattaccccaatttcataaatgaggaaatgacagacagatagatagatagatagatatgccagttgtccctgaggaggcgaaattttgctcagttgaaaaccactgtgatatagatagatgatggatacatagatagatattagttagacagaaaatagctagatagataatagctagatagatagtaatggtcaatgatagattgtgatcaatgataggtaatagatgacaggtagataaatgatcgatggtcaatagatgataggtagatgatagacagtagatagagagtaaacagatgctatataatgatcaaagatagataaatgatagataaatatgtacttgatagataataaatggtaaatagataaatgatggtagataagtagatgatagatgataaatggtaaatagataaatgatggtagatagataagtagatgcttgattgtaaatggtaaatagataaatgatagacggtagataagtaggtgataggtggtaaataggtcgatagatattctataaatagttgatagataaatggtaggtgatagatgataggaagtgagttggatgataggcacacagacaaatggatcacatatgcatacaatctgtcatgctaaggcaggctttgtcaaccttggcagtatgtccatctggagctggatgattctctgtggtgaggccatgctgtggactgtagcgtgttgagcaggatccctgggctccacccacttgacatggatgtacccactataccccccaccgcagttataacaaccaaaaatacctccagacatttctatatgttcctgggggagggggaaacaaaaaggcctccaatggaaaaccactgatgtagatccctacagatgccagcccagttctgtggggatgtgcctactaccattcaatggcagtaacctggacctaagaccagtatgctctctgaggctctggaaagggactcccagcctcgcatcttgaggagagcttagacatcctacgtagcattatgattcccctccaaacatggctgtgctgtgtggatcaggggtctcctcccttatctcctccatcccacccagccgtctcctttcacctcagtccctgtgtgttgagtgtggaaatatctctgtgcccaggatcctgggccggttttgtggcggggattcttctcccacagctccatcatgcatgttccctcatctccttcgatgctgatgtgttattattcgtagaacagtgatgaaatggcagcatgataccatagaacggtgataaaatggcagcatgatatcatagaacggtgataaaatggaagcatgataccatagaacggtgataaaatggaggcatgataccatagaacggtgataaaatggcagcatgataccatagaacggtgataaaatggcggcatgataccatagaacagtgataaaatggaggcatgataccatagaacagtgatgaaatggcagcatgataccatagaacagtgataaaatggcggcatgatatcatagaacggtgataaaatggaggcatgataccatagaacggtgataaaatggcggcatgataccatagaacagtgataaaatggaggcatgttaccatagaacagtgataaaatggcggcatgataccatagaacagtgataaaatggcggcatgacaccatagaacagtgataaaatggaggcatgatatagaacagtgataaaatggaggcatgataccatagaacggtgataaaatggcatgataccatagaacggtgataaaatggcagcatgataccatagaaaggtgataaaatggcatgataccatagaacggtgataaaatggcggcatgataccatagaacggtgataaaatggcggcatgataccatagaacggtgataaaatggcggcatgataccatagaacggtgataaaatggcggcatgataccatagaacggtgataaaatggcatgataccatagaacggtgataaaatggcggcatgataccatagaacggtgataaaatggcggcatgatatcatagaacggtgataaaatggcggcatgataccatagaacggtgataaaatggcatgataccatagaacggtgataaaatggtggcatgataccatagaacggtgataaaatggcggcatgatatcatagaacggtgataaaatggcggcatgataccatagaacggtgataaaatggaggcatgataccatagaacggtgataaaatggcggcatgataccatagaacggtgataaaatggcggcatgataccatagaacggtgataaaatggcggcatgatctcaagggttgggattagacacccagaaatgggagcacctgtggttgggtggagttattgatccatccttctccagtgttcaactcctccacctatgctcatatcacttataaggcagacctggccaggcatggtggcttatgccggcaatcctagcactttgggaggctgtggtgggcggatcacgaggtcaggatttcgaggccagtctggccaacatggtgaaaccccatctctactaaaaatacaaaaattagtggcatatggtggtgggcgcctgtaatcccagctacttgggaggctgaggcagaagaattgcttgaacccgggaggcggaggttgcagtgagccaagatcacaccactgcattccaacctggtcaacagagtgagactctgtgtttcaaaaacaaacaaacaaaaacaaggtagaccttatgggtctttccctgggagccttctacagagtggttgttgctacagacagcagtgatatgagacaaaccatctaaggccctgaaatatgagtcttgaaaatggctgtggacaaggaaaatcaatgaaataacagtgacaccagcaccccactctctctagggctcttaaaagttcttagcctgtagcctcttttccaatccactccagccttccttttctttgaatttgaaaatgaactttgaaatttctttcagtgacaagaaaatgtcactgtgttacgtgttgtatatccatgtgtctccttgggaagaaaattaaaggactaattgaagaaagaattagaaacactgaatccacagaaacgcagccacactctgtaattaatttttgaagaaaagaaaatgaaatgcttgccgatggtgaacctctccagcatgttcattagatatttgcattttctgcctattccattaaaagtacctctaatcagacagtcaatcaaaagtgcttatccagacatcttctttttagaatttgaatcatgccatgttctgtataggagtgagaccttaccacataaacagggtagggcttgctgtgtgctcagaaacgacacattaaccaggctgaactgatggaactccagctctctgtatccttctttgtccctctaatacttgggcagattctgccccaccattaaaaattcaatcattaataccaagaagaaaattgaggggtttcaaagaacctcaataaaccacagatttaggtctttataagaccttggtaagcagttgtggattctatagtttgtacctaccataagttatgatgatcattatagcattactgataacattttaaaaacttttattgagctgggtgcggtagctcacacctgtaatcctggcactttgggaggctgaggcaggtgtatcacgaagtcaggagtttgagactagcctgaccaacatggtgaaatcccatctctactaaaaatacaaaaattgggtgtggtggtgggcgcctgtagtcccagctactcaggaggctgaggcaggagaatcgcttgaacccgggaggtggaggttgcagtgagccgagatcgcaccactgcactccagcctggcgacagagtgaaaactccatctcacaaacaaacttttatgataatgtgtatggaaagtgtctcctcttgaaatgttccattttctctaaccaaagccaacgctccagccagccagtaggtagcagccagtaggagctgtcagaactgattgctcttatcatcactaaacacacaaagagggaaaagccatttcctcattccccaaattccagctccatccttcctctgaaagcatcatgccatttctcgctccggatatgtatttggtgtttagtcattcaaccgtgacatatctaacgttggcagagagggggcagaattcgaagttcttgccattccaggaagaggaagccatgttccctgtctaagcatctgcccacatcgggccgtgtctcggtaccaactccaccaagagagcagtgagtgacaaaggcaaggatgttcttaccaaacttggcgataacctggctccattaccatcctagattaataacccttcagtcattccagaggtggatgttgatacccaagaaatggtgggtgatgtgtatttttttgttgttgttgttgaaacagagtctcactctgttgcccaggctggagtgcagtggcgcgatcttggctcactgcaatctccgcctcccgggttcaagcgattctcctgcctcagcctcccaagtagctgggattacaggcacgcaccaccacacctggctcatttttgtatttttagtagagacagggtttcaccatgttggtcaggctggtcttgaactcctgccctcgtgatccgcccaccttggcctcccaaagtgctgggattacaggcgtgagccaccacgcctggccccattataaccctcttgcatagtctatccttcactcttgcgaaatgtttaatgagatgttgaataaatgttactatgctttgtatctttttttttgcttctatgtcacttttctttttgccgtgggtggcaatggtgagttcttttgcactcagggaagcttcatgcctcatcaccccaaccttctggaaattttgattcttatagttcaaacttccataatttttaaaaaccatttttaagttcagggatacaggtgcaggtttgttacataggtaaactcgtgtcatgggggtttgttgtatgattatttcatcacccaggtattaagcccagtacccattagttattttcctgatcctgtccctcctcccaccttctgataggcctcaatgaatgctattcccctctctgtgtccatatgttctcatcatttagctctcacttataagtgagaacatgtagtaatttggttttgctgttcctacatagtttgctgaggataatcgcctccagctccatccatgtttctgcaaaggacatgatcttgttcttatttatggctgcatagtattccatggtgtctatgtaccatattttctttttctttctttctttttttttgatatggagtctcgctgtgtcacccaggctgctggagtgcagtacccttgaaaattcctctgcctcagctcactgcacccttgaaaattcctctgcctcagcctcccaagtagctgggattacaggtgcacgcccccacgcccagctaatttttttgtatttttagtagagacggggtttcaccatgtgttggccagactggtctcgaactcctgacctcgcgatccacccgccttggcctcccaaagtgctggaattacaggcgtgagccaccgcacctggcctatgtaccatattttctttattctgtctaccactgatgggcattcagattgatcccatgtctttgctattgtgaaaggtgctgccacgaacatacacgtgcatgtgtctttatgacagaatgattgatgttcctttgggtatatacccaggcatgggattgctgagtggaatgatatttctgtttttaggtctttgaggaatggccacactgtcttacacaatgttggaactaatttacactcccgccaacagtgtttaggtgttcctttttgtctgccaccttgccagcatctgttgttttttgatgttttagtaatagcctttatgactggtgtgagatggtatctcattctggttttgatttgcgtgtctctaatgagcagtgatgttgaatgtttttgcataggcttgtcggctggatgtatgtcttttttttttttttttccgagacagagtctcactctgtcgcccaggctggagtgcggtggcgcgatctcggctcactgcaacctctgctccccgggttcacgccattctcctgcctcagcctcgcaagtagctttggtttttgactttagttacatgcactttttcagaaatcaaggtatgcataagcaaagcacatctgtctttccaaactggatttaaattcgccatttactaactaaggaatattgtgcaatttagttaacttctctaagcctcattttcctcgtctatgaaatgggaagaatagtaagatctacctcaaaagaatgttgtaaaggttaaacaaggtaatcaaattgtttagtaatatgcctcccacatatcaagccctcaaccccgccaccatgcctggctaattttttttgtattcttagtagaggcagggtttcaccgtgttagccaggatggtcttgatctcctgaccttgtgatccacccgcctcggcctcccaaagtgctgggatgacaggtgtgagccaccgcgcccggccagctgcatgtgtatcttcttttgaaaagtgtctgttcatgtcctttgcctgacgtggcaaagggtgtgctttcaatgggattttttttgtttttatttttgttttgttttgtaaatttgtttaagttccttataaattctggatattaaacctttatcagatgcatagttggcagatactttctctcattctgtaggttgtctgttcacgctgttgatagtttcctgggctgtgcagaagctctttgaaactttcgtaactttaaaccaagtgttagctaactccgtttctcaactgagtaacttcagaaattaaattagaacaacaggttctgccttttgaagacaaagtagcataaccctagccatccaccacatgctatcacttgattctgattgctgttttgaggattctttttgtcccaatctctaattagttttttaaaataagcgttttgtagagaggatgtttttctcaagagttaccctgttttgactatggtagccacaccccagtgatgtacatgtgtttctctattttccatttcataaccaccgttatgtaggtgaatccttgatctgacacacagtgcctgtctttccctatgaatggcttagtgatttgcctggaaatcttagcttgctgtagtgtgtgtgtgtgtctgggcacagttttagagaaacaagcaatgattcttttttttttttttttttttaatttcctgagtcccaaagtgtttgagacaaatctcgttttcccatatcgggtctagggttatttgttcagatcctttgtcattcaggactctgtagctctttctttattccttactgaaatctcacattgacgaagagctctttccacctgatttgcttttccattggcagatgtcctttttgttcctcccttgatgcttttaggattttctcttgatctttaaagctccacggtttcatcaggatgaggttgatggacatatgggcatttaaaaataaatcgtatggcttactatacatcttataatggcagatctgggtttttatctcagggattttttttttctttgcacgaaacctttccatttacaattgacccttgaaaaacatgggggttagggacaccaacccctcacacagtcaaaaatccatgtgtaactttttttttctttttcgagacagagtttcactgttactgcccaggccagagtgcaatggtgtgatcttagctcactgcaatctccgcctcctgggttcaagcgattctcctgcctcagcctcctgagtagctggcattacaggcgcacgccaccatgcctggctaatttttgtattttcagtagagacggggttttaccatcttggtcaggctggtcttgaacttgtgacctcaggtgatccacccactttggcctcccaaagtgctgggattacagatgtgagcccctacgcctggcccatgtgcaccttttgattctccaaaaacttaattattaatagcctactgtttacaggaacccttgccaataacataaacaggtgattcactcattcatattttctatgttctatgtattgcatactttatgcttagactaaagtaagctagagaaaagaaaacgttaccaagagaatcatgagaaagagaaactacatttactattcatcaaatggaaagggatcatccccgaggtcttcatcctcatcatcttcacatggaggaggctgaggaggagaaggaggaagagggaggttggtctggctttctcaggggtggcagaggcagaagaaaatccacatataactgacctgtacagtccaaacctgtgaaggatcaactatgtttctgtgtctctttctcccagttcttgtcttcagagataccaacattggatgttgcctctcaactggtttccttctctttcatgttcttttctccaatcacttcatgtcatcatctttttcttctacattctacacgcttccacaagcctgccctctgcacccctgacatgattctccacattcattttttttctttttttgagacagagtcttgctttgtcacccaggctggagtgcagtggcacgatcacggctcactgcaacctctgcctcctgggttgaagcaattctcctgcctcagcctcgtgagtagctgggattacaggtgcccaccaccacacccagctgtattttgtatttttagtatgacagtgtttcaccatgttggcctgcctggtctcgaactcccgacttcagttgatctgcctgcctcggcctcccaaagtgctgggattacaggtgcacaccaccagacccggctaattattgtatttttttttttttttttgagacggagtctcgcacttgttgcccagggtggagtgcaatggcgcaatctcggctcactgcaaactccacctcctgggttcaagtgattctcctgccttagcctcccgagtagctggaactacatatacctgccaccacacctggctacattttgtatttttagtagagatggggttttaccatgttggcctgggtggtctcaaactcccgactttagatgatctgcccacctcaacctcccaaagtactgggattacagggtgagccaccatacccagctgagtctcctcattcttgattttgatcttccctctgtctactattgtccgggcttctctaggatgtgatgttatatctcctactcgtttccggcacccttcttattatgttaccgcattaacccttttgttaaacgtttaatatttttgtgctctgaatttattattttttatctgatatgaatatattaggttggtgcaaaagtaattgctgtttttgccattaaaagtaatgatagtcttttttttttttttttttttttttttttttttttagatggggtctcgctcttgtcacccaggcaggagtgcagtggcaccatcttggttcactgcaacctttgcgtcccaggctgaagacatcgtcccacctcagcctcccgagtagctgggactacaggcatgcgccacaacgcatagctaatttttgtattttttgtagaaacaggctctcactatgttgctcaggctagtctcaaactcctgagctcaagcaatccgtcgtcctcggcttcgcaaaatgcagggattccaggtgcgagccattgtgcccggcctgataatattttgactctgactttcttttcgtttctatttacctttaaatctcttttatgttccacctgaattactcctctgtgggtatcttttataggctgtatatttgtgttttccttccaacctatttcttgctataattgagatagtgaaggattagtggtctcaggtccttctgcctcgccccacataaatcttcatttcaactgatgctcttcatttcttttttatggaatattactttcctgttttttgtgtttgcctgtttttcccatgagtcccaagatggatattttccctccatacgggcatttattttaatgcccagtcttcacccctggaggatgcgtgagttggttcttttttcctccttgccccgtggacctcagacatggacacacgtgtctgtggttttgagggctttgttttatccgttcagttcttcagctgcttaagatggacggacagaggccgagcgcagtggcttacacctgtagtcccagcactttgggaggctgaggcgggcagaccacaaggtcaggagttcgagaccagcctggccaatatggggaaaccccatctctactaaaaatacaaaagttagccaggcgtggtggtgggtgcctgtggtcccagctattcgggaggctgaggcaggagaatggtgtgaacccgggagacagaggttccagtgagccgagattgcgccactgcactccagcctggctgacagagcgagattccatctcaaaaacaaaaacaaaaaagatggatgggcagggagtggaggctgtgggtagtgattgctgtccatgacccctgtctgtgagcacctgctctctaagctgagggaatccctggtgtcatcccagcagtggcgtgttccatgctgctgtaggccaggaacatggtgcagccgaagtggacggccatccagtgatgacttggccccagtggacagctgcccagtgatgggacatctggagtagatggccgtccaacaacagttcattattgttgtgctacgtctggtgtttccagtggctggaaccactagagctccgctccattgggttggagccattccagggtgggaatggccaccaggagacgatgcctacccttctcttcttgcaccaagtcagcacccatactcaggcgaggccctgtgtctcctcctcctccccagcatagtcttgctggagtcatgtagaaaagtcatggaaaggggcttgtgaagggatacgctgccttcttcctgggctctcctggtatcccactggtactcagtcattctccttccaaactgaggtgtgtgcatacatataatttgctggcccttaaaaaccacgtgtaggcctggctcctgtaatcccagcaatttgggaggccaaggcaggaggatcacctgaggtcaggagttcgagaccagcctgaccaacgtggagagaccccatctctactaaaaaaaaacaaaattagctgggtgtggtggtgcatgcctgtagtcccacctactcagggggctgaggcaggagaatcgcttgaacccgggaggcggagattgaggtgagccgagatcgcgccattgcactccagcctgggcaacaagagtgaaactccatctcaaaaaaaaaaaaaaaatgcaatcagctataatccttccctaaactactggtgtgactgtcttctgactccttcaactattacccaaaagatgaatgacttcttagtgaccctttgtcctaggaattatttcataggcttctgtagcaaatggaaccttgggtctcactaggataataagcatgttctgaattcctggacgcttttttctttttttcctgcacaacttcatttcggggtaaatgaggacagcacctgagttccccactcccctttggattctctagggggttgaaggtttcttctactgacatacacatggcttcaggaagatggtgttggacgctttttctttttttgagacagggtctggctctgtcgcccaggctgaagtgtaatagtgcagtcttggctcactgcaatttctgcctccgggctcaagcaatcttcccacctcagtctctcgagtagctacgactgtaggcacgtgctaccatgccctgctaatatttgtatttttttttgtaaagatgaggttttgccatttgtcccaggctggtctcaaactcccgagctcaagccatcttgcctgccatggcttcccaaagttctgggactacaggcaggagccactgcgtccagcctggttttggactcttggtcttgggtttggccaaaactttggtggttcagatggactcttgtagattttaaggagaattgaagttttgtggcttaagctgaactgctgttctcaatgcccgtgctggtccgaatgcccatgctggtccctatagcccttcatctactgtggctggtcttgtaggtctgttttatttgctgtaggagcctttgcctgtgcttgtagctatcaccgtagcattcaacacacctctgctgtatcccctgaagacgccgaaacgtggtattctcaccccaaagagtttccaccctgataagttccagcaaggcagcccagcagctacgcctgcagacacttgttggtaggaagaagtgtcagatgatctgtaacactgtgcgttgatcctgcatgtctgaagaacttcacagaattgtcgcatggtgagcagtgatactaagcaaagctgagtcacccgtaagctcccaggccctcagcccggcaagtaggacggtattttcacacctctgttgatgaagcacctcagatagctcaagtttttggagacagcctcgtaggagttttagtttaaccataatctgcttgcggatcactgatgtttccatgagtcattccctgagattgtagtgaagaaaacagatactatcccattcgcttctttgcaaaatacccacaaagccacatgcattttcatactgaacatcttgggataccatttattttcctgcaggattatatcatagtttagggttgagtgtgcctccaggagtcatcagctaagcttcctgttttgtggatagagaatacgggaggacatctgatcccctatgactgccagcatcaggcctgggattgtggttgtccaatggtgcttttagggggcaaaaatgcacagctgtttattgaaacaacaaatgttccaggctgggcacggtgactcacgcctgtaaccccagcactttgggaggccgaggcgggtggatcacctgaggtcaggagtttgagaccagcctggctgttatggtggaaccctgtctctactaaaaatacaaaaattagccgggtgtagtgttgggcatctgtaattccagctactcaggaggctgaggctggagaatcgcttgaatcgaggaggtggaggttgcagtgagttgggattgcgccactgcactccagcctgggcgacagagtaagggcagggagggctctcagtctggtagtctcacccaggtggtccagggttccagcactgagagccaggatgccaactcccaatgcatcatcagcctcctcttcagccatgcaggaagtcagggctggtcccagtggttaatccagacaccagagtgcatagcatggccctccccatgtccagcacactggcctttcactgtaccatgtcctctttctcccattgggtggcctgtgttgctttctcaatctccaagtctgtgtcagcaaggaagtgttccatcctttactgagtcatgacctgtctgaggctgacaagtgccagagctcatgttattcaggcatatttataagcaggtgtttttatttaaagacttagtccacatattacaagtattctgatggactcatcaaagcagatagggaaagttggccagtctcattttgaatgttacgatgtagccgaacatttacaaaactgtctttgactttctttctttttaattttactctaagttctgggatacatgtgcagaacgtgcaggttcgttacataggtgtgcgtgtgccatggtggtttgctgcgcctatcaaccaatcttctacgttttaagccctgcatgcattaagtatttgccctgatgccctccctccccttgcccccagctccctgacaggccccggtgtgtgatgttcccttccctgtgtccatgtgttctcattgttcaactcccacttatgagtgaaaacaggcagtgtttggttttctgttcctctgttagtttgctgagaataacagtttccagcttcatccatgtccctgcagaggagatgaactcatccttttttatggctgcatagtattccatagtgtctacataccacattttctttatccagtcttatcattgatggacatttgggttggttccaagtctttgctgttataaatagtattgcaataaacatacgtgttgaaatttttattttatcacggtcaaacgcttaccatgagagccaccctcttgacaaagtgttacatgtataatacggtcttgttaactctaggcacaactgctgtggtgtgcacagttgtacccagactgcagaactgattcatgttatataccaaaaccttatacttgtggaacagcatctccctacgtccctctctcctcatcttctgaaaaccatcattctactgtctgcttctgtgaatttgactattttagattctacatgtcagtgacatcatgcggtatttgtctctctgtgtctggtgtatttcacgttaacatcccccaggttcatccatgttgtggcaaatgacagaattcccttctttttaaggctgcgtggtattccattgtctgtatgtactgcattttctttctttttttgagatggagtcttgctctgtcacccaggctgcagtgcagtggcgtgatctcggctcactgcaacctccgcctcccaagttcaaatgattctcctgcctcagcctctggagtagctgagactacaggcacccgccaccatgcccggctaatttttgtacttcttagtagagacggtgtttccccatgttggccaggctggtctcaaactcctaactaactgcaagtgatctgcctgcctcagcctcccaaagtgctgggataccaggcgtgggccactgcacctggccaattacgttctttttttattttttttcttgagacagagtctctgtcgcccaggctggagtgcagtggcgcgatctcggcttactgcaagctccacctcccaggttcacgccattctcctgcttcagcctcctgagtagctgggactgcaggcgcctgccaccacgcctggctaatttttttgtatttttagtggaaacggggtttcaccctgttagccaggatggtctcgatctgacctcgtgatccgcccgcctcggcctcccaaagtgctggaattacaggcgtgagccaccttgctcagcccaattaccttccgtttaaggctgtaaagtatcccattgtgtgtatttacagcattttctttatttctttctttgagactgagtgtcactctgtcgcccagtctggagtgcagtggcgtgatctcagctcactgcaacctccgcctcccaagttcaagtgattctcttgcctcagcctcccaagtagctgagattacaggtgcctgccaccatgcccggctaatttttgtacttcttagtggacacggggtttcaccatgttggctgggctggtctcaaactcctaactaactgcaagtgatccacccgcctcagtctcccaaggtgctgggattccaggcaccgcgcctggcccaactaccttcttttgaaggctgcatagtatcccattgtgtgcgtgtaccgcattttcttttttttttgtttgagacggagtgtcagtctgtcgccaggcctgagccaccgcacccagctgtaccgcattttcttcatccattcatctattgaacgcttgggttcattccatatcttggtgattgtgaatactgctgccataaacatgggggtgcaaatgtctctcatagaccgatttatcttttggataaatacctagaagcatgcttgctggatcatcgagtagttctatttttaatttttttgaggaacgtccgtaccatttactgtattcacccatttctgcaggaaacagtggcagaggaacacaagttttcttcttccctgtcccagctgtgcaaaaagagacccacagccgggcgcggtggctcatgcttgtaatcccagcactttgggaggctgaggcaagcggagcacctgaggtcaggagtttgagaccagcttggccaacgtggtgaaatgtcgtctctactaaaaatacaaaaattagctgagtgtggtcgtgggtgcctgaaatcccagttacgtgggaggctgaggagggagaataccttgaacctgggaggcggaggttgccgtgagccgagatcgtgccactgcactccagcctgggcaacaggctctctcaacaaaacaaaataaaaaaaaaaaaaataaaaataagagacccacaagggctttggacctcctttctttgcaaaacaagaaaataatatagcagacattgggcagtttttcattctgactttccagtttcatttttgcttcttcctgtatggttgctgcctggacctctttcttattgctgggaggtctttcccctgcccccatccttttgagcctttctatctacttttcttttgaaagaaagtaaataaaaccccacacatccagacaataggagcgcacgcctcagaattctggctgcgagggactgaccccatccagagagaacgaacaaatgcatcaaaaccctggctgcaagcgactgaccccagcttgatccacttaagccagaagagcctttgcttctatgtttaatctgcaccaagcttagtgatcactttcttctcagaggccagaacacagagtccaacctttccaggatgccagcttcctatctctggggtctcctcttcctgcagagaagctttagtctcttacccgagctgcttctctattctcttttgccttgctttgcctataatactaacacactgtctttttcttatgttacgttggactatcccaaggcagggacccaattggcctggcttgggttccctgcctgactgtgggtttggctgaggagtgggcagcaatttccagccgttggcactgccagaacgcatgggtgtatggggtttctggaggcagcagctctatagtgaagcagatatgtagggggtgttcattaccaagacagcagtgattgtccacgagcagggtggttccaacagggagcctacagtctaactgcagatggatgctaccattttacatgtcccatgtatgacatccatgtaccgtatgttgctggacaccgcattatggcaactgaaaaacaaaaaggcattaaatgcctgggaaaatgtacagctcattacatctcatatggtttggctctgtccccactcaaatcttatttatttatttagagacagagtctcgctcactcaggctggagtgccgtggcatgatctcggctcactacagcctccacctcctgggttccagcgattctcctgcctcagccttttaattagctgggattacaggtgcccgccaccatgcacggctaatttttgtgtttttactagagacgggcttttgccaaattggccaagctggtcttgaactcctgagctcaggtgatccacctgtgttggcctcccaaagtgctgggattacaggcgtgagccaccgcgcccggccccaaatctcatcttgtattcccacctgttgtgggagggacccagtgggaggtaaccgaatcatgggggcaggtctttgccctgctgttctcatgatagtgagtaagttttatgagatctgatggttattataaaggggagtttcctgcacatgctctcttctcttgtctgtcacaatgtgagacgtgcctttcaccttttgctttccaccatgattgtgaggcttccccagccacgtggaactgtaagtccagttaaacctttcttttctaaattgcccattctcagatatgtctttatctacagcatgaaaacatacttatactttatttatccatccttatctatatcaaatactatttgaccatagattgtgtaaagacaatatggcacagagacaccatggaatactatgcagccataaaaaagaatgagttcatgtcctttgcagggacatggatgaagctggaaaccatcattctcagcaaactatcacaaggacagaaaaccaaacacctcatgttctcactcataagtgggagttgaacaatgagaacacatggacacagggaggggaacatcacacactggggcctgtcggggagtaggggactgggggagggatagcattaggagaaatacctaatgtagatgacgggttgataggtgcagcaaaccaccatggcacatggatacctatgtaacctgcatgttctgcacatgtaccccaggacttaaagtattaaacaacaacaacaaaaaaaaaaccagactcatacaacatccctacaaacaggaaaaatggggaggggaacatgggagtcaccttgtagtttacttagatttgctgtgagaagaagctatgggaggctttccaaaggctgcgggaaggatttgggctatcttcaggagattgagcttgacagcagcttcaaggcgccttgtgggaggggaggctgggggcaggaaaatcaggtgggtgaaaaatacactgatttgcagagaaatggtgccagcctggactgtgaaaacagagacgagaaaaaccacactcggcaatatttgagcacgtattaaatcctggatggcacattgcatttttatggatgtcattcctaagagattcacagtcaggggaagatggtacataacaactcgggcatgtcagatgcacctctgtagctgcgtgtccagatgccatggagtgagatgcctggttttgctcatagagttagaaacattatcagaaaatacatgtatttgagttaaattttagagagtgagtagaaattcatcgggtctacaaggaggcaaagagctttcctggatgaaattcctccttggcgttcacctaaaacttactaatttcttacagaacaaggataccacgggaggtgggtgccgcagaaccagggaactgtgtgtctgagtcaagatactgcagagaaatagaaccaatatgatgtgtgtactgatagaaagcacatttattttaaggaattttgctcatatggtgatggaggctggcaagtctcaagatgtatggggtagaccagccagctggagacccagggaggagctgatgatgtagttggagtccaaagtccatctgttggcagaatcccttctggctcaggtaacattagtcttctgttctagtcagaccttcaactgattggaccaggcccacccaccataggaaggacaaattgctttactcaaagtgtactgatttagatttttttttttttttttttgagacagagtttcactcttgttgcccaggctggggtacgatgcgatctcggtgcgatcttggctcaatgcaacttctatctcccaggtttgagcaattcttctgcctcatcctcccgagtagttgtgattataggcacacaccaccacgcccagctaatttatttttatttttttggtagagacaaggtttcaccatgttggccaggctgatctcaaactcctgacctcagatgatccacctgcctcagctgcccaaagtgctgggattataggtgtgagccactgcacccagcccagtcttttgttctattatgaccttcaactgattagaccaggcctacccaccaattcctttactcaaagtctcctgatttcgatatttatctcatttaaagcaacctcaaagaaacacccagaagaacatttaatcacatatgtgggcaccatggctcagccaagtggacttataaaatcaaggatcaagggtgcctcagaacaagagtacccagacagaacacaagttgggcagtatttcaagaggcaggggaagccatggaagctgctctgaggggacttgtgatcaggtgtgtatgttagggaggtcactgtggcagcagggtatagggtagactgcaggggtcttgtggcctctgtctctgtcacaggccaagtcatattcaaatttataaaattcaaaatttttacatcattaatttgaaattttattaaataaatacagtatatatatatatatatatatatatatatatatatatatatatgcttctttttatatactttaagttctggggtacatgtgcagaacgtgcaggtttgttacataggtatacatgtgccatggtgggttgctgcacccatcaacccatcatctacattaggtatttctcctaatgctatacctccactagcccctgaccccctgacagaccctggtgtgtgatgttccccaccctgtgtccatgtgttctcattgttcaactctcacttatgagtgagaacatgtggtgtttgcttttctgttcttgtgttagtttgctgagaatgatggtttccagcttcatccatgtccctgcaaaggacatgaacccatcctttttatggctgcatagtattccatggtgtgtctgtgtaccacattttctttatccagtctgtggtcgtatagtatttctggttctggattcttgaggaatcgccacactgtcttccacaatggttgaactaatttacactctcaataacagtgtaaaagcgttcctatttctccacatcctctccagcatctctcgtttcctgacttttttagtgatcgccattctaactggcataagttggtatttcattgtggttttgatttgcatttctctaatgacccgtgatgatgggctaaaaattcagagaaaatgtaataaaatgtttaatctagctcaagtatccttcctttgttgaatcagttttcaccttttctgtctttcctgctggctggcttgctggagcccgctctcatgagtggtgcaaggtcagagatagaaaaccaggcccatgtatggttgtgtcttttcacaagttcagccttttattgatgctatttcagtttacagaagccccaagatgcacggagttttcaaggaggcaattctccttaggacttcccatttagtactgaaatggcttgagcccttggagtactggagcctgtgtgccggcagcatttagtcagagctacaggcgcacaggctcctgctgtgacccaagtcagtcagtattgcaacctatacatactaatacacttcaccaatatatgcatgttatagattaaacattctacatcaaacaacgtaacatttatcatcaagagaaaaggggtaggaaaaagcttaacaaaggagcacagggatattgatgtggacaaaaaaaagtctcctggcctggccctggagggccatcagtggtcgccatcttgcaaggaagagcctttgatatcagtggggcagagccttttgcggtggatgctgcgtaatgattacaagtgacagcaagatggcatctgttaaggtagccatttggagctgctgaagccctgttctttcatgaccacagagtcctctggtgaggattgacaatggaagagggtgtttggttgtgtccttaactgtttggatgtggtctttattgatcaggtgaacatctggctcctgtaggcatgatgccttttgaatgaaatgtaacatggaatctttttctaaggtggagtcacttatgtcaagcgtgctctacacactcactgtaagaattaaagaggaaagaagcatgaaatgtcacttgacagttaaacacaggtttattttagagaaacctgagaggggcttctggctgagttaggtcagagctcttctctcttatagactaagcacatttaagggttttggaagggggtgcttatcataggttcagaatgtttgtatgtgagggagagtttattgcagggttgaatatctctggtcagaggggaggctgtctcagggttggtatgtttttggtcggagacgggtttatcttagggttggaatgtttctggttatgctgacatgagtcatgaggctgatgttttcgggctggatttaggcggtttttaatcaaggggagcctagaatggtggtgtttgttcaagatggccatgctcccgctctgtcacccacaacctgaagaccgttatcatattgattttgtatctcctgtgcgtacctgatggagaatgactgaatgtttgaattaaaagactcagggagaaggcaaagttgtgtttaagttgcaagttgaaaaaaacaatccattggctctgttagcagctattagagaggttggggcgggagcagagtctgtagcttaactttgcttttgttatgtcgatgctatgagcgtgggaatcatggaaactgtgaataaatggaagagagtctgtcagtgacctactgctgcatcttgggccagcccaggcatccgtgagtgttcagggagacctcgggagagttctcaggcagaaactagccactcacatgcttgtcatctgcggggttgacatggtgggctatttttatgctcagacacttgggagaaagggcaggctgtacccaaaggcagataagtgctggccagatgggcttgctgggcaccgtcgaactcatggtcaccgtcctgcccaggagctagaaatagaactagccccgggacaatccgtgaggtatcaggtgagtatggcccgatacatgtgactcagagacacaaggagtgagggtgtgtgctctgtctcaatgagagaagagagaagtcagggcttgctttggcaacaccaaatgcagatatcagactcctattcagaaaccagaattctcatctcagcatttattttctggatatgtggccgacagataggcatctctgtttataatgcctttaattttgatcttgacaaggactagaggaagctcttactgaaccttcacgcccacaaacaaaagcttctaaatcggccgggcgaggtggctcacgcctgtaatcccagcacattgggaggccgaggcggacagatcacctgaggtcaggggtttgaaaccagcctggccaacatggtgaaaccccatgtctactaaaaatacaaaaaattagccgggagtggtagcgggcatctgtagtcccagatacttgggaggctaaggcaggagagttacttgaacccaggaggtagaggttgcggtgagctgacatcacgccattgcgctccagcctgggcagtaagagtgaaactccatttaaaaacaaaacaaaacaaacaaaaaaacttctaaatcacattcaggaagcattttgtaatattttatttcttatcagggagcattttgtaatattttatttcttctcaacccctgtagtggattgaatggtgcctctattttacccccacccccaccaaaaaaaaaaaaaagacaagttcaccttgaatctgtacatgtgattttttatttggaaataaggtctttgcagatgtaaaaaaggatctggagatgagatcatcctggattgcagtggatcctaaatctaatgacaggtgtccttgtaagagacggaagaggagacacagacacagaggagaaggccacgtggagacggaggcagagactggagtgatgcggccataagcccagggatgcctggagcccccaggagctgggagaggcaggaagaattcttccctagagcagggagcatgtccctgtaggcacctcgatttcacagatgtagtctccaggactgggagaggttaaatggctgcttttgtaagctccctagtttggggtcatgggttacagtggtcccatcccaacctgtaagctctggagaacatgagtctggaatgcaagcgtgtgcggtgattcagcttgatgcctgtggtgggaaaagagccccttgtattatggcttcctgctgtgtgtaagtaaaaccagtcctctgaggaaatcaaagcccagtaaacccgtgcaccctaacttcccaggatcgcaaactggagagagagcggcagccattttctccccctgccttgatttgctgaacctgccacccgtgcagcatttcccaggaggctaacctggtgatattgtccattcttggtcctccgcaatgcaggcaatattcgttgctcagctcaaatgcttgcgtctcctctttcttctctccacctgcaaaacatcttttcataggtcccattgggaacaccagctcgttggctggtatttccacactctttttccttccttttgttgcttcatctacctctgatttgccagttgtctgatgtctcctctcacgagcctatctttctcccaagcctagtagacacgaaccattgaaagcatccttgaatgacaaaagtccaaatatcaatttgcaaggtgaagactgtggcttttattatttgttctcaatggcgggtgtctggcggggagtccagtcgcctgacgttgaatgcagtcatttcctaggtgtgggtcaagattctgatgtccacaggcaataatgtccgtgaacgtgtgtatgtaccttgatggacattactgactgtggactccagaacattggacattgtatatattgatggacatcatatatatatatacacacacacacacagacagacgcacacacacaccatggaatactacacagccacaaaaaagaatgaattaacagcatttgcagtgacctggatgagactggagactattactttttttattattatactttaagttctggggtacatgtgcaggacgtgcagtttttgttacataggtatacatgtgccatggtggtttgctgcacccctcaacccgtcatctacattagatacttgtcctaatactatcactcccctagccccccacccctcgacaggccccagtgtgtgatgttcccctccccgtgtccatgtgttcttattgttcagctcccacttatgagtgagaacatgtggtgtttggttttctgttcttgtgttagtttgctgagaagaatggtttccagctttattaaaagtcaggaaacaacagatgctagagaggatgtggagaaataggaatggttttacactgttggtgggagtgtaaattagttcaaccattgtggaagacagtgtggggattcctcaaggatctagaaccagaaataccatttgacccagtaatcacatgactgagtatatacccaaaggattataaatcattctactataaagacacatgcacacgtatgtttattgtggcactattcacatagcaaagacttggaaccaacccaaatgcccatcaatgatagaatgtataaagaaaatgtggcacatagacaccatggaatactatgcagccataaaaaaggacaagttcatgtcctttggagactattactctaagtgaagtaactcaggaatggaaaaccaaacatcgtctgttgtcactgatacgtggaagctaagctatgaggacacaaaggcatgagaatgatacaatggactttggggacttggggagagcttgggagggggcagcgagggataaaagactacaaatagtgtggaatgtgtactgcttgggtaatgggtgcaccaaaatctcacaaatcaccactaaagaacttactcgtgatcggatgtggtggctcacacctgtaatcccaacagtttgggaggctgaggcgagcggattaccttaagtcaggagttcaagaccagcctggccaacatggtgaaaccctgtctatactaaaaatacaaaaggaattagccaggcctggtggcacacacctgtaatcccagctgcttgggaggctgaggtaggagaattgcttgagcgtgggaggtggaggttgcagtgagccgagatcatgccactgcgctccagcctggctgacagagcgagactctgtctcagaaaaaaataaaaagaacttacttatataaccagatactgcctgtaacccaataagttatggaaaattaaagaaaaacacacaaaaagagtatattcaggatcacttaagtaagcatgatactacatcacatctcgttgcggaaattatatggattatcattccatgagtgtaccagcttccggaagtttctgagctcatatggggagtgggaagtaggtggtctcgtgggaactgcagggctggccccttgtcaggacggtcatcactagtgacataaataccccatggtagagagagctggggtgtcttcgtcggttttgtgtcactagaaaggaacactggaggctggataatttatagaggaaagaggtttatttgggttatgattctgcaggctgtacaagaagcacagggccagcatctgtctctgctgaggacctcaggaggcttccactcatggtggaacgggaaggggagctggtatgtgtacagagaccacacgaagagacaggagggaagacagacgggagacgccaggctctatttaacaaccagcctgtggagaactcatagagtaaaaactcactcatgcttcaagaaaggacattgatctcttcaggaagaatccatcgtccgttgctcaaacccctcccattcgacctcccatccagcactgaggcttacattttaacctgagtttgggagaggaggaattttaaagcagagcctgtagattctaaagcaaaatattctgggtctcctgcttgtagaatggttgtgagtgtgacttcctttttctatttttattttatttttttgaaacagagtctcgctctgttgcacaggctggagtgcaatggcactgtctcggctcgccgcaaccttcatctcccaggttcaagcgattctcctgcctcagcctcccaagtagctgggattacaggcgcgcaccaccatgcctggctaatttttgcatttttagtagagacggggtttcaccatgttgaccaggctggtcttgaactcctgacctcgggtgatctgctggcctcggcctcccaaaatgttgggattacaggcatgagccaccatgcctggcctgggattgttatttctaaatgattccagctttttttttttttttgtctcagctgaggcacagcggtggaacttgtcgtcttatcattgacttgttatgttcatgaaggacttggaaaaccaacgctgatcctcagagtaacagcatagatcctcacaagacagtctatgaagctggagccccctgggttgtaaaatgcctccgcaccccgtctctgtttctgaagaaggaagctctgctgagcagctaaacatgacgtgcttgttaagtgtgcattggttaaagaacagatgaaggtacaggctcagtctccaaaacttcattatacaatctcacagatgagtagcaccgttcagcattgagtgacacctactttcccgtctccaggtggttagatatcatcatctccaatttaaggcccatctaagaggtgcaccttttctcgatcctgaggctcaagtgtctaaacagcaactgtaaattttctccaatcagtgtttctcccctgtgtggaaataaattcgcatccttgaagttcagctctctccttcattttacaaaaaaacaaaaaacaaaaaaacttgttttaagcaagattaaaagtgaattttctattagcagtaattttatatcactccctgtcttgcttcttttgcactcactgaattgaagagaacgatatgaaattgcctggaaataaaaatgaaagtgcttctcagagccaaacaacactactcgtgtgaaagaatatagaatgaaagtttgaagtgtccatcagtcctgaacctgggatgatcctgtcctgatatccttaacgagaatgcatctaccaagaccctattcgcaaatcagttcacattcacggtgtttgggggttaggacttgggcatgtcattacgggaaatagctttgttggcttttctggttttacatagaaagagcaataaaggtcagccgcggtggctcacgcctgtaatcccagcactttgggaggccgaggtgggtggatcatgatgtcaggagttcaagaccagcctggccaacatggcgaaaccccatttctaatgcaagcagggcttaaaacctagatgacgggttgatgggtgcaggaaaccagcatggcacatgtatacctatgtaacaaacctgcatgttctgcatatgtatcttgcaacttaaagtaaaataaatctatctatctatatctatctatctatcttagggctgctgtaataaacgaccacacacttggaagtcttaaagccacaacaagtttattcttttccagtcctggagaccagaagtctgaaataacgatgtgggcagtactgtgcttcctctggaggctcacttgaacctgggaggcagaggttgcagtgagccaagatcatgcctttgcactccagcctgggcaacaacagcaaaactccgtctcaaaaaaaaaaaacaaaacaaaaaacaaaataccgtgaatatgttctctaaattaatctcacagcatgggagaaggtgaacaggataccccagtactgatgacaagtattatgggatggaaaagagaactggcattcttctttgctggcaacacaacctgtttttgttgatgtgaaggcagttaaccttgttgctagataaatgttactgcagatgtctgacgtaatgagaatgcgttatccacagcaaaatgcttttgaaaaagaaactgcagggaacttcacagtgagtgactaagactcactactgcagtctggcgtggtggctcacgcctgtaatcccagcattctgggagggtgaggcaggcggatcatgaggtcagtagatcgagaccatcctgggcaacagggtgaaaccccgtctctactaaaagtacaaaaaaactagctgggcatggtggcgggcgcctgtagtcccagctacttgggaggctgaggcaggagaatggcttgaaattgagaggcggaggttgcagtgagccgagatcacgccactgcactccctggtaccagagcaagactctgtctcaacgacaacaaaaaaacaaaaacaaaaacaaaagcatgatattaaagacactgtgctccatgactcagaagttgaaagagctactttgaatctgcaaatgatacctccatggatgtcgcctaagttcatgaaagatggaagcatagtgacagtaacaataatttaagaaggtttgaaaggaaaatcttggggtccccaaatcactaagctcaagggaaaagtcaagctgggaacttctcagagcaaacttgcctcccgttttattcaaagttactcctggccaggtgcggtggctcacgcctgtaatcccagcactttgggaggccagggcaggcagaacacgaggtaaagagatcaagaccatcctggcctatatgatgaagccccatctctactaaaaatattttaaaaactagctgggcatggtggcgggcacctgtagtcccggctactcgggaggctgaggcaggagaatggcttgaacctgggaggctgaggttgcagtgagccgaggtcgcgccactgcactccagcctggtgccagagcaatactctgtctaaacacacacacacacacaccccaaaaaaataatgaatgcaaccatttgtctcttatccacctatgacctggaagccccctccccacttcgagtcgtccccgtgtttctggatggaaccagtgtacctctcaacatatattgattgatgtctcatgtctgcctaaaatgtataaaaccagcgtgtgccctgaccaccttgggaacatgtcgtcaggaccacctgaggctgtgtcatgggtgcgtcctcaactgtggcaaaataaatttttctttttttttttttttgagatggagtcctactctgttgtccaggctggagtgcagtggtacgatctcggctcactgcaacctccacctccctggttccagcgattcccctgcctcagcctcctcaatagctgggattacaggtgcccgccaccatgtccagctaaagttttttttgcatttttagtagagacggagtttcaccatgttggccagacttgtcttgagctcctgacctcagacaatccgcccgcctcgacctcccaaagtgctgggattacaggcgtgagccaccacgcccggacttaactttctaaattaactgacaccatctcagatattcagggttcacaaaggcttggaggggcctgcaaatatatacaattatagaattaaatagtgatggatagagtcccttattcaaaaatactgttataaattaagttaaaatattaaagtcaaagaaacttcacacccataatcgcaatgctttcagaagatggaggattattttgagctcaggactttgagagcagcttgggcaacacagcaagatgccatttctacaaaaatttttcaaaaatagctgggcatggtggtgtgtacatgtggtcccagctactggggaggttgaggcgggaggatcacttgagcccaggagtttgaggctgcagtgagatgtgctcaaatcactgcactccagcctggctgagagaccaagaccttatctcttaaagaaagaaaataggcggctgggtccggtgactcacgcctgtaatcccagccagggcacgcgaatcacctgaggtcaggagttcgagaccagtctagcgaacatggtgaaactccgtctctactaaaaataccaatattagccaggcatggtggcaggtgcctagaattccagctacttgggaggctaaggcagggagaatcacttgaacctaggaggtggaggttgcagtgagccaagatcatgccattgcactccagcctgggtgacagagtaagactgtgtctcaaaaaaaaaaagcatacttttgagttaaaacaacagaattaccattcaacccagcaaccattcctgggtacatacctaaagaaataccaattattctaccgtaaagacacttttgcacatgaatgttcattgcagcattatttgcaatagcaaagacatgggaattaagctagatacccatcagtggtagactgggtaaagaaaatgtggtacatgtacgtcgtggaatactgtgcagctgtaaaaaagaacaagatcttattattttttgcaggaacatggatggagctggagatcattgtccttagcaaactaatacaagaacataaaagcaaatatcgcatgttctcacttataattggaagttcaacattgagtaaaggtggcctcaaagaaaggaacaacagacattggggtctgcttgagggtgaagggtgggaggagagggaggattaaaaagctgcctattggccgggcgcagtggctcacacctgtaatcccagcactttgggaggccgaggtgggcagatcacgaggtcaggagttcgagaccagcctggccaagatggtgaaaccctgtctctactaaaaatacaaaaattagccaggcagagtagcaggcatctgtaatcccagctactcgggaggctgaggcacaagaatcacttgaacccatgaggcggaggttgcagtgagccgggatcgcaccattgcactcaagcctgggcggcagagtggcactctgtctctactgcatatcagatattgtgctgattatgtgggtgacaaaataatctgtacaccaaactcccatgtcacgtaatttgcctgtgcaacaaacctgcacatggactcctcccgaatctaacatacaagtttaaaaaaatacatgtttgtacagctgcaccacgtgtgtatgtgttttaagctatgtgttatgatgactcaaaaacgttcaaaaaattaaaaggtgttaaagttataaaaaagaataaaatgcatcacacttttcaaatcatgaaatacctttttttacccatcgtgaatgtaaacattgacaccaatgggaagcttgagtattgtgtccattttacagggcaagaaaacaggggaatgggtaaatagcaaaacgagcaaagaaatgagtaggcaaaggcccatcacctatttctttgtggatgtctttgttgaactttttttcaacaaaatgaaaccaagccccctgattgttagttacctcacgcccatagtcttggccagtgagtcttttcgtaaaatggtactcaccgcagagtacattctgaatacacgttagacaacgatgaccaggaaaattcctgagtttttgatcgatcacattcctggccaaatcagatggatatttaagacctcagtgtgccctttgcaatcttgcaactcctgctttggttctctggaagaaatcttcttgtcgaagattcttactaaaactcaatgggttaaaatgcaaagatcttatttgttgcatagaatcaagactctgggtcaatacctggcagagtgactggaggctgcattggggtggactgtttttagacggcaggtcaggccccagagagaggtagttgggtgggaaacataagtcctatttctaatgcacagttgttgtgcctcctctggatatccaaatgtttggcacaatctgttttcctagaatcccagctgacatagagcagctaatgctcacatactgtcatccagccagtggctcatttagccaattaacacgctgatttcaaaagcattgtgaaaatatcactgcacacactaactagcttctgaccatcccttcccttcccttcctggcatatttctccagcgtaatctctgctcatagcctttcttacgagctacccacacccttgagcttcacaggacccattcagtctgtttgtgttttctccccgacctttcagcaatgtcaccatgatcttttcaagaatctttttctttgcttctcctgacaaatgcatcatccttctgagcaataaacagaggaattggcaaagttaataatgtcgttattgagcacttagtgaatggtgagcattatgctaagactgttttgtggtgtatccatacaccattccaacgatatatattttttaatttaagcatactttattggtaaacaatactaacaattatctgaacatttcgcgagtcaaaaccttattgctggtggagagtcttgcctcaatgttgctggctgtggactgatcagggtggtggttgctgagggtagagggtgctttggcaatttcttaaaatagacaacagtgatgtttgtcacatcagttgaccctttctgtcatgaaagatttttctgtatcaagcgatgctgtttgatagggttttacccagagtagaacttttttcaaaattcgagtcagggccgggcgtggtggctcacgcctgtaatcccagcactttgagaggccaaggcaggtggatcacctgaggtcaggagtttgagaccagtctgaccaacatggtgaaaccccatctctactaaaactacaaaaaaattagctgggcatggtggcgggcacctgtaatcccagctactcggcaggctgaggcaggagaatcgcttgaacctgggaggtggaggttgcagtgagccaagatcgcgctatggcactccagcctgggcaacaagagcaaaactccgtctcaaaaaaaaaaaaaaaaaaaaaaaaaaaaccaaaaaaccttcctgaaaggattcctcattctgaatgccatttagaaccttggtgattcatggcaggaagttaagatatccacattaacagaaatcgggaaaaagtgaattccaatattcatgaatgacattgagggggttcaagacttcagtggaggaagtcacttctgctatggtgaaaatagcagaagtaaaggtgcaggttgaagatggggctgaactcctgtaatctcatgataaaactggaatggaagaggagtttcttctcatgaaggagcagagaaaatggtttcttgagatagatactattcttgggcccatttcactgatgagaaaactgaggcctctccaggttgaagggtacaactaccaagtgtgggagtctgggctctaccccattactggacatctccagagcctgttctcccttctgctaagtttgcgggtcgctcaacattgtctccttggacgtgtgataagtcttcctgctcctccttcatcagtctttaacatttgagagacatttagagtggcctggaccaggctctttgctcattctcttttcttctactgaggcctctttcacaagtaggttttctcatctctctcttctttcatttattctctccttcattctctctttctcattctcttattctctctccctgtcttctttcctcttctcttccctcctcttcccctcctacttcttccttcccctccttctcctgcccctcatctcctcctacttctcctcctccttctccttcttctccttcatcttctttcgtttcttctccttccctttctctcctcctccttctccttctccctttccttcccttcccctctcttcccctccccttccctcccctcccctcccttcccttcccttttcttttctttttttttttctttcacggagtctcactctgttgccaggctggagtgccgtggcgcgatctcagctcactgcaacctctgcctccccggttcaagcgattcttctgcctcagcctcctgagtagctgggattacaggcatgcaccaccctgcccagctaatttttgtatttttagtagagatggggtttcaccatgttggccaggatgatctcagtctcctgacctcgtgatccacctgcctcagcctcccaaagtgctaggattacaggcatgagacaccgcacctggccccttctactttttttttcccttctccttcacctcctcttccccctcctcctgcttctcctcctcctctttcacctcctcctccttcctttctcctcctcctccttcctttctctctgtctctctctctctctctctctccctccctcccccccccccccccccccccgccgtctctctgcttctctctcattcactctcattgacgtccatatccaaatttttggaatcgcagtgctgccctcttagttctttgtcatgaaccatctgttgcccttggattgttttaccttttgtatccttggcagcttgacatacccatggtctaagcaagagtgttttctctgaaagtgcaggcatgagctgatacttgtgtgtttcatccattatcagcactgttttatgcatgtaaggagggtgtgtggcatttgcttcgtgggttgtaggaagggacacccaggaaacaaacaactaaagtgaagctttcctgcgggctaggatttgaaggtcatactaatgtccttcgagagagttaatgtcaagaattggtgtgaccaaacagtggtggatgtcatagtgttttcctcttttcataggttcacttttcaaatgagacagtagccatgagggaccatccatgcaggctgagactagtcttcaggaaaatatctatgcctagtagtttcagaaaggttagggttgcatagatgtacccacctgtccatcctgatccttactctaaattcgacctcttctatcattgctttcaccatcactgtcttgttggtgatgggcccagcttcgagaaactcagatctgcctcagtgctgctggagctggagagctggaagaaaaccaatatggcgtttgaaccgcacaatccaaaagtattgtagcagcactgattcataggttccttctcagtagaacctcttttgaattcctccaaacaaagccttctatttgagccatggcccttgagtagaccgatgtcatggactattagagtatgctattggtgctccagctacccatggccaaccaccaggcattacttaggtagagccccactgcctggcctatgcaccaggcatcaacatgaggtttcataaatacctgggagtacaagtgcagaatctctgttgaaagaatgcaatactctttttatttcttcaccgaataattaaataatttttatttcttcattaaagggcaattgaagagaagacaacatgtctctcttagtaggtaccatccccgagtagaactcatcctcctctgtgcaaagattcccattgttcagatcactctaatgctttgaggaaaacctccccacagtgtaacatacagaacactcttccgggggttatggcagatgctggagtctcttctaccaccacctaaagatgctggggtactctgcaacaccacctgaggaaaggaacaggatgaaacacctgttgtattagtcacctagggctgccatgacaaaatactacaggctgggccgcttaaacagcagacttttattttcccacagttctgaaggctggaagtctgtgagatcaaagtgtgggcagggctggttcttcctgaggcctctctgctgggcttgtagacaccgtcttctccctgtgtcctcatagggtcgcccctctgtgtgtgtctgtgtcctcatctcctcttatgaggtgtcttagtccatctcaggctgctatcacagaataccatagactgggtgacttataaacaacagacattgattctctcacagtcctggaggctggaagtctgagatccaggtatgggcagggctggttcctcctgaggcctctctcctgggcttggagacgccatcttctccctgtgtcctcacagggttgtcccaatgtgtgtgtctgtgtcctcatctccttttcttatgaggtgtcttagtccatttcaggctgctatcacagaataccatagactgggtggcttgtaaacaacagacgtttattctcccacaatcctggaggctgtaagtccaagatcaaggtgtaggcagggctggttcctcctgaggcctctcttgtaggcttgtagatgccatcttctcactgtgtcctcgcagggtcgtcactctgtgtgtctgtgtcctcatctcctcctctttttttttttgagacggagtctcgctctgtcgcccaggctggagtgcagtggcgggatctcggctcactgcaagctccacctcccaggttcaagcgattttcctgcctcagcctcccaagtagctggaactacaggtgcgtgccaccatgcctagctaattttttctatttttagtagagatggagtttcaccgtgttagccaggatggtctcgatcacctgacctcgtgatccacccacctcagcctcccaaagtactgggattacaggcgtgagccaccacacccggcctcatctcctcttcttataagcatcccagtcttctcggattaggggcctccctggtgactttgttttaccttaatcacctctttaaagactatctccaaatatggtgacattctgaggtcctgggcgttagggctttaacatagggatttgggagaaggaatcagcccatcacagctgtgcattctaagactccagtgactttgtgctgacaatggcttttccttgggtagctctaaccagatggtctggctgggtctatcttgagtctagtgactcccaccacgaggccaactgagcagggtggccaggaaagcctgtggccttacaacaaggtgatgctcacctgcagcacacaggccatcactgtagctctgctggctttattcttgggtttatagtgatggcttctttctgcctctgcctcccttgaggcatctcgtttctgtggttggagtactgtgagcctaagagacagagagcatgtccacagtcaggcttcccttacttgcttcagtagcatctcatgagtgtttccaatgcattcagggagactcttcttcactgaaggagtcagatccattttgcagctttgctgcttggaaccttgatggaatggctgagtacatggccgccagcgtcactcatgcacgaaaagtgttgttgaaagctaatagaaactgaaatctggtcgggcacggtggctcacgcctgtaatcccagcaccttgggaggctgaggcgggtggatcacctgaggtcaggagtgcgagaccagcctggccaacatggcgaaaccccatctctactaaaaatacgaaaaattagccgggcatggtggcaggcacctgtcatcccagctactcaggaggctgaggcaggagaatcgcttgaaccctggaggtggaggtttcagtgagccgagattgcgccattatactccagcttgggcaacaagagtgaaaatctgcctggaaagaaaaaaaaaaaaaagaaaaactgaaatagaagatttcccttcccccagttcactttgactgcgctaaagtaatttcctttgagggcagagaggacacggattgctttgggcatacttcaaaatgctactgtctccctaggaatattgcaaagtggttactttcccccaataacacacaactggatatttctttgatcttcaccctgggaacctggtggagctcccggaggtaaaatttgtgaaagtacaaggtcccctctaagatgggcccccagaagtttttctgttgttgttgttttttgagacagagtctcgctctgtcactcaggctggagtgcagtggtgcgatctgggctcactacaacctccacctcccagggtcaagcaattctcctgcctcagcctcccgagtagctgggattacaggtgcctgccaccacgcccggctaatttttgtatttttagtagagacggggtttcactatgttggccaggctggtctcgaactcctgacctcaggtgatctgcccgccttggcctcccaaagtgctgggattacaggtgcgagccaccatgcctggccaggagtttttaacttacttaggcttgtccactgtcagcctgcagctgtttaataattaccctgcaaatgtgtccatcaggtgctggctccagcaggaactcctagacaagcacaattccacttgccacctgtctgtccagtcttcaggcagcatttcgtcttgtgatctctattttctgatggatcgcagagttgctgattttcagtatgttctgctctttgcctattgtgaggataggaattaaaatgcgcaagctctctacatgttagtgaagtggctacgttgtctggggtatataccctggggttcgtcattgggcatcaggaaaatttaggacaaagacacacacgaggagtttaggagtggaagtttaatcaggagaagagaaagagaaatggttttctctatagagaaaggggtctccgagcggaaaggaccagctggcaccaaatgtgatggattttatagtccagtttgaggaggcggtgtctcatttacatagagctcagagattggttccatcaagcatggcatttacatagcccacaggaaaggctggttgcccaccctaatcgtttatgcaaatgggctttgtagttggtcggggctctccgagagattggttccatcaagcatgacatttacatagcccacaggaaaggctggttgcccaccctaatcggttatgcaaatgggctttgtagttggtcggggctctcggtcctgtttttcttactttacatgtggctgacaaagaggagggaagatggagccactgtcttgaacgtgtctagtctctagttcctgctgggaagatggagccgccgttttgaatgtgtctagtccctagttcctgccgggaagatggaaccgccatcttgaacgtgtctagtccctagttcctgccgggaagatggagccgccatcttgaacgtgtctagtccctagttcctgcccggaagatggagccgccatcttgaacgtgtctagtcgttagttcctcccgggaagatggagccgccatcttgaacgtgtctagtccctaggtcctcccgacattcacccgtacaagctcccagctggcttgtgtatgtctgcagctcgacttgacaggctgttcattgttagaaaatgacttggggctgcttttcgttaaagagaaaagctgccgggcgcagtggctcacacctgtcatcccagcacttttggaggctgaggcgggtggatcattaggtcaggggttcgagacgagcctgaccagtgaaaccgcgtctctactaaaaaaaaaaaaaacaaaacaaaaattagccgggcttggtggtgcgtacctataatgccagctacttaggaggctgaggcaggcgaattgcttgaacccgggaggcggaggttgcaatgagcgaacatcacgccactacactccagcctgggcgacagagcgggactccatctcaaaaaaaaaaaaaaaaagaaaagaaaaaagccttgccgaggactcccatacccttactgtctgcctaagtgatttcttcttaactcctgtatcactggcagactctgagttgcctgttgggtggagtactatattgccgagtatcatgactgtattagatgtgagggagacagtgtgaataggacatggtccctgaagagcacagagctttcacctggggctgggcggagcttctgtcctatccagtgttatggaacccttgcaagcacaggtcaagcagctcaagggctggaagacgtgcacacaaaatccaagggcaacgttggaaagaggtttagtgtttcttagaaaaatgccagaaggctgaagaagtgggggccccgagcagctctgaagggtgtgtatgcaattaaactgaagccaaaggctgagagagaggagtgagagccgcctacggagctctgtgcagcttcatcataaactcacagacaggcttcatgcagcgccgtctcagtgcattcaatgtttggattccacatgcatgcgtcctcaacccccttgcaatgctgttctccttggagggaaatgggtccttcttaccctatcacatgcaggtatctggtctaccagataaatgtgtgagaaatcaccaacaaagcagaaattacttttaattacaaagcagagtcatcgtaaaactttgtgcaaaatctttttttttttttttttccagacagggtctccatctgttacccaggctggagtgcagtggtgtgatcatggctcactgcaacttcaacttccgaggctcaggtgatcctcacatctcagcctcccaagtagctgggatgacaggtgtgcaccaccacacccagctaatttttactatctgcttaagtcatttcttcttaacccctgtatcattagaggagaaaccggaagcccctatttttgaaattagtaaccacctatcacctaaaattcctctcattactgtgacgataatgatgattttttcgagaccggatctcactctgtcacccaggctggagtgcagtggtgtgactgtggctcacgacagcttcagcctcccgggctcgagtgatcttcccaccacagtgtctaaagtagctggggctgtaggtacgcatcatcattcccagctatgtatatattttaaatattttgtagagatgggatcttcctctgttgctcaggctggtcttaaactcctggcctccagcagtcttctcacctgggcctcttaaagtgctgggattacaggcgtgtaccaccgtgtctggccaaaaaacatatctattctggggttcatagtgatgcttgtttctgccttggcctgtcttgaggcatctcactcctgtagttggagtactctgagtgtaacagatggagagtatgtccacacccactcttccctcacgtgtttctgtagcatcccgtaggagttttcaaatgcatttggagatgtattcaccctgtgacagattcaatgcatctctacaaggcagaatagctctaccatggtgtggctatggcgcttggctacctgagtctttattctgccttccaggtgcttgttggttggataactttgggtaggttcttgtacctctttgagcttcaagactgtcttagtcagctctggctgttgcaagaaaatacagttgaccttgatacaaaaattagctgggtgtggcgcctgtaatcccagatactcaggaggctgaggcaggagaatcgcttgaacctgggaggcggagattgcagggagccaagatcacaccattgcactccagcctgggcgacagagcaagattccatctcaaaaacaacaacaacaacaacaaaaaactagagttgacccttgaacaatgtgggagttaggggcgtcacacacgtccctggcacagttgaaaatccaaagataacttttgactcacccaaaacttatgaatatcctattgttgagcagaagccttatcaataccataaagtcgattaacatatattttgtatgttttatgtattgtatactgtattattaaagtatgctagagaaaagaaaatgctgtttgtttttttttagccgggcgtggtggcgcacgcctgtaatcccagctactcaggaggctgaggcaggagaatcgccttataaggaactttgagaatcaaaaatcataaggaactttcattcttttttttttttttttgagatggagtttcactctgttgccctggagtcaggctggagttcagtggtgtgatctctgctcagtacagcctacgcctcccacgttcaagtgattctcctgcctcagcctcccgagtagctggcactaaaggtgcacgccaccacgcccagctaatttttgtatttttagtagagacagggtttcaccacgttggtcaggctggtcttgaactcctgaccttaggtgacctacccgccttggcgtcccaaagtgtggagattacaggcttgagccaccacgcctgataaggaacttttattctaagtgaagtaactcagggatgaaaaaccaacatcgtatgttctcagtgttacgtgggagctaagctatgaggacacaaaggcataagaatgataaaatggaatttggggtcttgggggggaagagtgggaggggggtgagggataaacactacaaatagggtgcagtatatactgttcgggtgatgggtgtaccaaaatctcacagatcaccactaaagaacttaggtaaccaaataccaccagtaccccaatcacttatggaaagataattaaaaacaaaaaaggacaccaaactaaatttttaaaaatcatagagaagagaaaatatatttactatttctgaagtgggagtggatcgtcatgaaggtcttcatccttatcgtcttcaccttgagtagcctaagatgagagcggacaggagggattggtcttgctggctccggggtggcagaggtagaagaaaatgcccgtagaagtggacccgtgcaattcaaacctgtgttgtttaagggttaactggaccatagatggggtggcataaataacagaaatttatttctctatagtactggaggcagaaatgtttacatccaggtggcaccatggttgggtacttgagaggttcctcttcttggtttacagatggtctcgcagggcagagagagaggggggtggagcacgagggagcatgtgtgccctggtgtctcttcttacaagggcacgaatcccaacataaggatcccaccttcacgacctgatgtaaacatcatcatctcccaaaggctccgtctccaaataccatcccctttggcattagggtttccacacatgagattcggggtgacaccattcattccatagcaggagccctccttggcagactgggacaccaacgcctcttccctcttgggctgacacgagctgtaaatgtcagtggacatttaaatactgcgttacacattcgatgtcctgtctgcaatggagccgggttctgtaaacataagctgccatggcgaaatcggatcatcatcgcccatcaagctctttggcagcagtgctgtaatcagtgcaaacatttatttatataaatgctcccatcccctcggcatgaagatatacttaggctctctcaatggacagccacgccacaagcccaggaatgagagcttgtcagatactgaggctgttttcagagccagtgttcggctgaagtggcacagaagctatcattgtttgcaaatctctgctgcttgtcaagccacagggttaagtaaccccggatgttgcgaacactctgaagtgctgacctgcagtgtctttttggatcactgagccctcaggcagacaggctgtacgtggaccgacacgtcatggctgctgtcttgcacttaaccctctttatctttagaccttgattgtgcacctgtttctcattggaagctaatgacaatccacgaagcggcttggcagtgactgtctctgattgtgtaaggaggggttgccacattcacccatgttgttgactttcaactgtacacttgaaaacgtcaaaagtcagagtaagcattgcctcatgtctccgagtgtagcaattctaggaaaactcttccgaatgggtttaaagtcaaacaaatccaatcaaaacagacttgcagggccaggcacggtggctcatgcctgcaatcccagcactttgggaagccaaggtgggcagatcacttgaggtcaggagttggagaccaacctggccaacatggcgaaaccccgcctccactaaaaatacaaaaagttagccaggtgtagtggtgcgtgtctgtaatcccagctactcaggaggattagggaggagaatctcttgaacctgggaggtggaggttgcagtgagctgagatcaccccactgcagtccagcctgggtgacagagcaagatcccatctcaaaaaaaaaaaaaagaaaagaaaagtccacatagggaaatatgtgaagctctttgggtcatatgatcgctaccacaacagcgcaatatgtaaatgaatgggcaagttctgtgttctaagaatcttgagggacactgagatgtaaatgtatatatttatcacgtggcacaaaatacagttgacccggccgggcacagtggctcacaactgtcatcccagcactttgggaggccgaggcgggtggatcacctgaggtcgggagttcaagaccagcctgaccaacatggtgaaacccgtctctactaaaaatacaaaaaattagctgggaatggtggtgcgtgcctgtaatcccagctactcatgacgctgaggcaggagaatcgcttgaattcgggaggtggagattgcagtgagctgagatcacgccatcgcactccagcctgggcaacaagagggaaactccacctcgaaaaaatatgtatatacagctgacccttgaacaacacgggggttaggggtactgacctctatgcagttgaaaatctatgtataggttctgactcccccaaaagttaaatactggtagtgtactcttgaccggaagctttattcataacatagagtcgattagtacatagtttgtatgttatgtatattataaagtcagctagaaaaaaaatgctaaggaagagaagagaaaatattttactacttactaaatggaagtagatcatcataaaggtcttcgttctcttttttttttttttttttgagatggagtctcactctgtcaccgaggctggagtgcagtggcacgatctcggctcactgcaacctccgtctcctgggttcaagcacttcttctgcctcagcctcccaagtaactgggattacaggcacacgccaccacacctggctaatttttgtatttttagtagagacggggtttcaccatattggccaggctggtcttcaactcctgacctcgtgatctacccgcctcggcctcccaaactgctgggattataggcgtgagtcactgcactctgcaggagtagggagaggagggggaggggaggaggagaagggagggggggaggaggggggacgaagagggaggaggagtcatctcgggtgaaagtccaaatgggtgaatctgctcagttcagatgtatgttgtccaacagtcaactgtgttatccttcttttgattttttttaacccactgtttaaaagatgtggaaatagttttttggtttacaaggtgcacaaaaataggcaaggggctggattttgctagagggctgcagttgaccaaccccgggttagaccattaccattgtcagtgggcacacaaagtaatgaaattattatagaaaacatgaggcgttgtttactggaaaggggtcttgatcctgaccccaagagagggttcttggatcttgtgcaagaaagaatttggggtgagtccatagagtaaagtgaaagcaagttgattaagaaagtaaaggaataaagagtggccactccattggcagagcagcaccgagggctgccagttggtgatttttatggttatttcttgattctgtgcgaaacaagggaaagattattcgtgagttttctgggaagccggtgggcggttctgggaactgagggttcctcccctttttagaccctatagggtaacttcctgacattgccatgacatctgtaaactgccatgaggctgatggaagtgtcttttagcagcgaatgcattagagttagcgtataatgaacagtgaggaagaccagaggtcagtctcgtcgccatcttggtttgcatggggtttggccagcttctttaccacaacctgttttatcaacaaggtccttaggacctgtatcttaatgccgacctcctctcatgccagtggtcatgtgcattcatctggctggaagggtatctttttttttttttgagattgggttgtcactgtgttgcccaggctggagtgcagtggcacagccttgaccttctcagctcaagtgatcctcccacctcagcctcccaagtagctgggactacaggcatgcaccaccatcaccacacccagctgcttttttttttttttttttctgtatttttggtagacacgaggtttcaccatgttgcccaggctggtctcgaactgctaggctcaagcaatcctcctgcctcagcctcccaaagctctggtattacaggcatgagccactgcacctggccttcaggactatcttcagacacttgttgtagcctcttcatttctgcacatccctccccagcggagatgctctcacaaattgctcataaggaaatttcttgtgggctccaaaatctttcccctaaaacagagttctgttgaatttctccctgacaatgtaaattaacaacttgtcttcacaagtgtgggacaaagataagactagaaatgatctctccgcccaccctgagacaaatgcatgtttgacatcttcctcttctgtatgttgactttgtcttatgcaaaagtggatttactgtgcatgaaatgaacgcgtgattgactgttcctctacccgcactttgccatgtaaaatgtgtattcagagagtgccaatcaaagactcacaagaatgtaatcatttgcctcttttatctactctccttcttttttttttctttcctctttccctcctgcctgcttttttccctttctataccaaagccctcaaaaccatccttggaaaaagcacagggccgcacgcagtggctcacgcctgtaatcccagcactttgggaggccgaggcaggtggatcacctgaggtcaggagttcaagaccagcctgccaacatggcaaaaccccgtctgtactgaaaaataaaaaaaatagcagggcgtggcgttgcatgcctgtaatcccagctacttgggacagtgaggcagaagaatcatctgagcccgggaggtggaggctgcagtgagctgagactgcgccactgcactctagcctgggccacacagcaagactctgtctcaaaaaaaaaaaaagccaggcgcggtggctcacgcctgtaatcccagcactttgggaagccgaggcgggtggatcacctgaggtcaggagtttgagaccagcctgacaaacgtggtgaaagcccatctctagtaaaaatacaaaaattagccgggcgtggtgacgtgcacttgtaatcccagctactcaggaagctgaggcaggagaatcacttgaacccgggaggcgaagggtgcagtgagccgagatggcgccattgcactccagcctgggcgacagagggagactccgtctcaaaaagaaaagaaaaagcacggagcacaggtcctatggtgactggcgtctgtttttcctggactggggcacattctcaaccgtggcaaaattaacctctaaactaatggaggcttgcctcactcatcttctttgattcaaaactttgagttaatccatttatgcctgaagttgcaagtttttgaatttttgccatcagatcttggcgatgaccttgagcagtaggatataaataactccacatgcttagcattccaataatggaacactaggcatacgtgggtttaatcaaaggagagatcatctgtgctggacctgcctcaaagagggtgagatgaatgagtaattcttcttcttcaaataaacttgagatggtctcagagatccttttcctggtttttgttgttattattgttgttgtttttgaggcagagtcttgctctatcacccaggctggagtgcagtggtgcaatctcggctcactgcaacctccacctcccaggttcaagcgattctcctgccccagcctcccaagtagctgggattacaggcgcccactaccatgcctggctaatttttgtatttttcgtagagacagggtttcacccttttggccaggctggtctcgaactcctgagctcaggtgatcttccccacctcagcctatcacagtgctggaattacaggcgtgagccaccgcagccggccctttttgctggttttgaagaagcagactcccatatgacaagttgctgagggtgtcacagcaagcagagagccaccattgtctgacagccaaaatgaaaatgagacttggccgggcgcggtggctcacgcctgttatcccagcacttttggaggccaaggccggtggatcacctgagatcaggagtttgagaccactctttccaacaaggagaaaacccgtctctactaaaaagacaaaaattagctgggtgtggtggcaggcacctgtaatcccagctactggggaggctgaggcaagagaatcacttgatcttgggaggcggaggttgcagtgagctgagatcgcgaaactgcactccagcctaggcaacagagtgagactctgtctcaaagaaaagagagaaaatgtgactcaatctcacaaccacaagaagctgaattttgcctcccaattcagcatgcctggaagagcatcctaagctacagatgtcatctcagctttgtctgacaccttaattccagccttgtgagactctaaatggagacatcctgttaatctaaacccaatcttctgacttacagaactgtgagatcataaaggggtgttgttttttaaactactacgtttggggcgttttgttacgcagcagagctagctaagatggatggctccttaagcagctcatttgagggcagagggaggcaacttctgcagacagatgggcatctatattcgctaggttcaagctgttaatgctgctatgtatacccaaatgacctcactaccttctcaccaggcagcaagaaacaggatcctcagacgaacagaagtccaacaccttagtctaagtctgtttatgttctcctgataggaaatcttttcatctcataaaaagctgctgatgtaggcctttctcaccctgtaccccacgttactgatgcctgttttgttgccaaactggactggtgtccacttgcctggtgcacttaggtcaaacctccacaatgaggctttgcagcaagagaaaggatagtgtttatttggacagcaccaagccaggagactcaggcagctcacgcttaagacctaacgttttttttttttttattgaaacggagtttcactcttgctgcccaggctggagtgctatggcgtgatctcagctcaccgcaacctccacctcccgggttcaggcaattctcctgcctcagcctgctgagtggctgggattacaggcatgcgccaccacgcctggctagttttgtacttttagtagagacagcatttctccatgttggtcaggctggtctcttaactcccgacctcaggtgattccctcgctttggcatcccaaggtgctgagattgcaggcgtgagccaccgcacctggcctaagacccaatcttttcaatgacttccgagccatagtgtttcaagtcgggtaaatttcaggacagaagctgctccaggcaaaatcatgaggacgaagttctgatttttttatcttgcccaaattcctatctaaagggtctagggagtcattctttacaaaccatgagttctcattagatgggttttatttaaccctatatatcgtaacttactttccaatgtgactctggcataacataatgagacaaggaaaaacaatgtatttaaccccaaaatatatttccttgccataccttgaaattgccctgagaagtctcttgtgggaaaaatccacattctatagagaatagcctttcctccctccctcccttacctcctttacctcccttccttccttccttccttctccccttccttcctcccttctccccttccttcctcccttctccccttccttccttccctcccttctttcccttccttccttccctccattcctttccctctctcccttctttccctccctccctcctttccctccctccctccttccctccctgcctccctccttccctccctcattccctccttccctccctcattccctccttcattccctccttccctcccttccttccctccctcccttccttccctccttccctccctctcttccttccctccttccctccttccttccgtccctccctttgttcctttgttccttcccagatctgggacataatcaactgagagccaggcccccttttaggtctgataagaaacattttacaacctgttctctctgaagtctgctatctgagagcttcctgtgcaaaataaaacttggttcccacaatcctttatctccacctggacatttcctttctgttgattccaggtcttcagataaactcaaccagttgtcaaccagaaaatatttaaacttacctatagcctggcagcccccaggttgagttgtcccacctttctgaaccaaaccaatgtatttctgaaatgtatttgattgatgtctcatgccttcctaaaatatataaaatcaagctgcaccccgaccacctggggtacatgttctcgggatctcctgagggctgtgtcacgggccgtggtcactcatatttcgctcagaataaatctcttcaaatattttacagagtttgactcttttcatcaacaattataaatcacggctgggcgtcgtggctcatgcctgtaattctagcactttgggaggccgaggtgggcagatcacgaggtcatgagatcgagaccatcctggccaacatggtgaaaccctgtctctactaaaaatacaaaaattagctgggcatggtggcgcttgcctgtagtcccagctatttgggaggctgaggcaggagaatcgcttgaacctgggaggcggaggttgcagtgagccgagatggcaccactgcactccagcctgggcgacagagcgagactacatctcaaaaataataagtaaaaaaaaaatcataaatcaatacatggaagctatacgttggtttggcctaaaaagggatatcttgggccaggtacggtggctcatgcctgtaatcccagcacatttgtaggctgaggcaggcagatcacctgaggtctactagtagttcaagaccagcctggccaacatggtgaaaccccgtcttgactaaaaatacaaaaaattacccaggtgtggtggcaagtgcctgtaattccagctacttgggaggctgaggcaagagaatcgcttgaacctgggaggcagaggttgcagcgagccaagatcatgccactgcactccagcctgggcaacaagagcgaaactccatctcaaaaaaaaaaaaatatatatcttgaagctgggcccgagggtggggttgcttacaggaacaaggtggattcaaagacttttggacttgcaattggttaaggaagtggagctttgtctaagacttgcggtcagcagtaaaagcacattggatctggcccatgggcaggacctcctccaggaccctcaggaagaaatttaaaacaaggaacagggatcagagttcagtccctagctctcccacgtctgaggtcttcatgccagaggattccatagggtagaggtgtgagtttcttttattttttttaattatactttaacttctggggtacatgtgcagaatatgcaggtttgttactaggtatacacgtgccatggtagtttgctgccatccatcatctacattaggtatttgtcctaatgctctccctcccctagtcccccagtccccgaaagacccctgtgtgtgatgttcccctccctgtgtccatgtgttctcattgttcaactcccccttatgagtgaaaacatgcagtgtttggttttctgttcctgtgatagtttcctgagaatgatggtttccagcttcatccatgtccctgcaaaggacatgaactcatccttttttatggctgcatagtattccatggtgtctacgtgccacattttctttattagttgctctagggaagcgaacatccctgactctaatttccttggttgttattttaagctactgtgactttcttcttcatcaagttgctcattaacttctcccagccagcgaagtgcctggagtttccttcctggaaggaactcaagatttctcttgatttccatgcttggtcgggggtggagagagtttcctggtttgcccctaagaggggtccctgccaggtctcagttcctcaagctttctctttagcacctttagcagacagatactatcacagcttacagtgcttgcagcatgggtggtggcgtggggattttgatgccgttggattttccccactttttccattttgtgcccagaagcattactcttgaagcatttaaatttgaacacagtgggaaacagcttcttaggaattaagttttaactggtttccagtgtatctaaacagcagacaggtagacccttggtaacttctttttgatgtataaacaactcagaccattaaatcgacgctcattagcaacctatgctgctcatccaagctaccctgaagtttacttttagcccagtcctgtgggtggataatggtttcaacgcattcccaggaggacgatttacctccttggagacagaattgttcttgaaagctcttcacaagtccgcgtttccacggcaacatcaagattgacttctcgcccttgggtagtgccttgtcttcgaaagcctttctttcctctttacttacacaagctctttggggcatctgctctttgcctcgcgggtgggtcaatggtgctttcattttaatcttcttttctagactagacctgggagtcagaggacaactttaattatctgaacactttaccattctgacaacaatatttacagagtttatcctgaaggtggtttctgaggacagctgtgtatccgaggagcattgttttaacttgagttctctcgtagtgatgtatctcaagtgctcaagagggagaggagggccatcgtagtaaacacaatgaaaacaaaggcgtcacccacttatttatcccaccatgccaggcagctctctccccatctctctctttctctctctgtatgtctctctctctttctctccctctctgtgtcacaacctctgtctctctcattctattcctctctgtccctctctgtcactttctctgtgtctctcctctttctctctctctgtctctcgcttattctctctgtctctcagtttctgtgtctctctccttctgtctctctttttttttttttttgacacagagtgttgttcttctcattcagtctggggtgcaatggagtgatctcggctcactacaacctccgcctcccggattcaagcgattctcctgcctcagcctcccgagtagctgggattacaggtgcccgccaccacgctcagctagtttttatatttttagtagagacggggtttcaccatgttggccaggctggtctcgaactcctgacatcaggcgatccacccgcctcggcctcccaaactattgggattacaggtgtgagcctgtatctgtctctctgtgtctctctggcacactctctgtctctttcaagctctctttctgtgcttctatttctgtgtcacaatctttctctctgtctctttcctccctctgtctctctctttctctcccattctcaccctctctttctccataactttctctgtgttttgttcttttttcttcctctctcttgcttattttctctctctctccctctctctctctctctcacacacacacacacacatatacacacacacacagaataatctcgctgcagcgtctttcacagtaggtcttaggggcagatggatagctgcctcatacaaagaaaataggatttcaggtctccagagaggcgctccatacctgcataacgactaagagatactggtatttcacctttatttttaaattgataaatatatagaaatgagagacgcagggggtgacaaccaatctgccctccttcttggcaaattccggcagttcgggcacctgggttccttccctcctgaatgaagagaggccagaagccatcatgagcttcgtccctgctcaagactttgcaggctgtggtcgcatcagctcttggctccaagaactgggctttttgggtagcaggacggctgttgctacccacaagtgcgggaagaactgtcctctggctgcctggatcccggaggttctggcttaccaagacactcgtgaatttattaggatgcgtagggacggggcaggtgcagacggattcaggggctgtgttggctgttggtagatgcttgaaagctgttgctgctctgagctgaacgccttctccacaagcgctgcctcctggtctaaatgatgggtttttattttatattattttgagacagggtcttgctctgttttctaagctggagtgcagaggtgcagaggcataatcatagctcactgcagcctcaacctcctatgctcaagcagtcctgccacctcagcctcccacgtagctgggattgcagacatgcaccaccacactcagataattttttatgacttccttttgtagaggtagggtcttgctatgttgcccaggctgctcttgaactggcctcaagcaatcctcccacctcggcctctcaaaatgctacagtgacagggtgagccaccacacctggccatgatgattttcaaattagcccagttgggttacaaggttgactaagatctgattttcaggtagtggttatggacacacttatcacatttattctaggagctctttaataatatttcagaatggacagcatttctggaaatttttttcttagtattaaatacatttgcttttgtatgtctcagtggaagacttctttaagtttacatttttatgatttttttcttctgtatatataaatgttactcatcaagcaattcctgccctcctagcaaatttcttctgctatgcttttttcagaatttctatcagaacagcataaatttcacaaaacaaaccacctcagactctttttgtccaaccagtcagtatcagggcacttatctgttctttgaaagtctagaagaattttctaaaataccctctgcactcatctaccctttcttcatgccattctttcattattcttctctatttttcttatagctattggtctgattagacctaatttccttgattgaattgggataattagtatctctgagaaaattatttcctcgagattttcacattttacttacaaatgtaacatattatcaggatactaagaaacagaaacctatcattttaaagcttttttcatacagtacagtgtttcctatttgtaagtttgcatttcctgcctcattaaatatattattgacagtattttctgggaccttgtttctccttcttccttccttccccgtttccacccatcctttcctccttccctttcttccctcctttctccctccctccctttctttcttccctccttccattcattcttgcttccctcccctcccctccccttccctctttccacccatcctttcctccttcccccacaatgttgattttgttcatttctccctgcctacctaggaattcttgaaaaatatacttggatattgtgttattctgaagaaaatgctgtgaaaatggcacattatagcttcatctcaattcagcatttggtttatgattttcaagttagccctgttgggttacaaggttggttacacagatccaaaccatgccttcataggcgatgatcctccttgttccattaacgttttagacttcaatcattgctgtcttgtgtgactagggccatttctacttggtttttgcttgtttggctgataaatgtgaacgttttaacaattgttgaacaattgttaaaacaattgtcgaacaattgtcgaacagttgttttaacaattgtaattcctcctttttaatactctgtatctttaccatcaagatacagacatcacctttttcacaggctctgagtgtaggaggccaccattttggctttatatcatgaccagtaactgggagcgccctcgttggctgaagctgtacttcctgcttcttttctgttcttgccacatggataactggtatactccatcttattccatgagctacgtggcagacactcattttgtagctcctaggagtgcgttaaatactcccaaacactctaactttcatttctctaaattatctaaatagaatgaaggtatcgttgaaggtactccaggtggaatgaaaaaacctatctcaagtcttccggagatcctcctgtgttcggttccctggtccctctcatggtgccctgggaaagggacgcagctcctacatgggttaggttccaggtgaacgcagccactgagctcctagcaagtacgatttcctgtgtcctatgcgcagatcaccctggtgtcttggtccagtgggcttgaagcctcatactcttttgtttttccttgttttttattttattttttttatttttattacttttttttttttttgagagggagtcttgctctgtcgcccaggctggagtgcagtggcacaatctcggctcactgcaagctccgcctcccaggttcatgccattctcctgcctcagcctcctgagtagctgggactacaggcgcccgccaccacgcctggctaattttttgtagttttagtagagacagggtttcaccatgttagccaggatggtctcgatctcctgacccctcgtgatccacccgcctcggcctcccaaagtgctgggattacaggcgtgagccacccaccccccggccttgtttgttttcttttaaaaaaaatttcatgaggtacacgtgcagctttgttgtaagatacattgtgtagtgctgcggttcacgcttcagttgaacctgtcactcaaacggtgaacaaaatacctcataggtagagttttagcctttacacccctctccctcccctgctcttggaatgcgcaggtgtgccagcttcccatttttatgcctgattattcaatgtttagctcctatgtataattgagaacaagtggtatttaattttccgtttctgtgttaattcacttaggataatggcctccagctgcatctgtgttgctgctaaaaacatgatttcattcttttttatggctctatactattctacggtatatatgcagcaactacattttcttcatccaacacataattgatggacacctgggctgattccctcatgcctcccaagattgaatcaggaagaaatcagatccagaacagactcatttcatgacaagttatgaaattgaatcagtaatttacaaaaacctatcaatcaaaaaaaaaaaaaaaagccccaagaccagacaaattcacagctgaattcgaccagatgtacaaagaagagctggttccaatctgactgaaacgattctaaaaaattgaggcggagggattcctccctaacttattctacaaaacctgtatcatcttgataccaaaatctgacaaggacacgacaaaaatagaaaactacaggccaatatcccagatgaagatagacgcacaaatgctcaaccacatactagcaaacagaatccagcagtgcgtcaaaaagatgactgatcatcgaaaccttgtctctactacaaatacaaaaattagccaggcgtggtggtgcgcgtctgtaatcccagctacttgggaggctgaatcgcttgaacctggcgggtggaggttgcagtgagccaagatcgcaccactgcgctccagcctgggcaacagagcaagactctgcctcaaaaaaaaaaaaaaaagataattgatcgcaatcttaattgtgggcttcattcctgctctgctctttgtccaaagagatttttctgaatgtcaggggtgaagttcaagttctagcacccagtgagcattctgccttcccctgctgcagggcttgatgtatcggctcatcttcccctagtgatgccagccataccctgttccccttacccttcctaccagtgtttctcttggtgcgaggtagctcctgaatggatgcaaaaaaaaaaagatgctgattgcaagaatgagcaaagcccgttggttgcctgtattactccgttctcacactgctctgaagaaatacctgagactgggtaatttttaaaaattttaagttccgggtacatatgcaggattgtacatagataaacatgtgccgtggtggtttgctgcacctatcaacccatcacttaagtattaaagcccagcatgagttagctattctttttattattgtactttaagttctggggtacatgtgcagaacatgcaggtttgttatataggtatagacgtgccatggtggtttgctgcacccatcaactcgttatctacattaggtatttcttttaaagctatctctccccttgccccccaccccccaacaggccccagtgtgtgatgttcccctccctgtgtccctgtgttctcattgctcaactcccacttaagagtgagaacatgtggtgtttagttttctgttcttgtgttagtttgctgagaatgatggtttccagattcatccgtgtccctgcaaagcacatgaactcatcctttttaatgtctgcatagtagtccatggtgtctatgtgccacattttctttattcagtctatcaatgacgggcatttgcgttggttccaagtctttaatattgtgaacagtgctgcagtaaacacacatgtgcatgtgtctttatagtaggatgatttataatcctttgggtatatacccagtcatgggattgctgggtcaaatggtatttctggttctagatccttgaggaatcgccacagtgtcttccacaatggttgaactaacttccactctcaccaacagtgtaaaagcattcctgtttctccacatcctctccagcatctgttgtttcctgattttttaatgatcgcccttctaactgatgtgaggtggtatctcattgtggttttgatttgtacttcactactgagcaggcattagctatttttcctgatgctctccccctccctgacccccacccacaacacgccccagtgtgtgttgttcccctccctgtatccatgtgttctcattgttaagcacccacttatgagtgagagtgtacagtgtttggttttctgttcctgcattagtttgccaagaataatggcttctagctccatccatgtccctgcaaaggacatgatctcgttcctttttatggctgcatagtattccacggtgtatatgtaccattttttttaatccagtctatcattcttgggcatttgagttgattccacatccttgctattgtgaatagtgctgcaatgaacatatgtgtgcctgtatctttataatagaatgatttctatttatttggatatatacctagtaatgggattgctgggtcaaatggtgtttctggttctaggtctttgaggaattgctacactgagactgggtaatttataaagaaaagaagtttaattggctcatggatctgcaggctgtacgggaagcagagcagcttctgcttctagggaggcatgaggaaatgcataatcatagtggaaagtgaaggaaagcaggtgtcttacatggccctagcaagagaaggagagacagaggtgcagttggggtgggctggggagatgctacacacttttcaacaaccagatgccacgagaactcattcactattgcaagcacagcacccaggggatggcactaaactattcctgagacatccacccccgtgacccaatctccccctacaagggtccacctccagcactggggattccaattcaacttgagatttgaatgaggacacagatccaaaccatatcactacccatctatcaattcatccatccatctatccatccatccatccatccatcagttcatccatccatccatccatccattcatccatccatccatccacccacccacccacccatccatccacccacccacccatccatccatccatttatccatccatccatccatccatccatccatccatccatttatccatccatccatccatccatccatccatcagttcatccatccatccatccatccatccattcatccatccatccatttatccatccatccatctatccatccatcaatccacccacccacccatccatccatccacccatccatccatccatccatccatccatccatccatccatcagttcatccatccgtccatccatcaattcatccatccatccactcacccatcctctcatgtatccatccatcaatccatcgatccacccacccacccatccatccatccatccatccatccatttatccatccatccatccatccacccatccacccatccacccatccacccatccatccatccatccatccacccacccatccacccacccatccacccacccacccacccatccatccatccatccatttatccatccatctatccaatccatccatccatccacctatccatccatctacccatccttccacccatccatcaattcatccgtccatccgtccatgcatgcatccatctgtattagtctgttcttgcattgctataaagaagtacctgagattggatgatttataaagaaaagaggtttaattggctcatggttctgcaagctgtacaggaagcagagcagcttctgcttctggggaggcctcaggcaacttacaatcatgatggaaggtgaagtggaagccagcacgtcttaatggctagagcaggagcaagagtggaggggaggtgctgtgcacttttaaacaaccagatcttgtgggaactcattcatggtcacaagaacatcaccaaggggatggcgctaacccattcgtgagaaatccacctccatgatcccatcacctctccccaggccactcctccaacactgcggattacaattcaacatgagatttgggtggggacacagatctaaactatatcaccacctcgcaagccagtgatctcaatagaatgctgatgttcatgttgctagtggctataagccttttttctcaaggagcaagaaaaatgcatcttctagtttttttaaaaaaaatccattcacactgctgtttttggaagctcagcttgtgcttttacccatcctttgatcactggttccaattattagcagtagtatgggttttcctctttcttacatccccacaagtgtttttgtggaaaattacagcagtacctcaggagtttctatccagatgacactgtgctcagaatcagcgcttttaaactctccatggcaaaactgcctctcccctaatctgcagcagattgataactgccgtagatacaataaaaatgaattactaaaaaaaatgcatttaagaaacatggaaactagaagctctcagtgtgttttttttaagtcattggattgaacaaagcttaaatgactgtcattattttttaagtttctaaacatttactttcaatttctgaacatgtctcaccacagacagcttgcagtaacagttcacagagtggcagccgtctgattcaggagtgtgtgtaccatcataccatccaatatattactttatttatttatttatttattttttgagacagtctggctctgtcacccaggctggagtgcagtggtgcgatctcagctcactgcaacctccacctcccgggtttaagcaattctcctgcctcagccatccaagtagctgggatttcaggtgcctgaccccatgcccggctagtttttgtatttttagtagagatgcagtttcaccgtgttggccaggctggtcttgagctcctgacctcaagcgatccgcccgctttggcctcccaaagtgctgggataacaggtgtgagccactgcacctgcccacccaactgtatttctctaaggaaaatattgaaagtacttatttccttttccttgatggcctggtgacttggtacagatgggcttcattctccatgatgaggaagctgttatattatcttaaaacatgccttccaagagaaggttaaagtatatatttcagatcacaaggtcaggagcacttttggctgccacgtttggctgactcttggatgttgtgttatttaaagtgtcctagatcagccacaataaaacaaaacctaatcactgtgtctcaacctcaggtgtgtgctgcaggaagcgccagttcttgtgatatcggagccatgtccacctctgttctggggacccgggaccccacgggttggtctgagtatgtcatcaagagctagatgaggccgggtgaggtgcttcacacctgtaatcccagcactttgggaggccgaggcgggcagatcacaaggtccggagttcaagaacagcctgggcaacatggtgaaaccctgtctctactaaaacacaaaaattagccaggcgtggtggcgggtgcctgtagtcccagctactcaggaggctgaggcaggagaattggttgaatccaggaggtggaggttgcagtgagccgagatcgcaccaccgcacttcagcctgagctacagggtgaaactccatctcaaacaacaacaacaaagaactaggtgaaaagacctggcgtgctcctgcagcgcaaccagccgtgatcatacaaagaccagaatgctgcaggatggcatgtcatggcccatccctctcatctctgctccacgcagcaataagaccaaagctaacctgcttccagagacacctcgtggaaatgtgcaaggctcagcaaagaaaggctaatatctaatgattcatgtatttacacagctttttttttgagatggagtctggcactgtcaccaggctggagtgcagtggcatggtctcggctcactgcaacctccgcctcccaggttcaagcgattcccctgcctcagtctcccaagtagctgggattacaggcaatgcaccaccatgcccagctaagttttatatttttagtagagacagggttttgccatgttggccaggctggtctcgaattcctgaactcaggtgatcgcccgcctcagcctcccaaagtcctgggattacaggcgtaagccactgcgcccggcctgcttttttatttcttactagcacgagaacttagagtgatacaaatcttctgaatattttggctgcattctgcagacggtgacaccttctgtttccgtggatattatttataaaacatttttgtcacctgctatgaattgttaccctgtccacatgctttaaaagggcagtttttgaaatcaacatgagtttgggcactgggaaattgcatacttaataaaattaaacattaaaaaggggctctttctgctttcctatcaactcaggcagcagggtgatagatatagggggtgagggatgcaccctgtgttggccagggttctctagagggatataactaacaggataaatagctatatataaaggggggtttattcagtattaactcacaggatcacaaggtcctacaataagctgtctgcgagctgaggagcaaggaagccagcccgagtgctaaagctgaagaacttggagtccaatttttgagggcaggaagcatccagcacgggagaaagctgtagcatgggaggctaggccagtctaaccttttcacattcttttgcctgctttttgaatgtgctgtgctggcagctgattagatggtgcccaccccgattaagggtgggtctgcctttcccaccccactaactcaaatgttaaacttgtttggccacaccctcacagacacacccaggatcaatactttgcatccttcaatccaatcaggttgacactcggcattaaccatcacacctggtgtgtgtttctctgattataaggacaccagtcctactggacgagggcctcacccttttgagctcctacaggccctgtctgcaaataaagtcacattggagtttaagggttctgatgatgagtgagggagggcacggctcagtctataacgatgtcctatatctattgcaaagaaaaaatgaaggcactattcaattcctccaaattaggaggtttgccagagcctcagacaaaaggattttttagggaggtacagttcattccataatgatgttctctatcgcaaagaagaaggggtaattcagttcctccaaaccaggcgatttgccagaactccaaacaaaaggaatttttttttcttcttgatccctatttatcaacacatgcctctgtgtctttccagttgacttcatctcttgggcagcattaatttcagaaatctgtatttctgacttgccctcaggaaacccctttagatgttagaaattcttctgtggatgaagttatctttttttttttttgagacatagtcttgctctgtcgcccaggctggagtgcagtggtgtgatctcggcttactgcaacctccacctcccaggttcaaacgattgtcctgcctcagcctcccgagtatctgggattacaggcgtgcaccaccacacctggctaatttttgtatttttagtagagaccggatttcaccatgttggccaggctggtctcgaactcctgacctcaggtgatccacccatctcagcctcccaaagtgctggggttataggcatgagccaccacacccggccagatgaggttatcttcttgagtctcagggtttactgtctgtcactgagttgcaaataaaagaaaagttggatgagttattggcagcctcaagagcaacagtgagaattgtagactcactttctgcattggagggtgtggtgtgtgggctacgggaagcgtggacatcattcaccatgctaggtgccgagaggggcatcagacacagcaggtgcgtgaatctcctgtcttcatatgatactgtctcactgtcagaatcacagtgacagaaggcatttgttactgtggattcacactccgttagggttaagatttttattctgtgtgagttccttagggttactgtgaaaagcacatcttatcttctctcgataatttttaagtgacatttaaaaatattcaagcatgtgacttgaccgaattgcttagcatttgagttgttgcattaaatggagcatctcgtcactttcaagtatttgatactggcagttgctaagagttaaaaggcagctggatttgtcgcagacaatgagttaaggaatccttccacatttttcccatttttttttttttttttttttttttttttgagacagagtttcactcttgttgcccaggctggagtgcaatggcacgagctcggctcaccgcaacctctgcctcccaggttcaagtgattctcctgccttagcctccctggtagctgggattacaggcatgtgccaccacacccggctaattttgtatttttagtagagacggggtttctccatgttggccaggctggtcttgaactcccgacctcaggtgatccgcccgcctcggcctcccaaagtgctgggaatacaggcgtgagctgccgcgcccggcccgtttttcccaactttaaaagtaagggttctcaggaccctgtgtagagcagtgaaaataagacctcgtgtgtgtgtgtgtgtgtgtgtgtgtgtgtgtgtgtacacacgcgcctgcaggagaactgctgttccacttaggtgagaggatgggctgtgtgcttcagaccaggaaatgtgtcatcttgccaagcaacctggctgagtgtgctggagtcaggatcttgaacagaaacttccttttctggtgttgttcactacagagctaaaatggccaaatatatactgtgaaaattgttttttttttttttaacaaaagaccagatccctccttcagctgtatacatttttgaataaaatcatattgaactaacaaaaaaaaaaaaaacaccaaaactggggaacttgcacaatagaaatatatcctctcccaggtctggaggacaagactttaaatccaaggtgtctcagggctgagctccatccagacgctctaggggaggatccttttggcctcccccagctcctgggggctccaggcatcccacggcttgtggctgtatcactccagtctctgcctctgtcttcacatcatcattttctctcatctgtctcaagcatgcctgttcctcctccttataaaaaccccaggctaggcgtggtagctcatgcctgtcatcccagcactttgggaggccgaggcgggcagatcacctgaggtcaggagtttgagaccagcccggccaacatggtgaaaccccatctttactaaaaatacaaaaataagccgggcgtggtggcgggtgcctgtaatcccagctacttgggagactgaggaagggaggatcacttgaactcgggaagtggaggttgcagtcagccaagatctgtccgctgtattccagcctgggtgacagagcaagactttgtcaaaaaaaaaaaactcaaaaagacaaaacaaaaaaaactccgcactcctgtcatcctagcattttgggcagcagtatgataacaaggccaggagtttgagacctaccttggcaacatagagagacccctgtctctataaaagctaacaaacaaaaaacaaaaatctttgtcattatatttaggctaatacaggataatttcctcatttgaaaacctttaatgtctaaacaccctattttcatacaaggtaatcttttcacaggttctagagattaggaccaggagatttttagggacggagtggaggataccgtcatttagcctaccacattcttactaccttaggaaaggatggccaggcaaggtggctcacgacggtaatcccagcactttgagaggccaaggcgggcggatcgcttgagcccaggagttcgagtccagcttgggcaatattgcaaaatccgatctctacaacaactacaaaaagtagccaggcgtggtgctgcgcacctgtggtcccagctactcaggaggctaaggagggagaatcgcttgaattcgggaggtggaggctgcagtgagcccagatcacacctttgcactccagcctgggtgacagaacgagaccctgtctcaataaatgcataaataattttaaaaaggaaagtaattcagcacaaacatttgcatattcccaagatgatgctcacagcttgcagtgcctgcctgggtcctattcctatctgcctgggtctatctgcctgggtcctattcctatctgcctgggtcctattcctgtctgcctggggtctatctgcctgggtcctattcctatctgcctgggtcctattcctatctgcctggggtctatctgcctgggtcctattcctatctgcctgggtcctattcctgtctgcctggggtctatctgcctgggtcctattcctatctgcctgggtcctattcctatctgcctgggtcctattcctatctgcctggggtctatctgcctgggtcctattcctatctgcctgggtcctattcctgtctgcctggggtctatctgcctgggtcctattcctatctgcctgggtcctattcctatctgcctggggtctatctgcctgggtcctattcctatctgcctgggtcctattcctatctgcctggggtctatctgcctgggtcctattcctatctgcctgggtcctattcctatctgcctggggtctatctgcctgggtcctattcctgtctgcctgggtctatctgcctgggtcctattcctatctgcctgggtcctattcctgtctgcctcgggtctatgcatttcctttttgtctgaggacacatttttgcttcatgctgatatttttcacttcacctttctccccttttcttcttttctctttttccctctccttccctcccctccctctggggcagaagctggcatgcggcagagcgccagcagaggacgtggcccaagctcccatacatcttccctttacctcttccgctgacttttttctgggtgtgcccagagagcctagctctggacactcaaagatgcatcatttcaatgtatgttccaaagttacgtagcatccaaggcatatgagacatgcttaaaaacatactggtcatgcaagtgaggaggtgcaatgatgggtactgtcgttgcgattgcggaagccagatctagagatgcccggcgtggcttggggttcaggaaaacttcctgaaggaggtgacacatttgcgtttacgatccccaagtgaggcacacaagcatctctcggcgagaaccccacagtccatcccagaaaaggaaagtcaagagaatgggctacgtatgggaggaagggaactatttatggtcttcgatgagaaaataaatgtgcgtatgcgccccagctttgtgcttcggtattgccacatgccggaaccgcgtgaaaatacaagccgtcaatacaagcaagtgctagccctcttttattattctactgcagaagaaggaagtccttgcttctgagtcattttgtgtattagttacacatgccgtgtaacaaaataacacagactcagcagcgtgtcctaacagcctggtaatattttatccagaatgacgtgttttagaaagttatgtcctgtcaaagtaatccagataccatttccttttcttcttgtttttttggtattattatactttaagttctggatacatgtacagaacgtgcaagtttgttacataggtatacacgtgccatggtggtttgctgcacccatcgacccgtcatctacattaggtatttgtcctaaagctatcccttccctaaccctccaccccccagcaagccctggtgtgtgatgttcccctccctgtgtccatgtgttctcattgttcaacttccactgatgagtgagaacatgcagtgtttggttttctgttcctgtgatagtttgctgagaatgatggtttccagcttcatccatgtccctgcaaaggacatgaactcatcctttttttatggctgcatagtattccatggtgtctatgtgccacattttctttatccagtctatcattgatgggcatttgggttggtttcaagtttttgctattgttaatagttccgcaataaacgtatgtgtgcatgtgtctttatagtagaatgatttataaacctttggtatatacccagtaacgggattgatgggtcaaatggtatttctggttctagatccttgaggaatcgccacactgtcttccacaatggttgaactaatttacactcctaccaacggtgtaaaaatgttcctatttctccaaatcctctccatttccttttcttctccttatacagtaaggaatatgaaactaacacacactttctctcatttcattctctttctttttctgtctgctctctttgtctttctccctctctctctccctctctttttcctctctctctctccctctctttttcctctctctctctctctttctctgtctctctctttgtcttcttttctctatttctctctgtctctcagtgtttgtcacgctctctctctttgcctctttctgtctctttttttttttttgagacagagtcttgctctgtcacccaggctggagtgcagtggcgcgacctcggcttactgcaacctccacctcccaggttcatgcgattctcctgccttagcctcccaagtagctgggattacaggcgtgcaccaccacagtcgcctaatttttgtatttttagtagagatggagtttgaccacaatggccaggctggtctcgaactcctgacctctgcccaccttccaaagtgctgagattacaggtgtgcaccaccacagctggctaatttttgtatttttagtagagacgaggtttcaacatgttagccaagctggtctcaaagtcctgacctcacgtgatctgcctgccttcgcctcctaaagtgctgggattacaggcatgagccatcgtgcccggcctctttctttgtatctctctgtctgcctttctctctttgtcccttttactgtctcccgtccctctctctctttctgtttctctctctcactgtgtctctttgtctttatctctgtgtgttttttctctcttccccttttcctccccctccttttttctctttctctcttagcctttctttctttctctctttctctctctctctgcttctatctttctatctctctctttctcattcttacactccatctctgtctcttctctctctctgatggtgagtggagagtcatttcgttttggaatgatgatgagcattccagtaatagttttggagagtaaggctcatagagcttattaagcaaggtgtgtctgtcataaaattgattgctggcattttacacatcagtgcagacatggggggcacaggcagacccctccccccaccacacacacacactgcttatcctctgaaagctatgtggccttcataaaaatattaacagttcttttacagtaatgattttcccctatgaggctccccagtgaggaggctgtaaatgacactgaccaccagcagccctgcagatcaaggctgttctcttctcggccagcccagaaccagcctctgctcgctccctccctgaggactcctgtctctgacctctgcacacatgctgtgatttgctcttccacctcacaccattccccatcctcacctttcagaactcactggcagtgtcccccaataccttccacctctctccagaaattaccttcccatctcaatgtaagggaacttgcttcttccctcagagatctgctgtctctgctgcaagtaatagctagttttcatgcattttgttctgtctgactttaggttgttgcattgttctcccaacctccttgaacccatggacctggaggcagaattatatacctgtgaatttgcttttctttctagttcctctccctccaaaacctcagtccttctgggaaaaaaaaaaaaaaaacagctttaacacaatcaaacacatcacttttagcgatggagacccactgggaatttagagagaaagagtgaagttgatatactgaatacaatagacataagtctacctctctacctatgtgatgttataaagctgtccctgagtcattcactctctaaaaatgtcatctttggctggacacagctgctcacgcctgtaatccaacactttgggaggctgatgtgggaggctcacttgagcttaggagttcgagaccagccatggggacatagtgagaccctgtctccaaaaacataaatgtaataaaaaataaaatgctttcttttattattcttctgcagaagaaggaagtccttgcttctgagtcattttgtgtattagttacatatactgtgtaacaaaataacagactgagcagcgtggaagagctcatacttactatctgtagcaagggatccataaatggcgtccttttttattattatataaaattctatattctcctgtggaagaaggaagtccttgcttctgagccattttgtgtattagttacatatgccctgtaacaaaataacacagattcagcaacgtggaagggctcgtacttcttactatctgtagcaggggatgcataaattgcttcctgtttgattattatataaaattctatattctatattcctctactgcagaagaaggaagtccttgcttctgagtcattttgtgtatcagttacatatgctgtgtaacaaaataacccacagactcagcagcgtggaagggctcatacttactatcccacagctgctgcgggtcaggaatctgggcaggtgtaactgcattctctcttcggggtctcactgggctataaccaaagtgtcatctggcctgaggtcctctctggagctcaggatcttcgaaattcacatggttatacgcagaatccaattcctggaagctgcagatctggggatctgagtatcttgctggcttttggccaggggctgctgtcagctcctagagaggccatgcccaggttctggccccaaggcgctctcacaaaacatcagctcacatcaaggtcaggaggagaatgacaggtcccacacagactcaaggaaaggggactatacaaggatgggactcattgatctccctagagtatgagctcctcattgtaccctactgacatgtccaattcagtgttacttcctggacaggcgtggtggctcacgcctgtaatcccagcactttgggaggctgaggcgggcggatcacctgaggtcaagagtttgagaccagcctggccaacatggtgaaacattgtctctactaaaaaaaaaaaaaaaaaaaaaaatacaaaaatacaaaaattagctgggcctggtggcatgtgcctgtaatcccagctacctgggaggctgaggcaggagaatcactggaacccaggaagcagaggctgcagtgagctgagatcctgccacagcactccagcccggtcaacagagcgagactccatctcaaaaagagcagaaaaaaaaaaagtgttacttcctagatgaaattgagtttgacctgtttagaaattttcttaatctctgaaataggttgggagataaccaggtattttttgttgttgtccttttccagtggaatttttatactgtgacttggcttccatgacttccatccggcagtttgtgcagaagttcaagatgaagaagattcctctccatgtcctgatcaacaatggtgagtcctggtgaaattgcagcaagccaggggttaatttgaatgcaaacaggaactctagctttcatgcgggagaagtgtctcagcaaaacaggatatccatgggaattattgaacatacctgctatttctagtcagtgcttcatttcacggatagctttggaagagcatcattcttgttagcatgttactttgaaataatggtaaacgcgataacatgttgtatggagttgacacgttgacttgtccacttggactaaagggtatgaggcacatgctaagggttggtgttttcccaaatgttatcttacaaaaccatcaccacattcccctgagagtcattatttgggcactagaagctcattaccatttatctcttgattttaccccctgttcaacattctcacccagataggtggagtcaatatctccccttccccaccttcaatctgcccatctgccaatcttcaacacaaactacccttgaccttgagcccttctttgagcctcgctgagtgcttaaggtcattgcaacgcttactgttgaccttgagcccttctttgggccacgctgagcgcttaagatcattgcaacacttaatgtttctcctcgtaacactgatgcccattactctcatcccctgctgcagtccattttattttttataaaagttaacctgaaccctccacactgaggaggtacagttattgacatctccaaactaagtaaatacatagaactaaaggtctcagaaatacaccaacaaacatgtgtgctagtagaatttaacgcatcactttcacagatggagaccaaatgcaaattcagagaggaaataaatagtgacattaatacagtggatagaacagacgtacgtcaaacagtgagcccataaagacagcacattcctttcaaatacatgaaatatttatcaagttattgacacttcagattgcagacaaaaaaatcagcaaaaggatcttgtgattacccaatgtaattactccattacccacctagaccattaaagattcttaattctgcaaaaccccttgtgctacctaacgtaccattttcataaattctggagattaggatatggacatgtctgtaaggagggagaaagcattattctttgtactaaagttgtaatacctgtctgtttccagctgccaagatgtggtagcttctatctaatttttttttctttttgtcttgatgtgtttcgtgtttttgtataacattaatgggattggaggataggaaagtggatgagatacccacggttccccctcaacccacttgtttaattggaaattattatgctagagtttaaaggagaagcatgggatataaaactatacatagagtgtgatgccaatttatgcataaaaatttgtacagacatagctatgtgtgagtgcatatgtatttgtatatgtatttgatgtatgatgtatatgtatttatgcataaaaatacgtgcagacatagctatgatgtgtgagtgccactcaaatagctacagacaacaccatttccatgtacttagcctggtaagaaacatcgtattatcagtgctagtggctcctgttggaaggtccggaatgattttaactttgtgtgtcttctttggagatcaataacacttttcagatttgccatcctggtgggatctgaagtttctacgcaggcataaatgatttcccagtcagcagccatttggaatcttctgtctcagcactgggtgtggacttcctttgctgaagacctatcagtattagaagtgattagaattatagcattataagtcaccaaatgtggagaccacttagaggcactgtggagatcctacacgacccgacgtctcatttcctcgttctgtgtaacacccttactcattagtaatgggagcactttatcacagagcagttggagatggaaatacatacatgacatggtgcccttgcacagagacacacaaaacagaactgtccatcctcttaggacttttgtgcgactacttccatccatttggtatgggcttgcatccaccagtaagcagaaaaaattaggaatctcaggccgggcgcggtggctcacccctgtaatcccaacactttgggaggctgaggtgagtggatcacctgaggtcaggggttccagaccagcctgaccaatatggtgaaaccctgtctctactaaaaatacaaatattagccaggcgtggtggcgggcatctgtagtcccagctactcaggaggctgaggcaggagaatcgcttgaacctgggaggtggaggctgcagtgagccgagaccacaccattgcactccagcctgagcaacagagcaagactgtttcaaaaaaaaaaaaaaattaggaatgtcagatatgatatgtttctccagcagaatcttactgtgttctggggggagcagaattttactgagcaatgtgtatatgaaccacatctgtgacagtggatacaggctaacaccagttgacacaggctaaccagcgtatactccatcactcaaccaccacgtttaccttttgaaatggctattgcattcctaggattctcctctgttccttttctcaacagattttaaacaaggcacacagggctctcagaaacaaacaaaaatattctggaaactgggacagggttgaatttgaatcaaaagggtcttgttgttggattgtctctgtaccctatctcttctgtagaaaatctcatgcacatattgggtttacttcttcctagacttatctagacctttcttccatgctaagaccttttaccttcgctcaatgcctcagaggcacctcaagccagtaagtccagtgtgaaattcctgagtctatggctgacactggttctagaggagagtatttccttccccagtttttagaagactgtcagcgtttcttcacccatggcctccaacccggccttaaagccagcaatgatagtggctcacgcctgtaacctcagcactttgggaggccgaggcaggtggattacgtgaggtcaggagttcgagaccaacgtggacaacattgtgaaaccctgtctctactaaaaatacaaaattagctgggcatggtggcgcatgcctgtaatcccagctactcgggaggctgaggcaggagaattgcttgaacccgggaggcagaggttgcagtaagctgagatcacaccactgcactccagtctgggcaacaagagcaaaactccatctcaaaacaacaaaaacaacaacaaagccagcaatgagacacctttgaatctctctttcttgttctctctctctccctctcttcccttctctctctttctctctctcatcttgccttctctttttttttatctccttcacttacttttgttcttctgcctgccttgtagaagaaccattgtgattatttggggcccaccaggatcatctcagataatcacctcatctcaagatcttccactaattcacatctacaaaggcccttttgccgtgaaagtcacattttcatgtgttccagagatgaggacatggacattttttcatcttttgagttattactcttccaaattgggaataggttgtgggcatctctggggtcattattgtgtcgaccacatgagaattagtctgtggacatctttagagccattattcagtcttccacatgaggattaggatgtggacatctttggggccattattctgtttcccacatgaggattagaatgtgaacatctttggggctattattctatctaccacatgggaattaacatatggacatctttggggccattgttcggcttccacatggggattaggatgtggacatctttggggccattattctgtcttccacatggggatttggatatggacatcttcggggccattattctgtctcccacatggggattcggatatggacatcttcggggccattattctgtgtaccacatggggattgggatgtggacatctttggggccattattctgtctaccacatggggattaggatgtggacatcttcagggccattattttgtcttccacatgaggattgggatgtggacatctttgggtcattattctgtcttccacatgaggattaggatgtggacatttttggggccattattctgtcttccacctgaggattaggatgtggacatctttggggccattattgtgtctcccacatggggattacagtgtgggcatttttggggtcatgattctgtctcccacatgaataatgtggacctggacatcttgagttgtgcattatttaacctgccatacctacctactctgcccttcacatacttcgcttgcaggaaaaataaaataataagcaagattcttgacctcatagaaatcatactttagcaacggaaacaaacattggaccaataatcattctgtgaaatgttctgccttagaaaacacacctcttgcaatgtgacaacacagtcttgtaaagtacagagaagattgcaccccaagtcacacgcctccctggaattccccagcctgtgctgctcagaacaccatttccaggaggtgataatgagaatccatttgttacaagatgatggcttgaaataacactttgcactttcttccttttatctttttgttctacatctttcaagaggttgctcaggctgtggctttcctggactccctataggtttttgtggctgactaaggttcatcttgtccctggggtcactgttgagaagagctcagttgcagaggatctggatttttttttttttcctctgtgggtacagacagaagcttctagaaaagagctggagacttcgcttttggaggctgtgttgaatacccattgcccactcttcacaagaagacagaaatgcagagaggcagtctcttgttgacaaatcctcttggttctcttggaaatgcaacagaaccatggagcttcgtgaagcccatgggcttggaaaggggcctcccgaggtacccagggtggatggaaagctgcagggataagtgctcctcaagccagaagtagcccagatggcacagtctatgctgagaatggattcatcaccagcctgtgtgctggaggcttgggccagatgaaccttgatttagagaggaagtaaagcattttttgccttggtttgtgcatcagaattcatcttcatggtgtgcaaatgacgaggctggattctatacagtcagcactgagaatggattcagcacaagcccgtgtgctggaggcctgggtctgatgtacctggatttagggaagaagcaaagtatttttctcatttattgcatgccttagtttgtgcatcagaattcatcttcgtggtgtgcaaatgagaaggctggattctacacagtcagcgttgagaatggattcatcaccagctcttgtgctggaggcttgagccagatgtacgttgatttagagaagaagtaaaggatttttctcatttgttgcatgccttggtttatgcatcagaattcatcttcgttgtgtgcaaatgagaaggctggattctatacagtcaacgctgagaatgggttcatcaccagctggtgtgctgaagcttgggccagatgtaccttgacttagagaagaaatcaaggatttttctcgttggtttgtgcatcagaattcttcttcgttgtgtgcaaatgagattgctggattgtatgtttgggatattgctggtgtcaacttatgtaaatagagtttctatttataggcagcctcagggaaggactccagtggtggtacttttagtgtctaagaggctagtagggggtctgcagacccctaaaccagggctgtccaacccccaggtcatagtaccagtccatggcctgttaggacaccggccgcacagcagaaggtgagtggcaagtgaacaagcaaagcttcatctgtatttacagccactccccattgttcacatgactgcctgagctctgcctcctgtcagatcagcagcagcattagattcttataggagcacaaaccctactgtgaactgtgcatgtgagggacttaggttgtgcactccttatgaaaagctaaagcctgatgatctgtgcatgggaaggatctaggttgtgtgctccttatggaatctaattcctgatgatctgtcactgtctcccatcacccccagatgggactgtctagtcacaggaaaacaagctcagggctcccactgattctatatgatggcgacttgtagaattatttcattatatagtacaatgtaataataatacaaataaagtgtacaataaatgtcatgccccggaatcatcccaaaaccatccccacattccacctccaccttctgtcttcagaaaattgtctttcacaaaagtggtccctggtgccaaaaaggttggagactgctgccctaaactatttccccagaaccttccctccaaaactcctgctagtcaaccacgtgcctcaagtctcatggaaaacagccccagctgagctcagccagggtgacttccaaggcaagaaggagctacacttcgtgcttttctttttttattcttagagcaatcaaggttttgcaaacattaaatacttcagacatagaatatctttttcatttgctagtgggttgaaaatagaacctgactgcctctgtctggctgctgtgggaagctcagaggcaacgcgatgatttatcaagcacaagaataaatcaataatagacctcctgcagagccggtatttatggtttattcacttcaaaattgtatttatctagcttcccatccccatgtctgaaaattgatagatttttaataatgcagaggatttatagatttatccttgtcagccatcttcccataactctaatggatgaatttctttctgagataatgaattactaagcattatttttcctaccaccaaagaaatacgtccacgatacagggtgaccctgaaaaataacaatgattcttccctggccagagacctaaagactctgttttttggtacagttcttcattcacccattcattcattcattcattcattcattcaaattcattcattcacttgaatgaattcaaatgagtgaatgaatgaatgaaagaattcaaatgaatgaatgaattcagaggaatgaatgaatgcaaatgaattcaaaggaatgaacaaatgaattcaaatgaattaattctaaggaatgaatgaattctaatgaatgaacaaatgaattcaaaggaacgaatgaattcaaaggactaaatgaattgaaaggaatgtatgaattcaaaggaatgaattcaaaggaatgaatgaatgaattcaaatgagtgaatctgaatgaattcaagggaatgaataaattcaaatgaaggaatgaattcaaatgaatgaacaaatgaagtcaaaggaacgaatgaattcaaaggaatgaataaattcagaggaatgaatgaatgaattcaaaggaatgagtgaattcaaaggaatgagtgaattcaaaggaatgagtgaattcaaaggaatgagtgaattcaaaggaatgagtgaattcaaaggaatgaacgaattcaaaggaatgaatgaatgaattcaaatgagtgaatttaaatgaataaattcaagtgaatgaatgaattcaaaggaacaagtgaattcaaaagaaggaatgaattcaaatgatgcaaatgaatgaatggaatcaaatgaatgaatgaattctaatgagttcattcaaatgagcaaatgggcacagggcacctacaagacccatgagagttaaggaagattcattcggggaagcccaggtgtgcagttctgcatcaacagaagactgaggtgcagtggagccggtccttactgaggacccactttttggtggacggacacctgagcagccatctcctgtctttgtgggcgcctggcattttctatgtgactcgggctccacagtcatctggtctccctcccgggaagacggaaagtgttgcatcgcggcgcatgcattcgtcagcggatccttgagtctgcacaggtgtagaccatttattctgcgtgccttctgtttgcttctcttccagagctgctctcctgtggatagagtagctttctgttccgtagtggtttcctctgcctctcccgatggcgccttctctgaacaggaggcatttggatgttcttttagtgttggtgttggcagcagcatgggatgtggtctgttgtgactctgcggcaggctgttccctgccagagaaggctagatgttcagggcgtccgtcccatagcctccctggactggctccatccttcccaccgccctcccgagattctaggaagtgggttgagaagcagtggtttttcagttactcaaatgcttttctcctctctctctctctttctgtaactctctgtctctctctcctccttctccccgtctctctgtcattctctctttccacctcttcactgtctcacttttcctctcttttgctttttctctctgtctctctctctcctcagtctaccccatccccgcttctactattttgctctcgacctcccttctccctcctccctccctctctccccctctctctccccttctcccttctctctctccctttctccctctctctccctctctctctttctctcttctctctttcttctctctctccccctccctccctcgctttctcccctcttctctctctcccattctccctctccctccctccctctctccttccttccctctctccctctttctcccctcttctctctctccttttctcccattctctctctccctctctccctccctttcccttcttctctccctcccctctttcttctctctcccctctttcttctctctctccctttctgtttccctctcgcacaccctccctcttctccctatctcctttctcttcctgtctctccccttgtctctctatctcctttgtcttcctctgtgtcccacttctctctctttcctccttcccccatctctcctcctctctcctttgccttccttctctccccctttctctctttctctctgtctctttctctgtctctccccttatttcctccctctccttctctcttcctttctcgtttgccctccctctctctccctgttccctctccatctctctctctctttcccccatttcctcctcttccttctctctccctctcgtttgccctccctctctctccccgttccctctccatctctctttctctctctttcccccatttcctcctcttccttctctctccctctcgtttgccctccctctctctccccgttccctctccatctctctttctctctctttcccccatttcctcctcctccttctctctccctctcgtttgccctccctctctctccccgttccctctccatctctctttctctctctttcccccatttcctcctcctccttctctctccctctctcgtttgccctccctctctctccccgttccctctccatctctctctctctttcccccatttcctcctcttccttctctctccctctcgtttgccctccctctctctccccgttccctctccatctctctttctctctctttcccctatttcctccctctcctccttctctctccctctctcgtttgccctccctctctctccccgttccctctccatctctctttctctctctttcccccatttcctcctcctccttctctctccctctcgtttgccctccctctctctccccgttccctctccatctctctttctctctctttcccccatttcctcctcctccttctctctccctctcgtttgccctccctctctctccccgttccctctccatctctctttctctctctttcccccatttcctcctcctccttctctctccctctcgtttgccctccctctctctccccgttccctctccatctctctctctctttcccccatttcctcctcttccttctctctccctctcgtttgccctccctctctctccccgttccctctccatctctctctctctttcccccatttcctcctcttccttctctctccctctcgtttgccctccctctctctccctgttccctctccatctctctttctctctctttcccccatttcctcctcttccttctctctccctctctcgtttgccctccctctctctccccgttccctctccatctctctctctctttcccccatttcctcctcttccttctctctccctctcgtttgccctccctctctctccccgttccctctccatctctctctctctttcccccatttcctcctcttccttctctctccctctcgtttgccctccctctctctccctgttccctctccatctctctttctctctctttcccccatttcctcctcttccttctctctccctctctcgtttgccctccctctctctccccgttccctctccatctctctctctctttcccccatttcctcctcttccttctctctccctctcgtttgccctccctctctctccccgttccctctccatctctctctctctttcccccatttcctcctcttccttctctctccctctcgtttgccctccctctctctccccgttccctctccatctctctttctctctctttcccccatttcctcctcctccttctctctccctctcgtttgccctccctctctctccctgttccctctccatctctctttctctctctttcccccatttcctcctcctccttctctctccctctcgtttgccctccctctctctccctgttccctctccatctctctttctctctctttcccccatttcctcctcctccttctctctccctctcgtttgccctccctctctctccccgttccctctccatctctctttctctctctttcccccatttcctcctcctccttctctctccctctcgtttgccctccctctctctccctgttccctctccatctctctttctctctctttcccccatttcctcctcctccttctctctccctctcgtttgccctccctctctctccctgttccctctccatctctctttctctctctttcccccatttcctcctcctccttctctctccctctcgtttgccctccctctctctccctgttccctctccatctctctttctctctctttcccccatttcctcctcttccttctctctccctctctcgtttgccctccctctctctccccgttccctctccatctctctttctctctctttcccccatttcctcctcctccttctctctccctctcgtttgccctccctctctctccccgttccctctccatctctctttctctctctttcccccatttcctcctcctccttctctctccctctcgtttgccctccctctctctccccgttccctctccatctctctttctctctctttcccccatttcctcctcctccttctctctccctctcgtttgccctccctctctctccccgttccctctccatctctctttctctctctttcccccatttcctcctcctccttctctctccctctctcgtttgccctccctctctctccccgttccctctccatctctctctctctttcccccatttcctcctcttccttctctctccctctcgtttgccctccctctctctccccgttccctctccatctctctttctctctcccccatttcctcctcttccttctctctccctctcgtttgccctccctctctctccccgttccctctccatctctctctctctttcccccatttcctcctcttccttctctctccctctcgtttgccctccctctctctccctgttccctctccatctctctttctctctctttcccccatttcctcctcttccttctctctccctctctcgtttgccctccctctctctccccgttccctctccatctctctctctctttcccccatttcctcctcttccttctctctccctctcgtttgccctccctctctctccccgttccctctccatctctctctctctttcccccatttcctcctcttccttctctctccctctcgtttgccctccctctctctccccgttccctctccatctctctttctctctctttcccccatttcctcctcctccttctctctccctctcgtttgccctccctctctctccctgttccctctccatctctctttctctctctttcccccatttcctcctcctccttctctctccctctcgtttgccctccctctctctccctgttccctctccatctctctttctctctctttcccccatttcctcctcctccttctctctccctctcgtttgccctccctctctctccccgttccctctccatctctctttctctctctttcccccatttcctcctcctccttctctctccctctcgtttgccctccctctctctccctgttccctctccatctctctttctctctctttcccccatttcctcctcctccttctctctccctctcgtttgccctccctctctctccctgttccctctccatctctctttctctctctttcccccatttcctcctcctccttctctctccctctcgtttgccctccctctctctccctgttccctctccatctctctttctctctctttcccccatttcctcctcttccttctctctccctctctcgtttgccctccctctctctccccgttccctctccatctctctttctctctctttcccccatttcctcctcctccttctctctccctctcgtttgccctccctctctctccccgttccctctccatctctctttctctctctttcccccatttcctcctcctccttctctctccctctcgtttgccctccctctctctccccgttccctctccatctctctttctctctctttcccccatttcctcctcctccttctctctccctctcgtttgccctccctctctctccccgttccctctccatctctctttctctctctttcccccatttcctcctcctccttctctctccctctctcgtttgccctccctctctctccccgttccctctccatctctctctctctttcccccatttcctcctcttccttctctctccctctcgtttgccctccctctctctccccgttccctctccatctctctttctctctctttcccccatttcctcctcctccttctctctccctctcgtttgccctccctctctctccccgttccctctccatctctctttctctctctttcccccatttcctcctcctccttctctctccctctctcgtttgccctccctctctctccccgttccctctccatctctctctctctttcccccatttcctcctcttccttctctctccctctcgtttgccctccctctctctccccgttccctctccatctctctttctctctctttcccccatttcctcctcctccttctctctccctctcgtttgccctccctctctctccctgttccctctccatctctctttctctctctttcccccatttcctcctcctccttctctctccctctcgtttgccctccctctctctccccgttccctctccatctctctttctctctctttcccccatttcctcctcctccttctctctccctctcgtttgccctccctctctctccctgttccctctccatctctctttctctctctttcccccatttcctcctcctccttctctctccctctcgtttgccctccctctctctccctgttccctctccatctctctttctctctctttcccccatttcctcctcctccttctctctccctctcgtttgccctccctctctctccctgttccctctccatctctctttctctctctttcccccatttcctcctcttccttctctctccctctctcgtttgccctccctctctctccctgttccctctccatctctctttctctctctttcccctatttcctcccctccttctctctccctctcgtttgccctccctctctctccctgttccctctccatctctctttctctttctttcccccatttcctcctcttccttctctctccctctctcgtttgccctccctctctctccctgttccctctccatctctctttctctctttcccccatttcctcctcttccttctctctccctctctcgtttgccctccctctctctccctgttccctctccatctctctttctctctttcccctatttcctcctcttccttctctctccctctctcgtttgccctccctctctctccctgttccctctccatctctctttctctctttccccctatttcctccctctcctcctctctccctctcgtttgccctccctctctctccctgttccctctccatctctctttctctctcttcccccatttcctcctcttccttctctctccctctctcgtttgccctccctctctctccctgttccctctccatctctctttctctctttcccctatttcctcccctccttctctctccctctcgtttgccctccctctctctccctgttccctctccatctctctttgtctctctttctccctatttcctccctctccttctctcttccttctttgccctccctctctctctcctctctctctctctgattgccctttcatccccatcactctcctttctctggagttctccgcttggagagcggagaactctcccttctcctcccgttcaggatacacctcacctgtgttcactgcttcaggcacaatatgtgattgtgaccctgagcgttcactccccagtaaaatgccattaggtgcacagaccaatgaacgataattgtattgcgtattttccacctttgaattggcagatcaatggacgataattttactgtttattttccacctttgaattggcagatcgatggacgatagttttattctgtattttccacctttcgattcgcagatcaatgaacgatagttctattgtgtattctccacctttgaattggcgaagagacagattccgtgaatgctcctaacgtggacggcacccgatacactgacgtggccacagggttttcttattccttacaaaattcgcaatgaaacatcagtatatttgctgatgattaaaacttgtgcaacaaaatctcagaagtcaccacaaaagaatgtatccatgtagcccaaaaccactggtttcccaaaaattattgaaattttaagaaacaggccgggcgcgatggcccacgcctgtaatcccagcactttgggaggccgacgtggatggatcacgaggtcaggagttcgagaccatcctggccaacacggtgaaatcccgtctctactaaaaatacagaaattagctgggcatagtagcatacacctgtaatcccagctactcaggagcctgaggcaggagaatttctggaacccgggaggcagaggctgcagtgggccgagattgtgccactgcactccagcctagcgacagagtgagactccatctcaaaaataaaattaaattaaaatttttaaaaaaaggcaaattattattttattttatttatttatttccttttttgagacagagccttgctctgtcgcccaggctggagtgcagtggcacaacctcttctcactgcaatctccgcctcccagaaaaaaacaggcaaattaaatctatggtaatggaaattggaattgtagttaccttagaagaatgtgataattaattttggatcaaaaaagggcttaggggtgcagatgtgggaggcggttacctgagaggggagagtgctcgctttggatgattccattgagatttccctcatgatctctgcaccttttttttttttgttttgaaacatagtctcgctgttgtcggccggggctggagtgcagtgcacgatatcagctcactgcaacctctgcctcctgagttccagaaattctcctgcctcagcctcccaagcagctgaaattacaggtgcccgccaccacactcagctaattttttttttttttttgtatttttagtagagacggggtttcaccaagttggccaggctggtctcaaactcctgacctcaggtcatccgcctgcctcggcctcccagagtgctgggattacaggtgtgagtcaccgtgcccagccctgtgcaccttttttatactttcctttgatttaaaagaaaataataacttgacaaaaataaataaatagaattttactgatgccgaaaaaaacatgattatggaaaatttaaaacacatacaaaagcctacaggcatttgaatttgccgtcgattgtctaactagtactcaattctgcatttcggacttccgtcaatccctcctctggggtaccatcatctcttcctaggccatgataatggcctcctaacaggcatctcaggcacccatccaatctctctacctggcaccaatctggtctttcaatgctctgcttacataggaagaggaaaattaatacctaaagccactggcaaagaactcaacaacaaaacaatttctccttcagaatatgtcaggctttcgttccgtaaatatcagcgtttcaggtgggtttgctgcctagaaacgtctccgtgacactgtggtttaaaatacgggtgcgtggccgggcgcggtggctcacacctgggatcccagcactttgggaggctgaggcgggcagatcacttggggtcaggagttcgagaccagactggtcaacatgacaaaaccccatctctactaaaaatacaaaaaaaaaaaaaaaaagtttagccgggtgttgtggtgcacacctgtaatcccagctacttgggaggctgaggcagaagaatcacttcaacccgggaggcggaggttgcagtgagccgagttcaacccactgcaatccagcctgggcaacagagtgagactccatctcaaaaaaaatgaaataaaaaataaaatacggacacactgcactccagcttggttgacagagcgagactctgtctccaaaaaaataataatattagtagggctgggtgcagtggctcacacctgtagtcccagcactttgggaggccaaggcgggaggatcagttgagattaggagttcaagagcagcctggccaacatggtgaaaccccgtctctactaaaaatacaaaaaatagctggccatcggggcaggtgcctgtaatcccatgtactcgggaggctgaggcaggagaatcgcttgaacccaggaggcagaggttgcagtgagccgacatcacaacactgcactccagtctgggtgacacagcaagagtttacctcaaagtaataataataataataaaataggaataaacgtaattactcgcagtagctcactaacgatgaattatcagcatccagggcccctgcgcgtggctgctgcattcaccacggcgcaggaattctcacgcagcttccccgccaggcgagtccctagcacggctcggattcatctggagcacaggtcaccacctgcctgcacagaagcactgtcccctctgctcttgcaaaagataccttccccaacgatgctgttgtcaccaagaatttgctcagagctgcaagccattatcctaagagaaccagcacagaaacagaaaaccaaatactgcatgttctgacttacacctggaaggtacacagcgggtactcatggacacaaagatgggaagagcagaaactcttgactgctagaaggtagggggagggaggcaggggatgaaaaaccacctgttgggtacagtggccatttcctgggtgacaggttcactcacagccccaccctcagtctctaatgtgtattcctctattccgtatgccccttcaatgccagaagcatacccagagcttagtgcccacttacaagtgagaacgtgtatttgcttttctgttcttgagtgactccacgtagaataataacctccagttctatccaagttactgccaatgacacgattccactctttttaatggcttagtagtattccattccattttctttatccagtactccacggaggggtacttaggttgattccgtatgtttgcaattgtgagttgtgctgcaagaaacagacaggtgcaggtattttgttttgtattgttttgtttgattattttattttattgatttatttatttttgagatggagtcttgctctgtcacccaggctggagtgcagtggtgcgatctcggctcactgcaacctccacctcctgggttcaagcaattctggggtttctccatgttgcccaggctgctctcgaactcctgacctcaggtgatctgcccgccttggtctcccaaagtgctgggatgacaggcgtgagccaccatgcctggcctgcaggtgtctttttgatataaggacttcttttcctttgggtagatacccaggagtgggattgctggatcgaacaaatgatctgcttttagttctttgagaggaacatccgtgctgttttctatacagcttgtatgaattcactttctttcggggcacaggaatgtaggcagttctgcctggggggtctcctgtggggctgcagctggggctgactttatctgaaggcttgaccaggttggatgtccaggatagctttctctggtgtcaagaagctggtacagcctgtcacctgggcttagctgggagggccaacaagaacaggtacctggggcctctccagcatgtcaggctgaaggtgctcagtctttttaaaccaaagctggctcctcccagactcagcattcccaagaaccaagcaggggccacgtgaccttattgacccaactttggaagtcacacagtgtttacaccactgtggcattctacaaaagaattaacgagaaagttaatgagcatggccgagattcaagggaaggggcgtagactctagctcccaaggagacgagtgtcaaaagaatttgcaggcctgctttagagccccctgaagctgcctttcaaaaccatgcatgcataagccaggtgttcatgataagctcgtctctcctaagctgggaatttatgacacttcaggcacggattgagctgtgtgtctccagattcttcacatcaaataaaatatgaggaaaatggcatcgtgaaaaagatgtttatagttcatcaaaatgcaaagcttcccgtccacccacagcaacctattctggtgtttttgtttttttgttgttggtttttttttgtttttgagacaaaaatcaacttaggttgattccgtatgtttgcagttgtgagttgtgctgcaagaaacagacaggtgcaggtatgtttttttgtttcgttttgtctcactctttcgcccaggctggagtgcagtggtgtgatctcggctcactgcaacctctgcctcccaggttcaagcgattctcctgcctcagcttcccgagtagctgggattacaggcatgcaccaccacgcccggctaattttgtatttttagtagagacaaggtttctccatgttggccaagctggtctcgaactcctgacctgaactgatctgcccgcttcgccctctgaaagtgctgggaggattacaggcatgacccaccgggccgggctttttttctggataactcctgaggtgaattctgacatacttctcagaagtgttttgttagatgggctttgaggactgtaggagtgttgaatgtttaatacacatgtgtcttgtgactgattgatactggaccctgattgatattggatccctcccagttggtttatactcctgatgttttacaggcataagctcagggaataaattctctgtatcctggaagtttttttgaaagctagatattcacgtaggagggggaagcactgagtctggctggaaagtgtgtgcaggtgagaagcaaggactgcacctgaacagtctgctcatttctccctgaggatttcagcaggccacaggcctggaatggcatggtggtgcctctcccctgccaccattctctgtgagagtgtgtccagaatttattccttcttgtgggttcttggtctcgctgacttcaagaatgaagccgcagaccctcacggtgagtgttagggcttttaaagatggtgcgtcccgagtttgttccttcagatgttcagatgtgcctggagttttttccttctggtgggttcgcagactcgctgacttcaggagtgaagctgcggaccttggcagtgagtcttacagctcatacaggtagtgtagacccaaagagtgagcagcagcaagatttatggtgaagagtgaaacaacaaagtttccacaacgtggaaggggacacaagctggctcaggtggccagcttttattcccttatttggccccgcccacatcctgctgactggtccattttacagagtgctgattggtccattttacagagtgctgattggtccattttacagagtgctgattggtccattttatagagcattgattggtccattttacagagcactgattggtccattttacagactgctgaatggtccattttagagtgctgattggtgcctttacaattctttagctagacaaaaggtctccgggtctccactcgacccaggaagtccaggtggcttcacgtctcaaaagcagcagatctccatccacgtttattttttatttcccccttgctgtacccaaagcactacaaccgcactgtggaggctacagccagaataagacgttggtttttcctcaaggacctcacaattgtcaagcctccactggggccagggacgtgtagagccgcgggacccactgctgagtcttctgtgggccctccgcgcaatggggcatccagtgcggcctgtgcatccacagttttgaaaggcgggttggagaggctgtaaaacaggcctgcaaattcttttcacacttgtctcttcgggagctggagtccctgctccgtctcttgaatctcggctgtcctcattaactgtctcgtaattcctagaatggggcagtggtgacaactctgtaggagttccaaagttgggtcgataaggccacgtggctcctgcttggttctttgggaatgctgagccggcgaggagccagctttggttttgagtgttcataaagtacaactggaaagactgtgtacacaaacacaggcaggtacacaaatgcacacgcatcaaaaatttatagggaaatgggtccatgtaccgaggcacaaataacatacagatattacagtacacacagaagcaagcacatatacaaatgcatgtacctcaaaaaatgtatacacctacggatacacctctacatatacaaacacatagagaaatgctagacctacatatatgtatagatagctccatataagatacacacaaacacaagcacgtgtacaaatgcatatgcatagaaaaagatgtacgctatgcagatgtacatatacatacacaaatacatacagaaacgctagacctatagatatatacatatctccatataaaatacacacacggccgggtgcagtgtctcacgcctgtaatcccagcacttagggaggccgaggtgggcggatcccctgaggtcaggagtttgagagcagcctggccaacatggcaaaaccccgtctctactgaaaatacagaaaaatttagccacgtgtggtggtgggtgcctgtaatcccagctactcgggaggctaaggcaggaaaattgcttgaacctgggaggcggaggttgcagtgaggcgagactgcctcattgcactccagcctggacgacaagagcgaaactcctcctcaaaaaataaataaatacatacatataaaatacacacacacatacaagcacataaacaaatgcatgtacctaggaaaatgtattcatgtacagatacacgtatacatatacaaataagtagagaaatgctaggcctatatatgtgtagatatctccatataaaatacacacaaatacaagcacatatacaaatacatgtacatataaaaaatgtgtgcacttgcagatgcatgtatacatgtacaaatacacagagaaatgctagacctctatatatttgtgtgtagatataaaatacatacacactaatacaagcatatatacaaatgcatatgcataggaaaatatgtacacatgcagatatacatatacaaatatgtagacaaatgctagacctacatatatgtatagatagctccatataaaatacacacaaacacatatacaaatgcatatgcatagaaagatatgtacacatgcagatgcaaacacatatatatacaaatacagaaatagatctacaaatatcaatatagctccatattgaaatacatctttgaacacaaacgtgtccatatgcaaatggataggtgtgtgtgtgtattaatcatacacctcaaatgcatttgcaaatgcaaacgtgcacaaatgcaaaagctatgggattccacagatgaatcaaaatgcatattcatgcgtgcaatacacgtagatgttccaatgtacaaataatgacaaatgctgtgtgtttgtaggtgtatgaacacatgcaaatacttgcgattgtacaattccaaatagaaacatataatatatacatacactgtatgcagatacacatgcaaagatgtaaatgtgtatggacatgtatatacatgtgaataaatgtgtacacatgcaaactcatgcacatgtgcatacaacacatatgtaaaagaaaatatgcacaaatttataggcatttgaaaatgaatctgcatgtaaagacgtgaacacatatgtacatgctaacatatatctctataggcatatatctttgaattatgcatacatgcagttatatacccaagtgtatagctatataaacacatttacaaatgcgtatgcatatatgtatatgaatagacgtgcctgtatttgcgttacgtgtagatagatacagaattccaggtacatatataacatgcctatgtatacacatctacattatccatgtacatacaaatacatatctacattggcattaatatccaagcaaactggtctgctctaagtacaaggcagtatggttcgtgcgtgtttctaggacaagtcacctttgagatcaggcctccacagcaaggacttcagggcaggcgctcagccgggcttggcctgacaggggtgggctgttctgtgtctggtagatagaacatgtcaagcacagaacctgcggtgatgatgatgtctatagaatgatgaccgacagggctgccctgtggtctaggggtgaggacaggccatgtttatactgaggtcggcatttctcaaaggacatctgagcagtttgtttgtgggatactcagtgaagagggggtgccatagcagctatacttgtccagaattctggggggagacaggatctctgttgcccaggctggggtgcagtagcacaatctcggctcactgcaacctccacctcttgggctcaaacaatcctcccgcctcaacctccccgagtagctgggactacaggcacgcaccaccacacccactaattttttgtatttttggtaaagatggagtttcactgtggtgcacagcctggtctcgaactcctgacgtcaagcagtctgccctactcacctacccaaaggctgggattacatgtatgagccatcacacctagccgcccagaataattaattgtccaggggactctgtttggtgacttggatgattctcactctcttgtgtgtgttgctgtgttatcattgtggttattatttttcttttccttttttttttttttgagatggagtctcgctctgtcaccaggctggagtgcagtggcatgatctcagctcactgcaacctccgcctcccaggttcaagcaattctcctgcctcagcctcctgagtagctggaactacaggaccctgccaccaaacctggctaatttttgtatttttactagagacaagggtttcaccatgttgggcaggctggtcttgaagtcctgacctcagatgatccacccgccttggcctcccaaagtgctgggatgacaggcatgaacttctgacctcaggtgatccacccgcctcagcctcccaaagtgctgggatgacaggcgtgagccaccgcgcccggcctgtggttattatttttaaactcaaggcacagaggtgcagagacagaaggcaggaagggacttcagtgatcttctagaatcttctccatcacacctaaagcaggaaacagaggcccaggaggaagacatggccgccagctctacaccccaccctccgatgtcctgggccatttgcgcatctggggaatccatctgtgagatttctccactgtcttccccagtctaactccttctgatattctcttttgtccagctggggtgatgatggtccctcagaggaaaaccagagatggattcgaagaacatttcggcctgaactacctagggcacttcctgctgaccaaccttctcttggatacgctgaaagagtctgggtcccctggccacagtgcgagggtggtcaccgtctcctctgccacccattacgtcg

SEQ ID NO: 2893 - DNA, 209087 bp, human
gcccggcccgacccggcccgacccttccctccccgcgcgtgtggcctccccgcctgtcccgggtcgggctccaaccaagcagcccccgtgcagccgcccccccgcgcaccctgacacctccgggccatggccggggacccgggggctcgcacgccccgcgcccaagacatcaggcggctctgcctgccgcctgcggtcggccagtgaccgcgcgcccccgccaggccccggaggggaggagcgggcgtcccagggacctcgacccctacccaccccagggtaagtgaggatgggcccttctccggaggacgtctccagagggggcccagaggcggcttctcgggcactggggagccacggaggtctggtggggagggcaggcccgttaagtggcaactttgtttccttggcctttgtaaacatctctgagtcacagatctccaactttgcaggactcgttcactgtctgaactcatcagtgatgaccgccactgtgttttgtgtatgcagataacttctgttcctagatttgcaggttcagaatttattattattattattttttgtaataggaagtagagatgaagtcttgctctgttgccgaggctactctcgaactcctgggctcaagcagtcctcctgcctcagcctcccaaagtgctggcattacaggcaccagctactgcatccgactaatgttttaaagttttgtagacggggtcttgctatgttgctcaggctggtctcgaactcctgggctcaagcgatcttccttcctttgcctcccaaactgttgggattacaggtgtgagccaccacacctgtctaatgttttaatttttttgtgtagcaatagggtcttgctacgttgcccaggctggtctgaaactcatgggccgaagcaatcctcctacctgggtcccccaaagtgctgggtttacaggcgtgagccaccacgcctggctaatgttttaaattttttgtagagatggcatctcaccatgttgcccaggctggtcttgaacccctggcctgcagcaatcctccagtctgggcctcccaaactgctgggattacagacagagcgccactgtgcccagcccatattctcaatttaaacctagaaacctgtaaacaattatttgtgaactggaataaagggaatgttaattccatgttaggttaaatgatactttgtttcaaaaataacagttttccaaaacagagcgttcagagggtcagtgtggtgggggtgggggtgtacgttgccctgaatgtcttaaatgtccagcctaagaagagagctgttatttctgcctctgtagacagtttcatggcatgtcaggaggcctctggaagacactactgcacgcctctgggagactgggagtcagccaggcgaagcgcttgggtgccttattgtgaaatgacttttgacttccactctgcacccactgaaggaatcccaggggtcccagcgccaccctttgagaagcgtgcctggagtggatgttttaaaatgagcctctctctcccgcctctagccagagaaaaagagctttgagttttctgtgagctaagcttttctttttctgccaaactggccttcagtatttttttttaaacccacttagcataattacaaatgcatagaagaaggagagtaaagggaactgtagtcaggctttcggagggcaggagagcatgtttgtttgaagtaagtaatcagttgcaaggtgaacggtttacagctgctgaacaattgtgtggagtctcgcagaagattatgtttatccgggcagttttgcttacagaaaggtccccttaaacctccttaagggcctgtgtgggccctggcagaagaggccggggttcctgcagcagctcaccaaaatgctggcctttgaaaaacttgctctttgtgcattagaaaaagggctggaatcttttttttttttttttttcccatttactgattaaacaacaacagaaggttgttaaagaggacgagcttctggtgaagtcacgtgtctgccaagggaatctgtacccgggtgtgtatcgaaacagaatggccttctctaaagattaacttaagtggcttgccctcatcgagccccttcctatgtatggattaaaaataattttcgataccagtggaggaatgctgttgtccttggtctgctggtggccagcttcctaaacggcattttttatttgcttctctctggtaggccttcgctgttggtgaggaaacattgaactttgtccagggcatttgagctaagctgtttgaataaccaagagggccaatttccccactgcagattggaagcaagggcagttttttcttagaacttccaaatggagcgtgttcttcttaggtatcgtacaaaggaaatgcctgggttacaccttccacatgagttgacttacatggtatgagaaggaagaaattgtggctggaatccactcctaaatggtgtcttcttacagttcatcatggaaaaacaagataattacaaattaatcatagatgttggtcatgcctttacagagggggtttagaagcaaattgagaattcccataagagggtctgtctctgtgttcttaagactatatccatgcggcccattcagtaagttgtatctgttggttggattttaaaatagatgatttaatcagtgcatttaatatcctaatatggcatcaaaacttgaacattgatatggcctgaaatctgttgaaaatgatcatattgagtaaagaaagtctctacccaccggtattaataacagggtgatctgtttagaaattacattttctctgatacatcaatgagttttgcaaaggagagaaaattgatggtacctgtagtcaagtccagttccaatactgccacagaatttttcttaaaagttctattgtaaataataggccacagaatattccttcactttctgggatgcaaaatggattcgtaaatgctgtaccacaggagtgagtatttacaaaaaatatgccaactggcccacttacaaagctatttatagaagtcctacttttcaaactattttttttttaacctgtaaagggaaagttaattcttgttggttttatgagtagtgaacagtggctattagaaatcaggtagaagtaaaaacagcagttttccaacttcttcttctttttcttgagaccaagtttcgcttttgtttcccaggctggagtgcaatggcgtgatctcagctcaccacaacctctgcctcccgggttcaagcgattctcctgcctcagcctcccgagtagctgggattacaggcatgtgccaccatgcctggctcattttgtatttttagtgagatggggtttctccatgttggtcaggctggtctcaaactcctgacctcaggtgatagtccaccttggcatcccaaattgctgggattacaggggtgagcccctgcccccggcctccaattccttgatcatagaatctctttcaaaaaaaatgaggaccccagacagtttttgtttttgtggattataacagtcaataagtcatcctgttagacattaaaacagaaatttaaaacatatttaacaatctatttaaaagtaatggtaacaggccaattacatgttacatacaaaaatgtatgtaatatatttattgtttttatattttatttttattaaatatatatatttttagaataatttatacttttctataaatataaaatacaaataagttatatttatataatttagatgtaaataaaaacaattgatatttttatataaatatataaatgtgtacacttatggggcacagtgtgatgctttgctgtatgtttgcattgtggaataattaaactaatatctatcacccgctatttttcctttgcggtgggaacatttaaaatctcttttagctatttttgttttttatttccataggttattggggaacaggtggtgtttgattccatgagtaagttttttagtggtgatttgtgagattctggtgcacccatcacccaagcagtatacactgcacgcaagacatttaaaatctctattggcgggccgggtgcggtggctcatgcctataatcccagcactttgggaggctgaggcgggtggattgcctgagctcaggagtttgagaccagtctgggcaatacagtggaaccccatctctactaaaatacaaaaaattagctgggtgtggcagtgtgcgcctgtagtcccagctacttgggaggctgaggcaggagaatggtgtgaacctgggaggtggaggttgcagtcagccaagattgcgccactgcactcaagcctgggcaacagggcgagactccgtctcaaaaaaaccaaaaaaacaaaaaaacaaaaacaaaaataaaaacctcttttagctattttgaaatatgtaatacactattaactatcgccaccacgctgtgcagtaggtcactgaaacggattcctcctgtcgaacagaaacttggtaccctttggccatgtgctgtatgttttttaaaagaaaaatgattgtcatttccaaaataacaaaaacctagggagaagagtggctgagttttagggttttgtcagtctcatccataaagggacggatggcggctggctccttcctctgcttcttcacactggtctcttgcgacgtgtcgttctggtaagagtcatgtgaggcacatccactggcctctcatggatgtgcaattggaaacgtgaaatcgccggccccctgagagcgttttggggagtgtcccccccaaacccccctccccccgcactggggatgctgcaccagtcttgaagaatgaggcagtgagaggctggtttacagcaacctttattcgtggccttgtgtgctcggaagcgctgcaagggaggaggaaggaggaaggagggtactcactgcagaaggtcagctctgctgtggctgttacgtgggttcaggtggaacccacctactgtgtggacggttctttacctgggaatcccatggaattctgacagcaggagacgtgggagggagcttcttgtttctccttccaggagtcacttggttaggggtttgggaattttggctcttagtacaaaacttcactccaggtactagacctgtttcagccaaatgatgatcatcataatagaatagaaacctttgttcacctaaataataacaataatattaataataatagaatataaacctttgttcatggtactggggcgtctttcagcccaataataataacaacaataggaataatgataataatgataaaatataaacctttgcttcacgtcctggaacgtctttcagccaaataataataataatattaatgataatagaatataaacctttgttcagggtactgtgacttctttcagcccagtaataataataataatagtaataatgataataatgatagaatataaacctttgcttcatctcctggaacgtctttcagccaaataataacaataataataataatgacaatagaatataaacctttgttcagggtactgtgacctctttcagcccagtaataataataacagtagtaataatgataataatgatagaatataaacctttgctccaggtcctgggagctctttcagccaaataagaataataatagaatataaacctttgttcacagtaccaggacctctttcagaccaacaataatgacagtaataataattataatgataatagaatataaacttttcttctaggtactgggacctctttcaaccaaataataatagtggaatataaaacttggctctaggtaccagaaccttttttcagccaaatagtaataataagaatagtattaatagaaaacagacctttggtccaggtactgggacacctgtgagccaaataataataataatgataataatagaacataaacctttgactgaagtgccagaacctttttcagctaaataataataataaaatataaacttttgttccaggtacccggacttctttcagcctaataataatcatagaatataaacctttactacaggtcctggcacctttctcagccaaatagtaataaaatagaatataaacttttgttctgttactgggacctctttcagcctaataacaaaagtaataataatagaataaaaacctttgctccaggttctagaacctctttcagcctaataataataataatgatagaatgaaaatttttgttccaggtgtcgagacctcttccagcctaataataataataatgtaataatataagcctttgctacaggtaccaggacctgtttcagccaaataataataacagcaatgataatagaatataaaccttggccccaggcactgggacttctttcagtcaaacaatcacaataataataataataatagaatatggatgtttgctccagctttcaggacctctttcagacagataataataaccgagtacaaacttttcttccaggtatcgggacctcttccagcctaaaaacaatagtaataatagcatatatatctttttttttgttttcttctttctttgagacggagttttgcgcttgttgcccaggctacagtgcaatggcgccatctcggctcactgcaacctctgcttcccgggttcaaacgattctcgtgcctcagcctcccgagtagctgggactacaggcatgtgccactaccacgcccggctaattttgtatttttagtagaggaggggtttcaccatgttgtccagggtggtctcaaactcctgacctcagatgatccacccaccttggcctcccaaagtgctgagagtacaggcgtgagccgctgtgcctggtgccagcataaaaatctttgctacaggtactgagacctttttcagcctaataataataacaaccgtaacaataataattagaatataaacctttgttactggtactgggacctcttccagcctaatcttcataataataaaaataataataataatggaattgaaacctttccttcaggttccagaaccgctttcagccacataataataataataatgataataataataataaatagaatttaaacttttgtttgaggactgggacctctttcagcccaatagcacaaataataataatggaatgtaaaccttttcctcccaattaccaaaacctgtttcagccaaataataatatgatgatgatgatgatggaggatctgatacagctgtgtcctgtcactcaggtcggacttaggaggcctcttgagattcttttccccctccgttgactgtgtaatccaggggccccaccctaactcggctgcagaagatgcagtttgggggttcctcgttttgtggaagtcccggtcatgttattcattctctcagcaccttagaacaaaccagggtgctggcattggccacaggacccccctccttgcaccccagtcttgggaagtggcactgctgggctctggcaatgcccagctcacctggcacgtggcggcgtctccctaaaaagcactgggcgggcaccgttgacggaaagccagcaacgcaggccgcgactgcccgtgaagacggggggcctttctaagacctccactcattatttcgggcaaaattaaccttcagaataccttgctttaataaagtaccagaaaccggagggcttaaaaccatagcttattctctcccagttctggaggccagaagtctgtaatcaaagtgtctcagggctgcgctccctccggaggcttacgcggagggtgcttcctgcctctcccagctcctgggggctcctggcgtccctgggcttcaggccagccacatcatcactctagtctctgcctctgtctccatgtggccttctctgtgtctgtgtctcctcttctgtcttttataaggacatctgtcactgcatttagggctcactcaaatcccggatgatctcatctccagatccttaactcatgagatctacaaaatttctaataaccaagtaagatctcattccacatcctgggctttaggctgtggacagatctttctgcgggccactgttcaatccaccatgattttatccagttcattgtggaggctctagaggaggatccttcctgcctctcccagctcctgggggctccaggcgttctgggtttgtggccgcatcactccagtctcggcctctgtctccatgtggtcttctcctgtgtgtccgtgtctcctcatctgtcttctattaaggacactggtcactgcatttaggaccacctcaattgagaataatctcatctaaagatccttaccttcattattaatacatctgcaaagaccctttttccaaacaaggtcccatacacaagtaccaggtggatacagattttctttggtaggggaggacgcttttcaacccactatagtcatcattgaaatatgcctccttgcactgactgtatcccaacactctgaacgtgcctgggtggtgcattttgatatttaccctcctgagcactgtactggacacttggagacacaattacaccttttaacaaagcccagctgtcattttgggcaacccagtcacagaggtggcctcctgagtggcagctggaagggcctgtatgtgtgagcattcaacctcaacaggaaccctggggactggcttctgggtcatctaagcctccacaccgactgcctgatgtttgcacaggtgtgtgatatttgcccagttgggcctttctgcccacaggtgtgactggacacaatgggcattttgagaagttccagggattgagaaatccatgcttcttcagacgtgcttacagatcacggatgcacctgtgacgttccacatggcttcattttaaaccataaagtttgagaagagtgtgcagtgcctcttagccataggaaagctggctttagtcagatggaggtcctgtttggcttctttaatgcagtgaatgaagctcaggtggcattcagagagtcctgctgtgatggttggcagtggggggtctgcctggccacttgtggattcttctatgtaggcttcatccccagaaaagatctacgcagctttcccacgtggcaggtgcttgggaaactcttaggacaggaacaacaagcccctgcgatgacagaggcattgtcaggctgggcgcggtgactcacgcctgtcatcccagcactttgggaggccaaggcgggtggatcacctgaagtcaggagttcgagaccagcctgaccaacatggtgaaaccctgtctctactaaaaatacaaaaattagccaggcgtgatggcaggtgcctgtgatcccagctactgaggaagctgaggcaggaagatcgcttgaacccgggaggcggaggttgcagtgagctgagatcacgccattgcactgcagcctgggtgacagagcgaaactctgtctcaaaaaaaaaaaaaaaaaaaaactaaaggcacttgtcaggtacagccctgcaaaaatgccgtgctcactcgcaaacctgtatgttgacacgtgcggcatcgctgcagtcggattaacgtggaagaaagagcgtattcctgcgctaggttccctcctccactctgcaaaagtgacccgcaaggaaggtccagccgtccggccccagtgccctttggttgaaagcggagctgccccggcaccctgtctgtctccccggcagggctcccgtgcgtgcctgggtcccttctcatgctgtgtttgtcttggcccttctcagcaggtccccacgcatgagcagccgtccagcaggcaggctccggtggagaagcaatggagaataaaagcctggagagctcccagacagacctgaagctggtggcccacccccgcgccaagagcaaggtgtggaagtatttcggcttcgacaccaacgccgagggatgcatcctgcagtggaagaaaatctactgccgcatctgcatggcccagatcgcctactccggaaacacctccaacctgtcctaccacctggagaagaaccaccccgaggaattctgcgagttcgtcaagagcaacacggagcagatgcgtgaagccttcgccaccgccttctccaagctgaagcccgagtcgtcccagcagcccgggcaggacgcgctggccgtcaaggccggccacggctacgacagcaagaagcagcaggagctgacggccgccgtgctgggcctcatctgcgaggggctgtacccagcctccatcgtggacgagcccaccttcaaggtgctgctgaagacggccgacccccggtatgagctgcccagccggaagtacatctctaccaaggccatccctgagaagtacggggccgtccgggaggtgatcctgaaggagctggccgaggccacctggtgtggcatctccaccgacatgtggaggagtgagaatcagaaccgcgcctacgtcacgctggccgcccacttcctgggcctgggcgcccccaactgcctgtccatgggctcccgctgcctgaagaccttcgaggtgcccgaagagaacacggcggagaccatcacgcgagtgctctatgaggtcttcatcgagtggggcatcagcgccaaggtcttcggggccaccaccaactatggcaaggacatcgtgaaggcgtgctccctgctggacgtcgcagtgcacatgccctgcctgggccacaccttcaatgccggcatccagcaggccttccagctcccgaagctgggggcgctgctgtcgcgctgccgcaaactggtggagtacttccagcagtctgccgtggccatgtacatgctctatgagaagcagaagcagcagaacgtggcccactgcatgctggtgagcaaccgcgtctcctggtgggggagcacgctggccatgctgcagcgcctcaaggagcagcagttcgtcatcgccggggtcttggtggaggacagcaacaaccaccacctcatgctggaggccagcgagtgggccaccatcgaggggctggtggagctcctgcagcccttcaagcaggtggccgagatgctgtcggcctccaggtaccccaccatcagcatggtgaagccgctgctgcacatgctcctgaacaccacgctcaacatcaaggagaccgactccaaggagctcagcatggccaaggaggtcatcgccaaggagctttccaagacctaccaggagacgcccgagatcgacatgtttctcaacgtggccaccttcctggacccccgctacaagaggctgcccttcctctccgccttcgagcggcagcaggtggagaatcgcgtggtggaagaggccaagggcctgctggacaaggtcaaagacggcggctaccggccggctgaggacaagatcttcccggtgcccgaggagcctcccgtcaagaagctcatgcggacatccacgccgccgcccgccagcgtcatcaacaacatgctggccgagatcttctgccagacaggcggcgtggaggaccaggaagagtggcatgcccaggtggtggaggagctgagcaacttcaagtcccagaaggtgcttggcctcaacgaagaccccctcaagtggtggtcagaccgcctggccctcttccccctgctgcccaaggtgctgcagaagtactggtgcgtgacggccacgcgcgtcgcccctgagcgtctcttcggatccgccgccaacgtggtcagcgccaagaggaaccggctggctcccgcgcacgtggacgagcaggtgtttctgtatgagaacgcccggagtggggcagaggcggaacccgaggaccaggacgagggggagtggggcctggaccaggagcaggtgttctccttgggggatggcgtcagcggcggtttctttggcattagggacagcagcttcctgtagcgaggaagcgtgttgtcttacaagtcatccccgcagcagcccattggatgctttgctgtaaatacttacccggtcagcttggttttgaacctcagagaccatccactgtctttgacacctagaaggtggaaaaaggaaagagatttgagaagtgagagagggtcgggggcggtggctcctgtctataatcgcagcactttgggaggccgaggtgggcagatcagctgaggtcaggagatcgagaccagcctggccaacatggcgaaaccccgtctctactaaaaatacaaaaattagccaggactgatggcatgtgcctgtaatcccagcttctggaggctgaggccagagaatcgcttgaacctgggaggtggaggttgcagtaagctgagatcgctgcactccagcctgggcgacaagagcgagactctctcaaaaagaaaaaagaagacacaagagaggtggctttgagtgggtttcctttcctcccctattcccggggcccggacgacttctgcttgggaactgccaacgcttctgcttgggaattgcgtgcagcagagcctagaggagctgttccttccttcacagatacttaagacctccaccatgtctgattcgagttctccctgggagggtttagaagaaacgcaggaacattctgggtggcgtcgaaggagcctttcccgatcatcatgtgtgacttctgcgaggtccagatcactgaattcatgtttacattctcgtgcaagcagggacctcttgcttctgagaaatggggaagagaccttttagccaaaatgcccttcttaaaaagagagacctttttttttaatgttcggttaaaaatgtgacagatgagtacaaaaatgcagacacttaacaaaaagcaaacagaaaaaaaagtgtggaatgtgttgtattttcgacaggttgctgccagagagcctgcttcctgctgcctgccgaaatttcactttgcggagttggtccttaaaactgggcggtggccgggcgtggtggctcacgctgaggtcaggagttcgagaccagcctggccaaccaacatggtgaaacctcgtgtctactaaaaatacaagaaactagccagatgcggtggcacccgcctgtaatcccagctactcgggaggctgaggcggaagattcgcttgagcccaggaggtggaggttgcagtgagccaagactacgccactgcactccagcctggaggccagagtgagactccgtctcaaaacaaaacaaaagtgggtggctcacgggtccggaggttatgtcttcggtgtctcagccctaaaagtccagttcccccgtgcggccagcttttccacataaggtgtttttgatttgattaccggaaaggactcttgattcttctcttttaaactgaataccataggggaaatgaattttaaaatattgcccccggaggggttttccgtggctggattcctgcgagttgctttcagtcattcagggaaacagaaagacgttttccaacatgtagaactgctttttaactggaggaaaaatacttcaggaggcttagcatattgcttggattctacgtgcagcgggttctctgcctccgtgaagacaagctgggctggggagaacggtgtctaggagggatgaccccactcagctccaggcagtgttctgccgagaccccaagaactcggggtgtcagagggcaaaggaactacctgcctttcacggctgctgacttctcagggctgcaagcagcacagaatgttatccttacgtcctgagccggtttaagtctgtggaaaaggaagcacgggagaaatccacgtaacctttgctttctttttaagggaagcggttccgccgtgaacttggaaccctcagctccgggtgttctcggcagaagggcagctggaagggacacagtggggcaggctttggggttgctccctgttctgccccgaggccggggacgcagggcagcccacgcctccgtgggctccattctgtagcattgccagcgttctcttcacgtctctaacaatccttcgcttttcctcactcacgtggaaatgtgaactgtcccggctctgtcttcatttttatttttaagccatcgttcccctcctgaacggttgccccttatttaatgctgtaaagttggactgttgttcaataaaccagagcaatgcattagctcctcattcatttgtctgccgcgtgtccgtctggactgcagtttgtctgaaccccttgatcctgggagtggagggaggtttatcattattattatttttatttttgttgtggtccttgttgaaagcaactttttccagggcacccacggtcagttctgtgctcctctttcttgtctgtaaatcctcaagttatgatgtactttcgggtgttttggcatcaaaatttctgagtgaataaagccggcagctggtgaaagtgttccccgggagcagagatttttgccggttccttcacttagtggatagttgtataaacggaggccccatggacgaggcagcctggatggatccggatggcatcagcgccttccctctccccccagcctccttatcacccctctcttcctgtcttcctcacctcctctcacatggtctcttccttccctcctccttccgtccaaccctccctctcttcttcagccaacaaatccttcctttcttccttctttccttccttccttccctcccatccttgtctcttcttctctcccttccttccctcccttcccttctttctttctctcccttccttccttctctcccttccttccttctctcccttccttccttctctcccttctctcccttttctcccttccttccttctctcccttccttccctcccttctctcccttttctcccttccttctctccgttccctccctcccctccctctctgcctccctttcctcccctccctccttcccccatccctccctccctccttccctctcctccctccctccttccttccctctgtccctccctgtctccctcccttcctccttccttcctttcctccctccctctgtccctccctcccttttctccctccctcccttcctctttcgttttccttccatccctttttccttcctccctccctcttttcctccctcctgagaaaacaatggcccccaagaaacacaggaaggccgggatgtgcacctctgcccagacttgccctttccaagtgctgttggttgactgcctgtccttgggcatcattaaaatgccgaaatttctctttcttgcacgttttgggttgaaaggggttcattttcagtcctcataactaagcatttgcatcgtgatgttcatttaagtgggacatgtttacacgtttttcccattaggagtaattctagtccttgagggtttcttacagagacatttccctaaccccgacggttctcatcccagcctgtgtggcactccttccgcacagtggtgggatttttcggttcggttttgttttcacgcttgcatctggctgcacagccctaactctgagctggttgtttttgtttcccccccactttgcagaattgcctgcttcgaactgttttcccagcaggcctctgaagggtgaggaaaacagcttggggaaagtgagaaaaaggtttcggatgttttagtaaagaggcagctggtgggaaggagccggttgggctgtttctggggtgccgaaatctcggtggtgacgttcatttgctcgtgagtgcagaggaggcccagagaccgggttcctggcgcagccagctcctgcttttgttccgaccatcttcctgcgccttctgcgagtctcagatgtgcttgggcagcagttctactgttttcccctctgtgatctcaggcccgccgccccgtcctttcccagtgatttctgctccgtcaaatcgtggggctcacctgagagttttataaaatgaactcgccatgcccctgcctggtgaacagagaatgcaaactctcacaggaccgtctgcagcaaaacggcagtgttttgctcatttcttcagacgacgaaaacagcagggtttggctcgtttcttccagattttctcaaactgcatgagttcctttctgagcaacttctgggaagctttcgggtttcagggctttgcagccaggctccttcctagctgcggctgcctgtccttttgtgttgcagtcagatgcgggaggtccttggcatgagtaccctgatggtgtcaactttaaggggtcagagaggaaatatttttggctccgcggaccatgcattctctgtctctcaacaacttagttttgccgttgtgtctaaaagcatccattgctgggtgtggtggctcacatctgtcatcccagcactttgggaggccgaggcgggtggatcgcctgaggtcaggagttcaagaccagcctggccaacatggtgaaaccccatctctactaaaaatacaaacattagctgggcatggtggtgggcacctgtaatcccaggtactgaggctgaggcaggagaatcgcgtgaaccagggaggcggaggttgtagtgagctaagatcgtgccactgcgctccatcctgggcgacaagagcgagactccgtgtattccactcccacttcgtgggcactaaattttatataaatgttgtgtcaagaaatattattgctctgttgacttctttttttcccccaaccattaagaaattcagaaaaaaaatgtacgaatgtaaacactgttcttggtgagtgggccttccaaaaataaccgctggactttgttgaaactacttttttttttttttttttttgccactttttcccttttttttctcgaggcaccaattggaatccacttatttgtcctggtttgagaaacagctcagatcgcacactctgggctctgtgtttctttaggtaacacacgtgaggtttttgtcactggaattcagtaatctgtgttaatattatcacaaaagaaccggggggcatttgtgtcttctcagaattgctgattaaaacagctgcatggccaggtgcagtggctctcatgcctgtgatcccagcactttgggaggccgaggcaggcggatcgcttgagcccaggagtttgagaccagcctgggcaacatggccaaacctcatccctactaaaaatacaaaaaattagccaggcatggaggcgcatgtctgtagtcagtcccagctactcaggaggcgaaggtgggaggatcacttgagcttgggagttggaggctgcagtgagctgtgaacataccactgcactccagcctggaaaataaagcaagagatgctgcctctaaaaataataataataataataaaaattagccaaacatggtggcacgcatgtgtgatcacagctacttgggagactgaggtgggaggatcgctggagcccggaaagtcgaggctgcagtgagctgagattgcatcactgtcgtgcagcctgggcaaaagagtgagaccctgtctctaaataaataaataaatgagttcacgattaagcagaagttgtgcttgttctgccaggatttcagttgggttctttgtgccctaatttacgtgagctagtaggttgtgcgttatcttagagggcttgcatgaaagaaagagggtagcctttcttttccctgttttggtagcattgctgaggtggcttttggctgacgggtggacccgtgggtgcagatgttttgatgcagaaggaatgattgccttttcacattcaggctccaactggcttttagcttgtgcgttcttaccctggggtgttcgaggtcaccggactcctattttatttgtgtttaactggaaaggcaggaactctgagaacgtatcaaataggcagttactgcaggatttctagaatttaaattgcttccaaaactgtatccacaagctaagaattatgtttaggttttaaaaggtgttggtttgcttcttacatgtttaaattcttgagggaaagaaatgcaaagaataataaagtttcatgatacaaaaatggtatgagaccgggcacaatggctcacacctgtcatcccagcactttgggaggctgaggcaggaggatgatttttgagcctgagtttgagatcagcctgggcaaacagcgagatcctgtgcctacaaaaataaaataaaaataggctgggtgtggtggctcatgcttgtaatacctgcactttgggaggctaagtcagtaggatcacttgaactcaggggtttgagaccagcctggtcaacatactgagaccttgtctctagtaacaataaaaaaattagctggacataaggtgtgcatttgtagtcccagttacacaggaggctgaggtgggaggatcacttgagccagggagttggaggctgcagtgaaatgtgatcgcaccactgcactccagcctgtgcaacaaggagagagatgctgtctctaaaaaaaaaaaaaaagccagacgtggtggcacacgtgtgtggtcacagctacttgggaggctgaggctgaaggatcgcttgagcccaaggaggctgaggctgccataaactacgatcatgccactgcactccaggctgggcaatagcctgggcgactgtctcaaccaaaataaatttaaaaagataggaaatttcaatgtgaaaatcagtgtcccccagaacgttccatttcttcccagctgggctatttttggagttccatggggagccggctcagtgcagtttgcatgtactcgggaggatgagccctgccatggtgtgtgttaggggacagcctgatctcaccaaccctcctgagcaggcccagccctccgagtaataactgggaacactcgccgctttgtgagacgacctcgtgtgctcactggaaggtcatctcttctggtccatgctgcagtgtggataccattttttttttttaagacagtttcactcttgttgcccaggctggagtgcaatggcacgatctcggctcacagaaacctccgcctcctgggttcaagccattctcctgtctcagcctcctgagtagctgggattacaggtgtctgccaccacagccagctaatttttatatttttcgtagagacggggtttcagtacattggtaaagctggtctggaactcctgacctcaggtgatccacccgcctcagcctcccaaagtgctgggatgacaggcgtgagccaccgcgaccagcccagtgtggatacaccttgagcacataactggaatcctttccttggaaacttggagccccttgtgtcatggtcatataaactgttgaattaagaggagacaccattaaatatgtcacagctgtcctcgaaactgggacttgttttgctttctgcctggaaatgcgagctatctttatagaattattttatagaaaataattgtatacatatataggaggtacgacgtgatgttttaatccgagtacacattgtgcaatgattaaatcaagctggttaccatattattaacctaattaacatatcaataatcaagctaattaacacattaacattcaagctaattaacatattaacaagctaattaacatattcacataatcctaactctgacctatatcacctcacctacttttttttgtggtgagaatgtgtaaaatctacttttagtcattttgaaaaacgcaatgtattattattaatgataatcactgtgtggtgtggtagaactttgaatttatttcttctatctaactggaaaaatttaattttaatgtaatttattttttttgagacagtctcaccctatcacccaggctggagtgcagcatcatgttcatagctcatggcagcctccaactcctggctcaggtgaccctcccaccacagcctcccaggtagctgggactacaggtgcacaccaccacacctggttaattttttaagttttttgcagagatggggtcttgctatgttgctcaggctggtcttgaattcctgggctgaagcgatcctcctgcctcagcctcccaagtagctgggactgcaggtgcatgctaccatacccagctaatttttttttttttttttaaagatgcggtttcattatgttgcccaggcttgtctcaaactcttggcctccagtgatcctccttcctcagccttccatagcattgtgattccagacatgagccaccgctcctggcctccaactgaaattttatgttctttgacaaacacttcatgaagcattcttccctggcaaccaccattgcactctctgcgtttatgcgttcagcttttttagattctacatacgagatgatacagtatttgtctctctgtgcctggttcatttcacttcacattgtatcttccagtcccatccatgttgctgcaaatggcaggatttcctttttcatggctgcatactattccattgtgtgtctatgccacatttgcttgatacgctcatctgttgattgacacatgggttgattctatatcttggaaactgttagtagtgttggcagtgcacagggggtgcaggtatcccattgatgggctgatttcctttcctttgggcacacaccaagcggtgggatgactggatcctgcacaacattctttcctttggtgtttcgcaggcccgtttctggactttagtgaacgtcttcccagtgtccatggcgtccgtcccttggccacatgcttagggaacatcttcagtgtgtacatggcgacagtcccatagccacattcttagggaatgtcttcagtgtgtacacggtggcagtccctttgctgcatgcttagggaacgtctacagtgtggtccattggccacattcttagagaacgtcttcagtgtgtacactgtggcggtcccttggccacattcttagggaatgtcttcagtgtgtacatggcggcagtcccttagccacatgcttagcgaacatcttcagtgtgcacagggcagtggtcccttgggccacatgcttagggaacgtcttaagtgccgtcccttggccgttttcttagggaatgtcttcagtgtgcacatgtggcggtcccctggtcgcattcttacggaatgtcttcagtgcgtacacggtggtcccgtagccacatgcttagggaatgtcttcagtgtgcacagggccatattcttacggaatgtcgtcagtgtgcacatggtggtggtcccttggccacattcttagggaatgtcttcagtgtgtacgtggcggaggtcccttagccacaagcttagggatcatcttcagtgtgcacagtgcgggagtcccttgggccacatgcttagggaatgtcttcagtgtgtacatggtggtggtcccttagccacatgcttagggatcatcttcagtgtgcacagggtgggagtcccttgggccacatgcttagggaacgtcttcagtgtgtacagggcagcagtcctttggctgcattgttagcgaacatcttcagtatgtacatggctgtggtcccttagccacaagcttagggaacatcttcagtgtgcacacggtggtggtcccttgggctacatgcttagggaatgacttcagtgtgtacatggtggccatcccttggccccatgcctagggaatgtcttcagtgccttgccttggctgcattcttagggaacgtcttcagtgcgtacatggcggtggtcccttagccacatacttagggaacgtcttcagtgtgtacaccgtggtggtcccttggccacattcttagggagcgtcttcacttcttacatggtggtggtccccgggccacattctaagggaacgtcgtcagtgcctacacaatggtggtcccttggccgcacgcttggggaacgtcttcagtcacagccctggttggtcccttggccacattcttagggaatatcttcagtgcatacacggtggcagtcccctggtgtcattcttagggaacgtcttcagtgcggtccctcaaccacatgcttagggaatgtcttcagtgctgtttcttagccatattcttagggaacctcttcaatgtgtacacactggtggtcccttggccgcatgcttagagaacatctttagtgcagtcccttggccacattcttagggaacgtcttcagtgtgatcccttggccacattcttagaaaacgtcttcagtttgtacaaggtgacagtccattggccagaatgtgtccctgccacattcttctgagtgtctgtgtctgtgttctttccaccctgtaagctgcttttgcttcttcactgggtgtctgtgactctcatgtggaatccctttcctctgtcaccgcccatcccaggcacagtgagagacgcagccagcctgctcctctctgcacctcgccatcccagacatcctccagccaccgtgctgaccgcattcattccttctcctgccctgtccgcatccttcttcccctacacgtttgataccaagaaatggtctgaatcacagccaaggcttcatttgctttctggaactgcagctccccagccccacccagatcagagattcagaacctgaatcttcggatttctggagatgcccccatcctatcagagacttctagtgtgtttctttatatccgtgtagacttgggaggatgacaggagagaaaccttagaaggtggtctgtgcatttcccgggcccggggtggaaggggcttgtgtcctggctgcctctgtgcacctttcattcttttttttttttttgagacggagtcttgctctgtcaccctgtcacccaggctggagtgcagtggagggatctcggctcactgtaacccctgcctcccaggttcgagcaattctcctgcctcagtctcctgagtagctgggaatacaggcatgtgccaccacgctcggctaattttatatttttagtagagatgggtgttcttcatgttggtcatgttggtctcgaactcctgacctcaggtgatccatccgcctcggcctcccaaagtgttgagatgacaggtgtgagcccccgcgcctggccgcacctttctttcttgatccacctggttttaaactcacagataaactgtttccacctgtgacaaatgagtcatccaccttccatgtggtctggactttgtccctgttacaatattcctgtctcttgtttctggttttttgcatcccacatgttgtccctgtaacagtcctgtctgttgtttctggggtcacccgtgtggcgagctgactgtgccacgttcctgaggctggtgaggatgctgtgggcaccttaatcacggctgtgaacaaactggctagagctaggtgccatggagctttgcagtggacactaagtcgtggtacccattctttgatcagtgacggagccaggtgtcttattaggtcttggggatttgtggaagcccagagcagggaaacagcttctacattgaaaggaatccttctcacactcatgttggcatcgtgaagtccctgatttcctaagacactaccctaatattttaaaagacttacaaaaaatttagtaaaatattcctaatagcagcacatgtggtgtttttttgtttgtttgtttgttttcgagatggagttttgctactgttgccaaggctggagtgcagtggtatgatctcggctcactgcagcctccgtctcccaggttcaagggattctcctgcctcagcctctcaagtagctgggattacaggcatgcactaccacacccggctaattttgtatttttagtagagacgggtttttccatgttggccaggctggtcttgaactcccgacctcaggtaatccgcctgctttggcctcccaaaatgctgggattacaggtgtgagtctccacacctggtcaatcccattctttttcaagaatgcatagtattctgtggtgtatgtacaccaccttttctttatccagtctacgtggcgttgttttgaggaatggatgaaatgatttgcataaaaacagtgaatgctttctattggaatggtgtttgcctcctgggaaactgtggagtcattgcaattgcaatttcctagtagatttgattaattaagagcattgggaatttttggggtgcctgatgcactattacagatatttttttcacagtgtagatatctcagcatgaatatgtctgttttcttttcttttctttcttttttttttttttgagatggagtttctctcttgttgccaaggctggagtgcaatggctcaatcttggctcactgcagccaacatctcctgggcttaagcagttctcctgcgttagcctctggagtagctgggattacaggcatctgccaccatgcctggctaatttttttttgtgtgtgtgtttttagtagagacagggtttcaccatgttggcctggccggtctcaaactcctggcctcaagtgatccacctgccttggactccgaaagtgctgggatgacaggcctgagccatggcggccagctgtctgttttctttccataagaggtgctggtctcaccgtggctctgtgctgtgatgaaatggcattgtccaagttttactcctcacagcctgattttgtatgttaaagacgtcttccttggtgtgaatcaagtgggctgggcagagttaagggagccatttatttagaaggcgattagatcgaattatgtcttggtaattactgcagttacaccaccccattctttccgtggctctcctagctgggtttgtggctagtcatggaggtgccctgaagagcctcattttcccacagctgtaggaagtgtgtggtacacccacaatgtcttagcttttgtattagggaaggtcttcagtgcattcccttggccacattcttagggaacatcttcagtgtgtacatggcggcggtcccttaaccacattcttagggaacgtgttcagtgtgtacacggtggcagtcccttggctgtatgcttagggaacgtcttcagtgagtgtgatcccttggccacatgcctagggaacatcttcattgtgtacctggcggcggtcccttagccacatgcttagggaatgtcttcagtgtgtacacggtggcagtctgttggccccatggttagggaacatcttcagtgtgcacagggcggcggtcccttgtgccacatgcttagggactgtcttcagtgtgtacatggtggcggtcccttggtcgcattcttagggaacctcttcagtgtgtacatgtcggcattcccttagccgcatgcttagggaacgtcttcattgtgttcttggtggcagtcccttagccacatgcttagggaacgtcttcagttgtatacagtggggtcccttggtcattatgcctaggggaacgtcttcagtgccagctgcattcttagggaatgtcttcagtgtgcacatggcggaggtcccttagccacatacttagggagtgtcttcactgcacacagcagtggtcccttggttgcattcttagggaacatcttcagtgtgcacatggtagcagtccctcacccacattcctagggaatgtcttcagtgtatacatggtggcagttctttggctgcatgcttagggaacatcttcagtgcattcccttggccacatgcctagggaacatctttagtgctgtcccttccctgcatttttagggaacgtcttcagtgtgtacatggtggcggtcccttggccgcattcttagggaacgtcttaagtgtgtacatggcggcggtcccttagccacaagcttagggaacgtcttcagtgtgtatatggtggcagtctcttggccacatgcttagggaacgtcttcagtgccatcttttagctgcattcttagggaacgtcttcagtgtgtacatggcagaggtcccttagccacacacttagggaacatcttcagtgtgtgcacagcagtggtcccttggcctcattgttagggaacgtctttggtgtgtagatggccgccgtcccttagccacaagcttagggatcgtcttcagtatgcacagcgtggcagtcccttgggccacatgcttaaggaatggcttcagtgtgtacaccgttgtggtcccttggccacattcttagggagcgtcttcagtgccgtcttttggctgcattcttagggaatgtcttcagtgcgtacatgggggcggtcccttagccacatacttagggaacgtcttcagtgtgtacatggcagtggtcccttggccccattcttagggaacatcttcagtgtgtacatggtggcagtcccttaatcacatgcttagggattgtcttgattgtgtacatggcgatggtcccttggccacatgctttgggaacctcttcagtgcatacggagtggcagtcccttgtccacattcttagaaaacgtcttcagttcgtacacggtggcgatcccttggccacattcttctgagtgtctgtgtctgtgtcctttccaccctgtaagctgcttttgtttcttcattgggtgtctctgactctcatgtggaatccctttcctctgtcaccgcccatcccaggcacagtgagagacgcagccagcctgctcctctctgcacctcgccatcccagacatcctccagccaccgtgctgaccgcattcattccttctcctgccctgtccgcatccttcttcccctacacgcttgataccaagaaatggtctgaatcacagccaaggcttcattatctttctggcactgcagctccccagccccacccagatcagagattcagaacctgaatctttggatttctggagatgcccccatcctatcagagacttctagtgtgtttctctatattcgtgtagacttgggaggatgacaggagagaaaccttagaaggtggtctgtgcatttccggggcccggggtggaaggggcttgtgtcctggctgcctctgtgcacctttcattcttttttttttttttgagacggagtcttgctctgtcaccctgtcacccaggctggagtgcagtggagggatctcggctcactgtaacccctgcctcccaggttcgagcaattctcctgcctcagtctcctgagtagctgggaatacaggcatgtgccaccacgcccggctaattttatatttttagtagagatgggttttcttcatgttggtcatgctggtctcgaactcctgacttcaggtgatccatccgcctcggcctcccaaaatgttaggatgacaggcgtgagcccccgcgcctggcggcgcctttcattcttgatccacctggtttcaaactcgcagataaactgtttccacctgtgacaaatgagtcatccaccttccgtgtggtctggactttgtccctgttacaatattcctgtctcttgtttctggtttttggcgtcccacgtgttgtccctgtaacagtcctgtctcttgtttctggggtcacccctgtggcgagctgactgtgccacgttcctgaggctggtgaggatgctgtgggcaccttaatcacggctgtgaacaaactggctagagctaggtgccatggagctttgcagtggacagtaagttgtggtacccattctttgatcagtgacggagccaggtgccttattaagtctcggggatttctggaagcacagagcaggcaagcaccttctacactgaaaggaatccttctcacactcatgttggcaacgtgaagtcctgcctttggaaatccctgatttcctaagacactaccctaacattttaaaggacttaaaaaaaattcagtaaaatattcccaatagcagcacatgtagtgttttatttatttatttatttttgagatgatttgcactcttgtcgcccaggctggagtgcaatggtatgatctgggttcactgcaacctccgtctcccgggttccaaggattctcccatctcagcctgtaaggtagctgagattataggcatgcgccaccatgctcggctgattttgtatttttagtagtgacagggtttcaccatattggtcagggtggtctcgaactcctggcctcaagtgatccacccatcttggcctcccaaagtgctgggattatgaatcactgctcctggcctactttttaaactttcaggttcaggggcacgtgtgcaggttcattacacgggtaaattgcatgtcctgggggtttagtgtacagattaattcatcaaccaggtagtaagcctactaccatctgataggtagttttttgatcctctcatttgtcccaccctccaccctccagcaggcccctgcagctgttcccttctttatatccaccagtgcccaatgtttagctgtcacttatcagtgggaacaggtggtatttggttttctgttcctgtgtaagtttgctaaggataatggcctccacctccgtgcatgttcctgcaaaggacatcatcccattttttttttttttttgagacagtttcctttttgttgcccaggctggagtgcaatggtgtgatctcggctcaccgctaccaccagctcccgggttcaagcagttgtcctgcctcagccttctgagtaactgagattacagacacatgccaccacgcccggctaattttgtatttttagtagagacggggtttctccatgttgcccaggctggttttgaactcctgacctcagttaatctgccctccacggcctcccaaagtgctgagattataggtgtgagccaccacacccaaccaatcccattctttttcatgggtatgtagtattccatagtgtatatgcaccaccctttgtttatccagtttacatggcgttgttttgagaaatggatgaagcgatgtgcatgaaaacactgaatgcttcctactggaggggtgttcacctttccgggaaactgtggagtgattgcaattgcaatttcctagtagatttgattggttaatagcattgggaatctttggggtgcctgatgccctattgcagatcttttttcacagtgtagaaatctcaacgtaaatgtctttttttttttttgagatggagttttgctcttgttgcccaggctgcagtgcaatggctcaatctcggctcactgcagccaacatctcccgggtttgagcaattctgcctcagtctcctgagtagctgggattgcaggtgcctgccaccacacccggctaatttttgaatttttagtagagaaggggtttcagcctattgttcaggctgctctcgaactcgtgacctcaggtgatccacccacctcggcctcccaaagcgctgggatgacaggcgtgaccgcgcccagcccagtgtggatacaccttgagcacataactggaatcctttccttggcaacttggagccccttgggtcatggtcatataaagggtgttgaattaagaggaaacactgttaaatatgtcacagctgtccttgaaactgggacttgttttgttttctgcctggaaatgcgagtcatttttctggaaaattcatttttcgttaaaaaaagtaattgtatacacgtatatgaggtacaacgtgatgttttaatccacgtacacatcatgcaatgattaaatcaagctagttaccatattaacaatcacattaactaacatattaataatcaggctaattaacatattaacattgaagctaattaacatattaacaatcaagctaatttacatattcacataattctaactctaacctatatcacctcacctacttttttttgtagtgagaatatgtaaaatctacttttagtcattttgaaagacgtgatgtattattaactatcatcactgtgtggtgtgatagaacttggaattcatttgttttatctaactgaaaaaaattaattttaatgtaatttatatgttttttgagacagtctcatcctatagccaggctggagtacagcatcatgttcatagctctcagcagcctccaactcatggctcaggtgaccctcccacctcagcctcccaggtagctgggactacaggtgcacaccaccacacctggttaatttttaaattttttgtagagatggggtcttgctatgttgctcaggctggtcttgaattcctgggctaaagcgatcctcctgcctcagcctcccaagtagctgggactacaggtgcatgccaccatatccagttaattttttcagttttttttttatttgtttagagatagggtttcattacgttacccaggcttgtctcaaactcctggcctccagtgatcctccttcctcagccttccatagcacagtgattccagacatgagccacagcgctcctggcctccaactgaaatgttatgttctttgacaaacacttcagcattcttccctggcaaccaccattgcactctctgcgtttatgcgttcagcttttttagattctacatacgagatgatacagtatttgtctctctgtgcctggttcatttcacttcacattgtatcttccagtcccatccatgttgcgcaaatggcaggatttcctttttcatggctgcatactattccactgtgtgtctatgccacatttgcttgatgtactcatctgttgattgacacatgggttgattgtatatcttggaacctgagtagtgctgcagggcacaggggatgcaggtatcccattgatgggctgatttcctttcctttgggtacacacccagtggtgggatgtctggatcctgcacaccattctttcctctgatgttttgcaggcctatggctggacctttggaacgtcttcactatgtacaaggtggcggtcccttggccacattcttagggaacgttttcagtgtgtacatggtgtcggtcccttggctatatgcttagggaacatcttcagtgggtacatggtggcggtcccttagtcatattcttagtgaatgtcttccgtgtgtacacggtggcagtcccttggctgcatccttaggcaacgtcatcagtgcagtcccttggccacatgcttagggaacgtcttcagtgcatacacggtggcggtcccttggccacattcttagggaatgtcttcagtgtgtacatggtcgcagtctgttagccacatgcttagggagcgtcttcagtgtgtatagggtggcggtcccttggccacatgcctagggagtgtcttcagtgccgtcgcttggctgcattctttgggaacgtcttcaatgtatacatggcggcggtcccttggctgcatttttagggaacgtcttcagtgtgtacatggcggcggtcccttatccacattcttagggaatgtcttcagcgtgtacacggtggcagtcccttggccgcatgcttaggggacttcttcagtgcggtcccttggccacatgcctagggaacgagtcttcagtgccgtcccttggctgcattcttagggaacgtcttcggtgtgtacatggtggtggtcccttgggcgcattgttagggaacgtcttcagtgtgtacatggcagtggtcccttagccacatgcttcggaatgccttcagtgtgtacatggcggaggcccctcagccacgtgcctagggaatgtcttcagtgctgtcttttagcggcattcttagggaacgtcttcagtgtgtacatggtggtggtccctgagccacatacttagggaacgtcttcagtgtgcaacggcagcggtcacttggccttattgctagggaacttcttcagtgtgtacatggcggtggtcccttagccacaagcttagggaacgtcttcagtgtgtacatggcagcagtcctttggaccacatgcttagggaatgtcttcagtgtgtacacggtggtggtcccttggccccatccctagggaaagtcttcagtgccgtcctttggctgcattctttgggagcgtcttcagtgtgtacatggtggaggtcccttggccacattcttagggaatgtcttcagtgtgtacatggcggcggtcccttggccgcatacttagggaacgtcttcagtgtgtacatggcagtagtcccgtggccgcattcttagggaacctcttcagtgcatacacagtggcggtcccttggccacattcttctgagtgtccgtgtctgtgtacttttcatcctgtaaactgcttttgtttcttcattgggtgtctctgactcttatgtggtatccgtttcctctgtcagcgaccatcccaggcacagtgagagacgcagccagcctgctcctctctgcaagtggccatctcagacattctccagccagcgtcctgaccgcattcattccttcccctgcccggtccacatccttcttcccctacacccttgctaccaagaaatggtctgaatcacatcacaggcttcctttgctttctggaactgcagctccccagcccacccagatcagaggttcagaacctgaatcttcggatttctggagatgcccccatcgcatcagagacttctagtgtgattctttatattcgtgtagacttgggaggatgacaggagagaaaccttagaaggtggcctgtgcagttccagggcccagggtggaaggggcttccatccctggctgcatttgtgcacctttcattcttggtccaacattttttttttttttttttgagacggagttttactgtgtcgcccaggctggagtgcagtggtgtgatctcagctccctgcaacctccccgcctcctgggttcaagcgattctcctgagtggctgggagtacgggcatgcaccaccatgcctggctaattttatatttttagtagagatgaggtttctccatgttggtcaggctggtctcaaacccctgacctcaggtgatccatccaccttggcctcccaaagtgctgggattacaggtgtgagccaccacgtccggctgcactttttattcttgatccacctggtttgcaactcacagataaactgtttccacctatgacacatgagtcttccaccttccatgtcctctggactttgtccctgttataatattcctgtctcttgttctggtttttggcatctcacacattgtccctgtttcagtccggtctcctgtttctggtgtttggtgtgccgcacgttgtccctgttacagtcctgtctcttgtttctggggtcacccgtgtggagagctgactgtgccgcgttcctgaggctggtgaggatgctgtgggcaccttaatcacggctgtgaacaaactgactagagctaactgccacggagctttgcagtggacgctaagctgttgtactcattgtttgatcagtgacggagccagatgtcttattaggtctcggggatttgtggaagcctagagcaggcatgcaccttctacgtagaaaggaatccttctcacactcaagttggcgtcgtgaagtcctgcctttggaaatccctgatttcctaagacactaccctaacattttaaagggcttaaaaaatttcaataaaatgttcccagtagctgttacatgtagtcatgtagcgtttttttttttttttttgagatggacttttgctcttgtctcccaggctggagtgcaatggcgcgatctcggctcactgcaatctctgtctcccgcattcaagggattctcccacctcagcctgtcaggtagctaggattataggtgtgcgctaccatgccctgctacttttgtatttttagtagtgacagggtttcagcatgttgatcagggtagtctggaactccttgcctcaggtgatccacccgccttggcctcccaaagggctgggattatgaatcaccgcccccagcctacttttttcactttgatttcaggttgagggggacgtgcgcaggtaaattgcatgtcttgggggcttagtgaacagattatttcatcatgcaggtaataagtccagtaccacctgataggtagtttttcgatcctctcatttctcccaccctccaccctccagcatgcccctgcagctgttcccttctttgtatccatgagtacccaatgtttagctgccgtttatgagtgagaacaggtgatatttggttttcttttcctacgtgagtttgctaaggataatggcctccacctccatgcatgttcctgcaaagggcatcatcccatgttttctttttttctttttcttttgagactgggtttccttcttgttgcccaggctggagtgcagtggtgtgatctcagctcaccacaacctcctgttcctgggttcaagtgattctcctgcctcaggctactgagtcgttgagattacaggcgcataccaccacgctgggctaattttgtatttttagtagagacggggcttctccatgttggccagtctggtcttgagctaccgacctcaggtaatctgcctgcctcggcctcccaaagtgctgggattacaggcatgcgccgccacgcccaaccaatcccattctttttcatgggtccatagtattccatagtgtatatgctccaccctttctttatccagtctacatggcgtcctgttgaggaatggatgtaacaggcgtcgtgttcaggaatggatgtaacaatgtgcataaaagcagtgaatgttttctattggaatggcgtttgcctttctgggaaactgtggagtcattcgaattgcaatttcctggtagatttgattagctaagagcattgggaatttttggggtgcgtgatgccctgttgcagatattttttcacagtgtagaaatctcagcatgaatatgtctgttttcttttctctttttttttttttttttgcgatggagttttgctcttgttgcccaggctagagtgcaatggctgaatctgggctcactgcagccatcatctcctgggttcaagcaattctcctgcctcagcctctggagtagctgggattgtaagtgcctgcccctacaccctgatttttctttttttttgtatttttagtagagacggggtttcacctgttgggcaggctggtttcgaactcctggcctcaagtgatccacctgcctcagcctcccaaagtgctcggatgacaggtgtcagccacggtgcctggccgtctgttttcttttcataagaggtgctggactcacagtggctctgtgctgtgatgaaatgacattgccaaagttttactcctcacagcttgattttgtatgctaaacaggtcttctttggcgtgattgaggagggatggggagacttaagggagccatgtatttagaaagcgattagatcctgttatgtcttggtaattactgcagttacaacacgccattctttccgtggctcacctagctgggttcgtggctagtcatggaggcgccctgaagagcctcattttcccacagctgtaggaagtgtgtggtacacccacaatgtcttagcttttgtattagggaacgtcttcagtttgttcccttggccacatgctttgggaatgtcttcagtgtgtacacggtggctgtccctgggccgcatgcttagggaacgtcttcagtgaggtcccttggccatatgcctagggaacgtcttcggtgccatcctgtgactgcattcttagggaacgtcttcagtgtgtacatggcgggggtcccttagccccattcttagggaatgtcttaagtatttacacagtggcagtctgttggcctatggttagggaacatcttcattgtgcacatggtatcagtcccttgcgccacatgcttagggaattcttcagtgtgtacatggtggccgttccttggctgcattgttacagaacgtcttcagtgtgtacatgtcagcggtcccttagccgtaagcttagggaacgtcttcagtgtgtataaggtggcggtcccttggccacatgcctagggaacgtcttcagtgccctcccttggctgcattcttagggaacgtcttcagtgtgtacatggctgccttcccttagccacatacttagggaacatcttcagtgtgcacacggcagctgtcccctggacgcattcttagggagcgtcttcagtgcgaacatggcgggggtcccttacccacattcttagggaacatcttcagtgtgcacacggcagcagtcccctggacgcattcttagggagcgtcttcagtgcgaacatggcggcggtcccttacccacattcttagggaacatcttcagtgtgtatatggtagcagtcccttagccacacacttagggaacgtcttcagtgtgtgcacatcagcggcccttggccggattgctagggaacctcttcagtgtgtacatggcagcggtcccttaacccaagcttagggatcgtcttcaatgtgcaaagggcaatggtcccttgggccacgtgcttagggaatgtcttaagtgtgtacacggcggtcccttagccacatgcctaggaaacgtctgccatctcttcgctgcattcttagggagcgtcttcagtgcgtacatggcggccgtcccttagccacgtacttagggaacatcttcagtgtgtacatggcggtggtcccttagccacatacttagggaacgtctccagtgtgtacaggtggccgtctcttagccatattcttagcgaatgtcttcagtgtgtacacagcagtggtcctttggccacatgctttccgaacgtcttcagtgcatacagtggcagtcccttggacccattcttagaaaacgtcttcagttcgtactcggtggcgatcccttggccacattcttctgcgtgtctgtgtctgtgtccttttcaccctgtaagctgcttttttttcttcattgggtgtctctgactctcatgtggaatccctttcctctgtcaccgcctgtcccaggcacagtgagagacgcagccagcctgctcctctctgcacgtcaccatcccagacattctccagccagcgtcctgaccgcattcattccttctctttcccttgtccacatccttcttcccctacacgcttgataccaagaaatggtctgaatcacagccaaggcttcctttgctttctggaattgcagctccccacccccacccagatcagaggttgagaacctgaatcttcggatttctggagatgcccccatcgcatcagagacctctagtgtgtttctttatatccgtgtagacttgggaggatgacaggagagcaaccttagaaggtggcctgtgcagttccagagcccagggtggaaggggcttccattcatcactgccttcgtgcacctttcattcttgatccaaccgttgttgttgttgttttgagacggagtcttgctgtgtcgcccaggccggagtgcagtggtgtgatctcaggtcactgcaacctccgcctcccatgttcaagcgattctcctgccacagcctctctgagtagggagctgctaaaataaaataccttcagttgggtaatttataaactagagacatttatcactcacagttctgaaggctggaggttcaagatcatggcagattcagtgtgtggtggggatgcactccctggttcatagacgacgcattttctctgcctgctcacatggtggaaagggcgagggagctctctggggctccttttataaggacagtgatcctattcatgaggcttgatccccatgaagtcatcacctcccaagtctcccacctcctgacaccattgtcttaggggtgaggatttcaatgcaggaatttgggggaggaacacaaactttcagattgtagcaaataccattctttaaaaaaatgcagtaatagttaagctttttttttttaatttgataaattttccaagaaggaggagacacagaaaccctccgtgttttgaaggttaatattagtgctgtaaaatacacgtgggacttgggcttataaaaaattcctggtcatggcaaaatataggtggtttgcagtacctggggaagcccacctttcctgtttctgacatgtaacttttgtggaaattgcctgaaagttgtttctagttacccttcagtcctgtgtccaacccagcatgtccgatactatctaacattgttttttttttgagatggagttttgctcttgttgcccaggctgcagtacagtggcacgatcttggctcgctgcaacctccacctcccaggttcaagcgattctcctgtctcagcctcctgagtagctgggattactaaattttatataaatgttgtgtcaagaaatattattgctcttttgcctttttttcccttaaccgttgagaaattcagaaaaaaacatttatgaacgtcaacactgtttttgacaagtaaacattgttcttggcaagtgggccttccaaaaataagggctggcgtttgtggaaactgctctactgttctttttttttcttgctacttttttctttttttttttttttgaggcactaattggaatccacttattcgtcctgggtggagaaagagttcagatctaacactgggggctctgtgtttccttaggtaatacatatgaagtttttgtcactgtaattcagtaatctgtgttaatattatcacaaaagagcagagtggcatttgtgtcttctcagaattgcttattaaaacagctgcatggccagccgcggtggctctcatgcctgtgatcccagcactttgggaggccgaggccggtggatcgcttgagcccaggagtttgagaccagcctgggtaacatggccaaacctcatctctactaaaaatacaaaaagtgagagcgtgcctgtagtcccagctactgaggaggcagaggtgggaggatcacttgagcgtgggagttggaggctgcagtgagctgtgatcacagcctgggaaaccaagcgagagatgctgtgtctaaaattataaaaataaaaattagccaaacatggtgccacgcgtgtgtggtcacagctacctgggtggctgaggtgggaggatcactggagcccacaaagtcgaggctgcagtgagctgagattgcatcactgtcgtgcagcctgggcaccagagtgagagacaccctgtctctaaataaataaataagttcatgattaagcagaagttgtgcttgttctgccgggatttcagttgggttctttgtgccctaatttacgtgagctagtaggttgtgcgttatcttagagggcttgcatgaaagaaagagggtagcctttcttttccctgttttggtagcattgctgaggtggcttttggctgacgggtggacccgtgggtgcagatgttttgatgcagaaggaacgattgccttttcacattcaggctccaactggcttttagcttgtgcgttcttaccctggggtgttcgaggtcaccggactcctattttatttgtgtttaactggaaaggcaggaactctgagaacgtatcaaatagccagtttactgcaggctttctagaatttaaatcgcttccaaaactggatccacaagctaggaattatgtttaagttttaaaaggtgttggtttgcttcttacatgtctaaattcttgggggaaaaactgcaaagaataataaagtttcatgattcaaaaatggtatgaggccgggcacaatggctcacacctgtcatcccagcactttgggaggctgaggcaggaggatgatttttgagaccaggagtttgagatcagcctgggcaaacagcgagatcctgtgcctacaaaaataaaataaaaataggctgggtgtggtggctcatgcttgtaatacctgcactttgggaggctaagtcagtaggatcacttgaactcaggggtttgagaccagcctggtcaacataatgagaccttgtctctagtaacaataaaaaaattagctggacataaggtgtgcatttgtagtcccagttacacaggaggctgaggtgggaggatcacttgagcctgggagttggaggctgctgtgaaacgtgatcgcaccactgcactccagcctgtgcaacaaggagagagatgctgtctctaaaaaaaaaaaaaaaagccagacgtggtggcacacgtgtgtggtcacagctacttgggaggctgaggctgaaggatcgcttgagcccaaggaggctgaggctgccataagctacgatcatgccactgcactccaggctgggcaatagcctgggcgactgtctcaaccaaaataaatttaaaaagataggaaatttcaatgtgaaaatcagtgtcccccagaacgttccatttcttcccagctgggctatttttggagttccatggggagccggctcagtgcaccttgcatgtactcaggaggatgagccctgccatggtgtgtgttaggggacagcctgatctcaccaaccctcctgagcaggcccggccctccgagtaataactgggaacactcgccgctttgtgagaggacctcgtgtgctcactggaaggtcatctcttctggtccacgctgcagtgtggatactttttttgtttgtttgtttgtttgagaaggattattgctctttttgcccaggctggagtgcaatggcatgatctcggctcactgcaacctccacctcctgggttcaagccattcttctgtctcaacctcctgagtagctgggattacagtcgcccgccaccacacccggctaatttttgtatttttagtagagacagggtttcagcatattggccttgctgttctcaaactcctgacctcaggtgatccacctgcctcagcctcccaaagtgctgggatgacaggcgtgagccaccgcgcccggcccagtgtagatacaccttgagcacataactggaatcctttccttgacaacttggagccccttggaacatagtcatataaactgtattgaattaagaggagacaccgttaaatatgtcatagctgtcctcaaaactgggtcttgttttgctttctgcctggaaatgggagtcacttttatagaaaatttattgttcgttaacaaaaaataattgtgtgtgtgtgtatatatatattgtatgtgtgtgtatatatatatatatatatatatatatatacacacagacacacattctctctctctctctctctatggtacaatatgatgttttaatccaagtacacattgtgcagtgattaaaccaagctagttaccatattagcaatgaagctaattaacattaataattaagtgaattaacatattaaccattgacctaattaacatattaacaatcaagctaattaacatattaacaagctaatttacatattcagataaccctaactctaacctatatcacctcacttcgtttttttggtgatgagaatatgtaaaatctagttttagtcattttgaaagatgcaatgtattattattaactataatcactgtgtggtatgatagaactttgaatttatttcttttatgtaactgaaaaaatttaattttaatgtaatttatgtttttgagacagtctcaccctctatcacccaggctggagtgcagcgtcatgttcatagctcatggcagcctccaactcctggcacaggtgaccctcccacctgagcctcccaggtagctgggactacaggtgcacaccaccacacctggttaatttttaaagttttgtagagatggggtcttgctatgttgctcaggctggtcttgaattcctgggcagaagtgatccttctgcctcagcctcccaagtagctgggactgcaggtgcatgccaccatatctagctaattttttcatttttttttatttttagagatggggtttcattatgttgcccaggcttctctcaaactcctggccttctgtgatcctccttcctcagccttccatagcattgtgattccagacatgagccaccgctcctggcctccaactgaaatgttatgttctttgccaaacacttcatgaagcattcttccctggcaaccaccattgcactctctgcgtttatgcgttcagcttttttagattctacctatgagatgatacgatatttgtctctctgtgcctggttcatttcacttcacattgtatctttcagtcccacccatgttgctgcaaatggtaggatttcctttttcatggctgcataccattccattgtgtgtctatgccacattcgcttgatgcacttatctgttgattgaacatgggttgattctatatcttggaaactattagtagtgctgcagtgcacagggggtgcaggtatgccattgatgggcagatttcctttcctttgggtacacaccgagcggtgggatgactggatcctgcacaacattctttgctctgatgttttgcaggccaatggctggaccttagggaacgtcttcactttgtacaaggtgggggtcccttggccacattcttagggaacgtctgcagtgtgtacacgatgttggtctcttgaccacatgcttaggaaacatcttcagtgtgtagctggcagcagtcccttagccacattcttcccgaatgtcttcagtgtgtacacggtggcagtccctagtcctaattcttcgggaatgtctttagtgtgtacatggcggcagtcccttggccgcattcttagggaacgtcttcagtgtgcacactgcggtggtcccttagccacaagcttagggaatgtcttcagtttgtacttggtggcggtcccttggctacatgcttacggaacatattccctgccgtctcttggctgctttcttagggaacgtcttcagtgtgtacatggtggtggtcccttagccacaagcttagggaacgtcttcagtgtgcacaccgtggctgtcccttgggccacatgcttagggaacgtcttcagtgtgtacatggtggcagtcccttggccacattcttagggaacgtcttcagtgtgtacagggcggcagtcctttaaccacatgcttaggggaaccatcttcagcatgtccacggtggcggttcttttgcggcattcttaggggatgtcttcagtgtgtacatggcggctgtcccttagccacaggcttagggaacgtcttcagtgtttacatggtggcggtcccttggccacatgcctagggaatgtcttgagtgctgtcccttggctgcatcttagggaatgtcttcagtgtgtaaatggtagcagtcccttagccacatgcttagggaacgtcttcagtgtgcacacagcagaggtcccttgcgccacatacttagggaacgtcttcagtgtgtacatggtggtggtcccttggccacatccttagggaacatcttcagtttctacacagtggccatcccgctgccacattcttagggaacgtcttcagtgcctacatggtggtggtcccttggccacattcttagggatcatcttcagtgtggacccttggccacattcttagaaaacgtcttcagttcatacatggggacgatcccttggccactttcttctgagtgtctgtgtcatttgctccctgtaagctgcttttatttcttcattgggtgtctctatcatgtggaatcccactcatctgtcaccacccatcccaggcacagtgagagacacagccagcctgctcctctctgcacgtggccatctcagacattctccagccactgtcctgaccccattcattccttctcctgcacggtccacatccttctttccctacacccttgctaccaagaaatggtctgaatcacagccaaagtttcatttgctttctggaacagcagctccccagccgcactcagatcagagattcagaacctgaatcttcggatttctggagatgcccccatcccatcagagacttctagtgtgtttctttatattcgtgtagacttgggaggatgacaggagagaaaccttagaaggtggcctgtgcagttccagggcccagggtggaaggggcttgcatccctggctgcctttgtgcacctttcattcttcatccagctgttttttttttttttttttgaagaggagtcttgctgtgtcccccaggctggagtgcagtgctgtgatgtcagctcactgcaacctccgcctcctgtgttcaagccattctcctgccacagcctcccgagtagctgggattacaggcacctgccaccacacatggctaatctttgtatttttagtagagatggggtttcatcatgttggccaggctggtcttgaactcctgacctcaggtgatccacctgcctcagcctcccaaagttctgggataacaggcatgagccactgcgcccggccgcacccttcattcttgattcacctggttacaaactcgcagataaactgtttctacctgtgacaaatgagtcatccatcttccatgtggtgtcgactttgtccctgttataatattcctgtctcttgttctggtttttggcgtcccgcacattgtccctgttacagtcgtgtctcttgtttctggggtcacccctgtggtgagttgactgtgccctgttcctgaggctggtgaggatgctgtggacaccttaatcacggctgtgaacaaactggctaaagctaggcaccatggagctttgcagtggatgctaagtcgtggtacccattctttgatcagtgacggagccaggtgtcttattaagtctcggggatttgtggaagcccagagcaggcatgcaccttctacattgaaaggaatccttttgacactcaacgttggtgtcgtgaagtcctgcctctggaaatccctgatttcctaagacactaatctaacattttaaaagagttaaaaaaaaatcagtaaaatgttccccatagaagcatgcagtgttttgtgtgtgctttttattgttttttttttttttttttttgagacgaagttttgttcttgtcgccaaggctggagtgcagtagcacaatctcggctcactgcaacctccgtctccagggttcacgggattctcccgcatcagcctgtcacgtagctgggattataggtgtgtgccaccatgcccgactaattttgtatttttagtagtgacagggtttcatcatgttggtcagggtggtctcgaactcctggcctcaagtgatccacccgccttgccctcccaaagtgctgggattaggaatcactgctcccggcctacttgtttttacttttatttcaggttgaggggcacatgcgcaggttcgttacacgggtaaattgcatgtcctgggggtttagtgtagagattatttcatcaaccaggtaataagcctactaccacctgataggtaatttttcaatcctctcgtttgtcccaccctccaccttccagcaggccccggagtctgatcccttctttatatccacgggtacccaatgcttacctaccacttatcagtgagaacaggaggtattttgtcttctgttgctgtgtaagtttgctaaggataatggcctccacctccatgcaggttcctgcaaaggacatcatcccgtttttttttttttgagatggggtttccctcttgttgcccaggctggagttcaattgtgtgatcttgactcaccgcaacctctggctcccgggttccagtgattctcctgccttagccttctgagtagctgagattacaggtgcatgccaccacgcccagctaattttgtgtttttagtagagacagggtttctccatgttggacaggctggtcttgaactccggacctcaggtaatccacccgcctcggcctcccaaatttctgagattacaggcgtgagccaccacgcccaaccaatcccattctttttcatgggtgcatagtattccatagtgtatatgctcccacctttctttatccagtctacatgacgtcgttttgaggtatggatgaaatgatttgcataaaaacagtgaatgctttctattagaatggtgttggcctttctgggaaaccgtggagtcattccaattgcaatttcctagtagatttgattggttaatagaattgggaatttttggggtgcctgatgcacactattggagatcttttttcacagtgtagaaatctcaacatgaatatgtctttttttttttttgagacggagtttctctcttgttgcccaggccggagtgcaatagctcaatctcggctcactgcagccaacatctcccgggttgaagcaattctcctgcctcagcctcctgagtagctgggattacaggtgcctgccaccacacctggctaatttttgtatttttagtagacacagcgtttcagcatattggtcaggctggtctggaactcctgacctcaggtgatccacccgcctcagcctcccaaagtgctgggatgacaggcgtgagtcacagcgcccggcccagtgtggatacaccttgagcacataactggaatcctttccttggaaacttggaaccccttgtgtcatggtcatataaactgtgttgaattaagaggagacactgttaaatatatcacagctgtcctcgaaactgggacttgttttgctttctgcctggaaatgcaagtcatttttatagaaaatttatttttcgttaacaaaaaataattgtatacatatatatggtacaatgtaatgttttaatccaagtacacattgtgcaatgattaaatcaagctagttaccatattaacaataaagttaattaacatattaaaataaagctaataacgtattaaccaagctaattaacatattaacaatcaagctaattaacatattcacataatcctaactctgacctatatcacctcacctagttttttttgtggggagaatatgtcaaatctacttttagtcattgtgaaagacgcgatgtattattaactatcatcactgtggtgtgatagatcttggaatttatttgttttatctaactgaaaaaaattaattttaatgtaatttatgtattttttgagacagtctcaccctatagccaggctggagtacagcatcatgttcatagctctcggcagcctccaagtcatggctcaggtgaccctcccacctcagcctcccaggtagctgggagtacaggtgcacaccaccacacctggttaatttttaaattttttgtagagatggtgtcttgctatgttgctcaggctggtcttgaattcctgggctgaagcgatcctcctgcctcagcctcccatgtagctgggagtacaggtgcatgccaccatacccagctaattttttgttttttttttttagagatggggtttcattctgttgcccaggcttatctcaaactcctggcctcaagtgatcctccttcctcagccttccatagcattgtgattccagacatgagccaccgcttttggccagcaactgaaattttgtgttctttgacaaacacttcagcattctttgctggcaacaaccattgtaccctctgcatttatgtgttcagcttttttatattctacatatgcgatgatatggtatttgtctctctgtgcctgtttcatttcacttcaccttgtatcttccagtcccatccatgttgctgcaaatgacaggatttcctttttcatggctccatactattccagtgtgtgtctatgccacatttgtttgatgcactcatctgttgattgacacatgggtttattccgtctcttggaaactgagtagtgctgcagtgcacagtggggcaggtatcccattgatgggtacacacccagtggtgggatgactagatcctgtacaccattctttcctctgatgtttcgcaggcccatgactggacctttggaacgtcttcactgtgtacaaggtggtggtcccttggccacattcttagggaacgtcttcaatgtgtacatgacggccgtcccttggccacatgctcagggaacatattcagtgtgtacttggcagtggtcccttagccacattattagggaatgtcttccgcgcgtacacagtggcagtccgttggccgcatgcgtagggaacgtcatcagtgcggtccattggccacatgcttagggaacatcttcagtgtgtacatggtggtctcttggccacattcttcgggaacgtcttcactgtgtacatggcggaggtcccttgggcgcatggttagggaacgtcttcagtgtgtacatggcggaggtcccttatccacattcgtagggaatgtcttcaatgtgtacacggtggcagtcccttggctacatgcttagggaacatcttcagtgcggtcccttgaccacatgcctagggaacgtcttcagtgccgtcccttggctgcattcttagggaacgtcttcagtgtgtacatggtggtggtcccttagccacctgcttagggaacgtcttcaatgtgcacatggcagcagtcccttggccacattttttgggaacatcttcagtgtgtacatggcggcggtcccttagccacattcttagggaatgtcttcagtgtgtacacggcggcagtcccttggccgtatgcttagtgaacgtcttcagtgagtacatggcggcgatcccttagtcacctgcttagtgaacatcttcagtgtgtatatggcggcagtcccttaaccacatacttagggaacgtcttcagtgtgtacatggcagtggtgccttagccacatacttagggaatgtcttcaatgtgtacatggcagtggtttcttagccacatgcctagggaacgtcttcagtgttgtcttttagttgcattcttagggagcgtcttcagtgtgtacacggcagcagtcccttggccgcattcttagggaaccttttcagttcatacacagtggcggtcccttggcaacattcttctgagtgtcagtgtctgtctgtgtccttttcaccctgtaagctgcttttgtttcttcactgggtgtctctgactctcatgtggaatcccatttctctgtcaccgcctgtcccaggcacagtgagagacgcagccagcctgctcctctctgcacgtggccgtctcagacattctccagccaccgtcctgaccgaattcattccttcccctgccccgtccacattcttcttcccctacacgcttgctaccaagaaatggtctgaatcacagccaaggcttcatttgctttctggaactgcagctcccagccccacccagatcagaggttcagaacctgaatcttcggatttctggagatgcccccatcctatcagaggcttctagtgtgtttctttatattcgtgtagacttgggaggatgacaggaaagaaacctttgaaggtggcctgtgcagttccagggcccagggtggaaggggcttgcatccctggctgcctttgtgcacctttcattcttgatgcaacttttttttttttttttttaaagatggagtcttgctgtattgcccaggctggagtgcagtgctgtgatctcagctcactgcaccctccgcctcccgggttcaagcgattctcctgccacagcctcctgagtagggagctgctaaaataaaataccttcagttgggtaatttataaactacagacatttgtcactcacagttctaaaggttggaggtttaagatcgtggcggattcagtgtctggtggggacccacttcctggttcatagatgatgcattttctctgcgtggaaggggcgagggagctctctggggtcccttttataaggacactgatcccattcatgaggctcgatccccatgatctcatcacctcccaagtctcccacctcctgactccattgtcttaggggtgaggatttcaatgcaggaatttgggggaggaatacaaactttcagactatatatagcaaataccattctttaaaaacatacagtaatagttaagctttttttttttttaatttgataaattttccaagaaggaggagacacagaaaccctccttgctttgaaggtgaatgttagtgctgtaaaatatacgtgggacttgggcttataaaatcttggtcacggtaaaatataggtggtacgcagaacctgggaaagcccacctttcctttttctgacatgtaacttttgtggaaattgcctaaaattgtttatagttagctcttcagtcctgtgtccaacccagcatgtccgatactatctaacattctttttttttgagacagagttttgctcttgttgccaagcctggagtacagtgacgcgatcttggctcgctgcaaccttcacctcccgggttcgagcgattctcctgtctcagcctcctgagtagtttggattactaaattttatataaatgttgtgtcaagaaataatattgctcttttgactttttttccctaagcattgagaaattcagaaaaaacatttataaacataaacactgttcttgacaagtgggccttccaaaaataagggctggagtttgttgaaactgctctactgtgttttatttatttatttatttattggtacttttttccttttttttttgaggcactaattggaatgcacttatttgtcctgggtggagaaacaattcagatctaacactgggggctctgtgtttccttaggtaacgcatgtgaggttttcgtcagtgtaattcggtaatctgtgttagtattattacaaaagagcaggggggcatttgtgtcttctcagaattgcttattaaaacagctgcatggccaggcgtggtggctcacgcccgtaatcccagcactttaggccggtggatcgcttgagtacaggagattgagaccagcctgggcaacatggccaaactccatctctactaaaaatagaaaaaattagtatgtgcttatattcccagctactcaggaggcagaggtgggaggatcacttgagtgtgggagttggaggctgcagtgagctgtgaccacagcctgggcaaccaagcgagaggtgctgtgtctaaaaatacaaacataaaaattagccaaatgtggtggcacgcgtgtgtggtcacagctacttgggaggctgaggctgaaggatcgcctgagcccaaggaggttgaggctgcagtgagctagcatcatgccactgcactccaggttgggcaatcgcctgggtgtgaccctgtctcaaccacaataaatttaaaaagataggaaatttcaatatgaaaatcagtgtcccccagaatgttccatttcttcccagctgggctatttttggagttctatggggagctgtctcagtgcaccttgcatgtactcaggaggatgagccctgccatggtgtgtgttaggggacagcctgatctcaccaaccctcctgagcaggcccggccctccgagtaataactgggaacactcgccgctttgtgagatgacctcgtgtgatcatttgaaggtcgtctcttctggtcagggtgcagagtggacacatttttttttttttttgagacagagttttactcttgttgcccaggctggagtgcagtggtgcgatcttagctcactgcaacctccacctcctgggttcaagccattctcctgtctcagcctcctgagtagctggcattacaggcgcccgccaccacacccagctaatttttgtatttttagtagagatggggtttcagcatattggtcaggccagtctggaactcctgacctcaggtgatccacccgcctcagcctcccaaagtgctgggatgacaggcgtgagccaccgcgcccggcccagtgtggatacaccttgagcacataactggaatcctttccttggaaacttggaaccccttgtgtcatggtcgtgtaaactgtgttgaattaagaagagacaccattaaatatgtcacagctgtcctcaaaactgggacttgttttgctttctgcctggaaatgcgagtcatttttatagaaaatgtattgttcattaacaaaaaataatcgtatacatatatatgaggtacgtgatgttttaatccaagtacacattgtgcggtgattaaatcaagctagatactatattaacaatcaagtcaattaacatattaataatcaagctaataaacacattaacaatcaagctaattaacatattaacaagctaattaacatattcacataaccttaactctaacctatatcacctcacctacttttttttgtggtcagaatatgtaaaatctacttttagtcattttgaaagatgcgatgtattattaactatgatcactgtggtgtgatagatctttgaatttatttcttttatgtaactgaaaaaatttaattttaatgtaatttatatttttttgagacagtctcaccctatcacccacggtggagtgcagcgtcatgttcatagctcactgcagcctccaactcctggctcaggtgaccctcctgagcctcccaggtagctgggactacaggtgcacaccaccacacctggttaatttttaaattttttatgtagatgggatcttgctatgttgctcaggctggtcttgaattcctgggctgaagtgatcctcctgcctcagcctcccaagtagctgggactacaggtgcatgccaccatacccagctaatttttttgtttttgttttttttttagagatggggtttcattacgttgcccaggcttgtctcaaacttctggccttcagtggtcctccttcctcagccttccatagcattgtgattccggacataagccaccgctcctggcctccaactgaaatgttatgttctttgacaaacacttcatgaagcattcttccctggcaaccaccattgcactctctgcttttatgcattcagcttttttagattctacatacgagatgatatggtattctctctgtgcctggtttatttcacttcacattgtattttccagtcccatccatgttgttgcaaatggcaggatttcctttttcatggctgcatactattccactgtgtgtctatgccacatttgcttgaggcactcatgtgttgattgacacatgggttgattctatatcttggaaactgtgagtagtgctgcagtgcacagggggtgcaggtatcccgttgatgggctgatttcctttcctttgggtacacaccttatggtggaataactggatcctgcacatcattctttcctgtgatgtttcacaggcccatgactgaaccttggggaatgtctttactgtgtacaaggtggcggtcccttggtcatattctttggaaacatcttcagtgtgtatacggcgttggtcccttggtcacatgcttgggaacatcttcagtgtgtacatggcagcagtcccttagccacattcttagtgaatgtcttcagtgtgtacacggtggcagtcccttggctgcatgcttagggaacgtcttcagtggtgttccttggccacattcttagggaatatcttcagtgtgtacacggtttgtgtacagggcggtggtcccttagccacaagcttagggaacgtcttcagtgctgttccttggccacattcttagggaatatcttcagtgtgtacacggtttgtgtacagggcggtggtcccttagccacatgcttagggaatgtcttcagtgtgtacccgtggcggtcccttggcctcatgcctagggaatgtcttcagtgccgtcccttggctgcattcttagggaatgtctttagtgcgtacatggcttcagtgcgtacatggcggcggcccctcagccacatacatagctaacatgttcagtgtgtacactgcaacggtcccttggccccattctttgggaacatcttccttgcggtcccttggctgctttcttagggaatgtcttcagtgcctacacagtggcagtcccttgtccacattcttagggaacgtcttcttctgtacatggtgtcgatcccttggccacattcttagggaacatcttcagtgagtacatggcggtggtcccttggccacatttttagggaacttcttcagtgtgtacatggctaccgtcccttagcccatgcttagggaatgtcttcagtgtgtacatggaggtggtcccttggccgcattcttagggaccgtcttcagtgtgtacatggcggtggtctcttggccgcattgttagggaccatcttcagtgtgtacatggcggtggtcccttagccacaagcctcgagaccgtcttcagtgtgtacacagctgtcgtcccttgggccacatgcttagggaacgtctgcagtgtgtacacggtggcggtcccttggccacattcttagggaacgtcttcagtgaggtcccttggccacatgcttagggaatgtcttcagtgcctacacagcggcagtcccctgtccacattcttagggaacgtcttcagtttgtacatggtgtgggtcccttggccacattcttagggaacatttttagtgtgtacatggcggcagtcccttagccacattcttagggaatgtctttagtgtgtacatggtggtagtcccttggccgcacacttctggaacgtcttcagtgcggtccctttgccacgttcttcgggaacatcttcagtgtgtacatgatggcggtcccttagccacaaacttagggaatgtctttagtgaatacacagcagcggtcccttggctgcattcttagggaacgtcttcagtgcggtcccttgaccacattcttaggaaatgtgttcagtgtgtacatggcgtcggtcccttggccacattcttagggaacatcttcagtgtgtacatggcggagtcccttagccacatgcttagggaacgtcctcagtgtgtacacggtggcagtcccttggccacatgcctagagaacatcttcagtgctgttcctttgctgcattcttagggaatgttttcagtgtgtacacggtggcagtcccttggctgcatgcttagggaacgtcttcagggtggtcccttggccacattgttagggaacatcttcagtgtgtacatggcggtggtcccttggccgcattcttagggaacctcttccttgtgtacagggcagcggtcccttggccgcattcttagggaaagtcttcagtgtgcccacggcagcggtcccttgggggtgaggatttcaacgcaggaatttgggggaggaacacaaactttcagatagtagcaaataccattctttaaaaaaatacagtaatggttaagcttttttttttcttgattgataaattttccaagaaggaggagtcaaagaaacgctccttgttttgaaggtgaaggttagtgctgtgaaatacacataggacgtgggcttatataaaaatcctggtcacggcaaaatataggtggtacgcagttcctgggaaagcccacctttcctttttctgacatgcaactttttcggaaattgcctaaaagttgtttatagttagcccttttcggccctgtgtccaacccagcgtgtccggtactatctaatgttctttgtttttgagacggaattccactcttgttgcccaggctggagtgcagtggtgcgatcttggctcactgtaacctctacctcctgggttcaagcaattcccccgcctcagcctcctgagtagctgggattaccggtgtccgccaccaggcccagctaatttttgtatttttagtagagacggggtttctccatgttggccaggctggtctcgaactcctgacctcaggtgatctgcccgcctcggcctcccaaagtgctgggattacaggtgtgagctactccgcccagcctaattttttattatttttaatttttaacattttttttttggagactgggtcttgctgtgtcccacaggctagagtgcagtggcatgatcatggctcactgcagctttgacctcctggactcaagccatgctcccacctcagcctcatgatagctgggactccaggtgtgtgccatcatgcccaggcaagtttttaaaaaaattatttgtagagatggcgtctcactatgtttcccaggttcgtctggaactctgggcctcaatggatcttcccacctgggcctcccagagtgctgggattacaggcatggggcacagtgcccagtccctcatgtgtgtaattgttcaacagctagagaaacccaaacacataccctcagacactgtcccgtctgccgcccaggtctcctcacctgcatggtttgctgttgccacttgatttaatggagggcataatgaatgacccttaaacacggcctctaagagtcctcgtaagtgccttcctcattaaaattcaagaggaatcaaatacctgttactgaatataaatgtttagaggagaaagcctgtgagctgagagtcatatcttaaggggtgtgtgcttgcagaattatcacattttcaatttcatgtgtgaataaattgttgtatttgggatcaccaagaaggcagaaacatgtatcaatgaaatttagtagacggctaaaaacaaacagtagcagcctactgaggggctgtggaataagcagattttagatttttagagggaaaacggtgatggtaggttatttccccaatggcttccaggcctccaactcaggcttggaattggccatggtcattggccctttttttttttttttttctttttgagacggagtctcgctctgtcgcccaggctggagtgcagggtgtgatctcagctcactgcaagctccacctcccgggttcacgccattctcctgcctcagcctcccgagtagctgggactacaggcttccgccaccacacccggctaattttttgtatttttagtagagatggggtttcactgtgttggccaggatggtctcgatatcctgacctcgtgatctgcccgcctcggcctcccaaagtgctgggattacaggcgtgagctaccgtgcccggcccattggctcttttttttaccatctcatcttctctcacacgagttattctcactgttggaaagaacttgtccttaaagcattgcttccaggtgagtgtaacggtgcccagcatgtgatacaagttaaaaataagagcagagcccaaatgctgtcattgcttgatccatcatttcccctgtcatgcagctcatttgagtaacagggtctcgtttcggggtgctgtgtccggagaggcagaactccccttggagaatgggtagagaatgtacatcacttgccaagtatggtggttttgcatgctgccttgactggacttgtttgcctttggttttctgtaagaatcttaggatatctgcccaggagttagacccctgggctaaagtaaggttgagggccagccacggtggctggtgcctgtaatccctggactttcggaggctgatgtgggaaaatcacttgagtccaggagtttaagaggagcatgggcaacgcagtgagacccccgtctatataaaatttaaaaaaaattagctggacatggtggtgtgcatctgctcccagctactttggaggctgaggtgggaggatcactggagcccaggaggtggaggctgcagtgagccatgatcacaccactgcactacagcttgggtgacagagccagaccctgtctctacgaaacacaaataaaaagtaaaatgaggttgagaaactccgcctccctcttgatttcaaggtaatactcagcttctagattgacacacacacaagtcattgtcttatcatagtgacatgtgacggaacacgcacgtgtctggtgacagatggtgcattgaggggaacattccttaagctgtgtttccttggggaaagaggcaatagcattctctgttagtacagaacccttcagtttgtacaaatgtcttcggaaagggaatattcctgagagcttctacgtggcagttaacaagtcacacttttcatctcagatgtctcaatttccagaagatggtacttgattacatttcctggggttcttgtttctaggaaatcgcggctgggtttttctagaaataatgcagtgatttggggacctgtggcactgggaagggtatgatctcaggcacaggactgcaaagacacgttgtttaccggccagcatgataactaggcgtgacgctgatggccagtgtgttgcatacgtactgggctttattatccatacctggatggaactgaatatatatatatacacacacacatagacacccataatatattatacaatgtaattatatatcatcatatatcatatatattataatatatacagttgacctttgaacaacacaggtgtaaactccataggtccatttatatgtggattttctgccacctctgccacccccgagacagcaagaacaaccctttttgttcctcctcctcctcctcagcttcttcagcatggagacgatgaggatggagacctttaggatgatccacttccactcgatgagtagtacatatgttttctcttccttaagattttcttaatagcattttcttttctctagcttactttactgtaagaatgcagtatataatacatagaaacacaaaataaatacaaacatgtgttgagaatgtagtatataatatatataaatacaaaatacatgttgattgacagtggcatgatctcagctcactgcaacctctgccttctgggttcaagcaattcttctgcctcagcctcccaaatagctgggcctacaggcgcacgccaccacacccagctaattttttttgtatttttagtaaagacggagtttcaccatgttggccaggctggtcttgaactcctgacctcgtgatccacctgcctcagcctcccaaagtgctgagattacaggcgtcaaccactgtgcccagccgtgtgagtctttatggtagaacaatttatattcctctgggtgtgtacccaataatgagattttcagtagactttgagtgaagccgatagctgttcataatgtgggtgggccttgcctaatcagtggaaggtcttaagaggtaaaaagagtccctcctccaaggaagagggaattctatctggaatccaccttcagacttgagctgcgacatcatgtctccatgggcatctggcctgctggtctaccctgcacattttggttttgcccctcccccacatcttgggagccagttctttaaaatctctttctctctatatatatatcctactggttgtttctctgcagaactgtcactcatgcagatctgtgtccacagatgacatcattgcaaagccactaagagagacatagcatccagggaatggaaggaccaggttcctttcagacttgaagacacgtcaaaacacattccaccgcgttgccttggagaacccagggaccaggcctcttcccctcctgtcaaatagtccttagcctttgttcttcttgctccttgtgaatttcacaggcttccttgactttgaattctgctccttggatgtctttgttggtgaacgtgatgagatagaattttggaaagctccgaggtgtgatcattgcaccctgggactgacacgtgctccgtcttcactgaagacagccggaagccgtggtgttccagaacttgaatgtggctgtggaaactagagtgtccatgcatcctgggcggtagctactggtgccgtctgcgtcgtctgtagctcctcattgctgattctcattcggctgcctcagtcaggacagggctggttacagcgttgctcttcatgctgttcaagtcagggtgatctacagggacagaacgaataggactgatgtgtatatgaaggggagtttactaggataattgactcacacgatcacaaggtgaagtcccacaataggccgtctgcaagctgaggagccaggaagccagtccaaggcccaaaacctcaaaagtaggcaagctgagagtgcggccttcagtctgtggtcgaaggtccaggagcccctggcaaatcactggtgtaggtccaacggtccaaaacccaaagaccctggggtcttgatgttcgagggcaggaagcatccagcatgggagaaagatgaaggctagagatcccgccactgcactccagcctgggtgacagagcgagactccgtttcaaaaaaaaaaagaaagaaagaaaaacatttaaaaagcagaaatgagctggatgcggcatcttctgcttgtaatcccagcattttgggaggccaaggtgggtggattgcttgagcctaggagctcgaaaccagcctgggcaacatacggagaccctgtctctacaaaaaaacacaaaaattatctggccatgctggtgcacacctgtagtcccagctactcaggaggctgagatgggaggtttggttgagcctgggaagttgaggctgcagtgagccatgattgccccactgcactccagcctgggtgaaagagtgagaccttgtctcaaaaaaaagaaaaagaaaaaagaacaaataagaagacagacacacctctcttctttgtgtgggtacagccgttggcaaactttgctgacagatgctactgaccttgttttcctttctgcattctgttcatttcaaaagtgggtaaatcagaagtgggactcactgtgaccttcagtgactcaatgctgaattcacaagattaattggagagtgtgaagaatgcagggcatccgtggacccattttaatgaattttagcatctcttgcatccttgtatccttgcatccagtaccggtccccagccttttagtaactgggctgtgcagcaggaggtgagtagcgtgtgagtgagcaaagcttcatctgtattgacagctgctccccatagctcatattacctcctgagctctgcctcctatgagatcagtggtggcattagagtctcataggagcatgaaccctactgtgaactgaacatgtgagggacctaggtggcgtgctccgtatgaaaatctaatgcctgatgatctgtcactggctctcatcacccgcacgcagatgggaccgtctagttgcaggaaaacaagctcagggcttccactgattctacacgatggtgagtttcataattacttcattctctattacagtgtaataataatagaaataaagtgcatgataaatagaatgcacttcaatcatccccaaaccatcccccaccccacatcagtggaaaaatggtcttccatgaaactggttcctggtgccaaaaagcttgaggaccactggacaaaggaacttgtcagagtatggattgaaggtctttattgatgctttgctgtcactcttactttaagatgaatgcgtatatatatgtatatacattctgtaatgtgtgaatatatgaagctccagctgctctctccctctctttcctctgcagtccaattctcgtagatcagtcttttcctgaaatgaatgacctcttaaattttattttatattttaagcttttatgttattttactttatttttaagctgtttttattttttaagcttttttttttttgagacaaaaaagtctcgctcttgtcacccaggctggagtgcaatggcatgatctgagctcactgcaacctccacctcctgggttcaaaaaattctcctgccccagcctcctgagtagctgggactacaggcgccagccaccacgctgggctaatttttgtgtttttagtagagacagggttttaccatgttggccaggctggtcttgaactcctgacctcatgatccacccacctcggcctctcaaagtgttgggattacaggtgtgagccaccacaactggccagtttgcaggtctttgttgatgctttgctgtcaatcttactttaagacgaatgcatatatatgtatgtgtatacattctgtaatgtgtgaatatatgaagctccacctgctctctccttccctctcctctgcagtccagtactctcctagatcattctgttcctgaaatgaacgaccattttttttttttttattttgagatggagtcttgctctgtcccccaggctggagtgcagtggcgtgatctcggctcaccgcaatgtccgcctcctgggttcaagcgattctcctgcctcaccctcctgaggcaggattacaggcgccagccatctcgcccggctaattttttaatttttagtagagatggggtttcaccatgttagtcaggctggtctcaaacttctgacctcaggtgatcagcccaccttagcctcccaaagtgctgggattacaggcgtgaagccactgcacgtggccggtttgcagtctttattgatgctttgctgtcaatcttactttaagatgaatgcatatatatgtgtgtgtgtgtgtgtgtgtatgcattctgtaatgtgtaactatatgaagctccagctgctctctccctccctctcctctgcagtccaatactcctagatcattctgttcctaaaatgaatgaccattcaggttttttttttttttttctgagatggagtctcgctctgtcacccaggctagagtgcagtggcatgatctcggctcactgcaatgcccacctcccgggttcaagcgattctcctgcctcggcctcccaaagtgctgggattacaggcatgagccaccgcgcccggccagaattcagttttttttttttccccatggttatccaatagcacacaggctcgtgaagccttcaaggtgcttcatctgaggttcgcttagaatggttgccacatattgttctgccggtgagttttcatgaattggactctgaaggttcttaattatggtggttgagtgacacggtctttcttctataagaacctaagttacactgcatatcaggaaaatgtgttcctgggaccagctttgttgggtttttggctgctggtcatcttcactttactctcccaaatttgaggactgtgacacacacacacacacacacacacacacacacacactctctctctctctctctctctctctctgtctctcttaggaaacaatggtatatcaacaatgaaatgatgcttttttttcttcttcttttttttttgagacagggtcttgctctgtcacctaggctggagtgcactgatatgaacatggctcactgcagccttgctctcccaggctcaagcaatcctcccacctcagcctcctgagtagctgggaccacatgggcacaccatcacacctggataatttttgtatttttagtagagacggggtttcactatgttggtcaggctggtcttgaacttctgacctagtgatttttctacctcggcctcccaaagtgctgggattacagacatgagccaccagactcggctgagcatcttttcaatatgaccttgtgtccgggcatggtggctcacacctgtaatcccagcactttgggaggctgaggtgggcggatcacgaggtcaggagatcgagaccatcctggctaacacggtgaaactccatctctactaaagatgcaaaaaaaattagtcaggtgtggtggcgggcacctgtaatcccagctactcgggaggctgaggcaagagaatggcatgaacccaggaggcagagcttgcagtgagccgagattgcaccactgcactccagcctgggcaacagagcgagactcggtctcaaaaaaagagaaaggattcaaggcagtgtataccaaacatgaaagtaaagttcaggaacctctttgatggaggagatgacggtggggtctgtagcctgttcatgcctataattgcaacacgtcgggaggccaaggtgggaggatcacttgaggccaggagtttgagatcagctcggccaacatagtgagaccccatctctacaaaaataaaaataaattagtggggcatggtggcacacacctgtagttccagctacttgggggactgaggcaggaggatcacttgaaaacaggagtttgagatcagcctgaacaatggagcaagaccctgtctctacaaaagattaaaaaaaaaactggcagatgtgctggcacgtgcctgtagtcccagctgcctaggaggctgaggcaggaggattgcttaagtctgggagtttgaggctgcagtgagctgtgttttcaccactgcactccagccggggtgacagagcaagaccctatcagtagtagtagtagtaataataataataataataataataataataataatatgttgctgcaaaagtaattgctgcttttgccattaacttttgcaccaacctcatgataaaacaacaaaaactcaacacctgtacctgccatgccctgaagctcatgacagtagacaaaactcactgtgtctccagccctcagtgttagatgaagggaccagggtgtgggaagatcagcagttcaaacgggaatcataaaacacatagtttttatttttttagttttgttttattatttatttatttatttttgttgttattatttttctgagatggagtctccctctgtcacccaggctggagtgcagtggtgtgatctcggctcactgctacctctgcctcccgggttcaagtgattctcctgcctcagcttcccgagtagctgggattacaggtgcgtgctaccatgcccggctaatttttgtacttttagtacagacggggtttcaccatgttgattgggctggtctcaaactcctgacctcgtgatccgcctgcctcggcctcccaaagtgctgggattacaggcgtgagccactgcgcccagcccccatgaaacatatagatattttcaaaacaactgtactaggatcaagaaggataggacttttgtttttcctgttttttaagaatgaaatatcatatggcgtaagcatagatttatttatttacttacttatctattcatttatttttagagacaggatcttgctctgttgcccaggctggagtgcagtaatgcaatcatagctcactgcagccttcaagtcctgggctcaaacaatcctcccatctcagcctcccacgtacctgggactacacatgcaagccaccatgcctggctaagttttaaatttctttgtagagatggggtcttgctatgttgcccaagctgatctcaaactcctggcctcaagtgattgtctcaccctgacctcctaaagtgttgggattacaggtgtgacccactgcttcctgcctagactttttttttttttttccaattaaggtttttactttgagatcattgtagatttataagcagttgtaagaaataataggaaagaatcttgtgtctacttcccccagtggtaacatcttggaaagcaataataccatgtcacaaggaggatattcacattcaggcaataatgcattgatcttatgttttactcgtatccgtgtgggtttttgtaccgagttctgtgcaatttcatagtgcgtgcaggtttgtgaagccagcattgtccgcaacacacagagcatttctttcaccaacaacccctcctgtttctctctctgcatcctacctcaacctcctctcccgtcctgaacccctgagaattactagtctgttctctatttctgtaccaacctgcatcctacctcaacctcctctcctgtcctgaacccctgagaattactagtctgttctctatttctgtaccttttctcatgtcaagaatgtcatataaatggagtcatacagagtgtaacccctttcaaatcacgtgtgtctttttttccttcactcaatagaattccctggagagccatccaagttgttgctaagaacaataagatgtttctttttaagtaacacctgcaaaaagtcttttataaaatggcgatgaaactaaatggtttttgattctaaacaaggcagccatgaatggttttctcgtatatcttagcatatgtgtgggagtgtatctgtgcaagtaattcttggaagtggaatagctgagccaaaaagaaaatgcatgtaaattttcttttctttattttaaagagacagcgtcttgctctgtcacccaggctggagtgcagtggtgcaatcatagcttgccgcagcctcgacctcctgggctccagtgatcctcccatttcagcctccagggtagctgggactacaggcgagcatcaccacgtctggctaatttatttttatttttgtagaggtagggtcttgctatgttgcccaggctgggcctcgtgctcctagcctccgctgatcctcccaccttggcctctcaaagtgttgggattacaggcataagctaccaggcctggctgcctgtcacctttcaggagtcattgtcaacttatctcctaagaaaatgcagtcttggtgggtacatttgaactgagtatgtaaacttctaacttctccaaggcatacgcattctggataacaaccctactttttaacctattccatgtgattgatgaaagctcacaattgctttattcattatttcattgtcagcgagactgaactttgtttcatatgcttatgttttatttcatatctccaaattgcatattcatttcctttacccatttgtggagggactggggtttggttagaagagctctttatagaccgggcgcggtggctcacgcctgtaatcccagcactttgggaggccgaggcgggcggatcacgagatcaggagatcgagaccatcctggctaacacagtgaaaccctgtctctactaaaaatacaaaaacaaaattagccgggcgtggtggcgggcgcctgtagtcccagctactcgggaggctgaggtgagagaacggcgtgaacccgggaggtggagcttgcattgagctgatattgcgccactgcattccagcctgggcgacagagcgagactccatctcaaaaaagaaaaggttagaaaaatacaccatggaatactacgcagccataaaaaggatgagttcatgtcctttgcagggacatggatgaagctggaaggcatcattctcagcctaataacgcaggaacagaaaaccaaacaccacatgttctcacttacaagtaggagctgaacagtgagaacacagggacgcagggagggggacatcacacaccagaacctgctgggggctggggaacaaggagagggagcgcattaggacaaatacctaatgcatgcagggcttaaaagctagatgatgggttgatgggtgcagcaaaccaccgtggcacatgtatacctatgtaacaaacctgcgcgttctacacatgtatcccagaactttaaaaaaaaaagaaatagtatttcaatatggtctgaattaggatgtctgttattagatataaaggagaacatatgtgttgagggccatttgagcctgttctgtatataaactcttatttttgcccttttctttgtagcatgtttggggtttttctggagttgaactttttagatatctgaaaaatagctgttaatatttctgatggaagttgcaaattttcttccagctcattatttattttttactttgcttatggagatttgttttgttttttaccatgtgattttttttttgagatagtgtcttgttcctcctggagtgcagtggcacgatcttggctcactgcaacctccatcccttgggctcaagtgatcctcccatctcagcctcccagcttgctggaactacaggcacgcaccgccacacccggttaattttttaaattttttgtagagatgaggcctctctctgtttcccaggctggtcctgagcttttggcctcaagcgatacccccacctcagccctcaaagtgctgggattacaggcatgagccactgcccggcctgttttttaaacaagtagttttttaaatagtgaaatctatctaaccatctttctgaattttcgtttaggaagcattttctttctgtggaggttaaactaatgattcctgctttcttgcaatcttctcatggtttaactttgtttttgccttggagttcactcatgcatgctatgaggtctggcactaattttatctgtttcctaatgtggcttcacgtgccccaacacggtttattaaaacgcccatcttttgccccttttgtcgtgtactcaatttccacatgcagttggcctatttttggaaattgtaccctgttccttcctccattaatgcctgtagtacctcccgtttaattatagaagcttctcaaatgttttaatctcctacagggccattgtgttctcaatctttgtacatatcagaattttcctctttgccgcctcatttggaattcttttccccacagcaattttcgaatcgattcgtccagtttgcctaaaagaaattctgtgaactatctttattggatcacatcaaatttgcatattgacttgggtcattctgacacctttaggattgtatcagtttagattttttttccccctccaacttctattttattttttaaattaaaaaaaattttttttttgagacggagtctggctctgtcgccctggctggagtgcactggcgtgatctcagctcactgcaagctccacctcccgggttcaagcgatcctcctgcctcagcctcccgagtcgctgggattacaggtggcacacaccaccacgcccagctaaattttgtatttttagtagagatgcggtttcaccatgttggccaggctggtcttgaactcctgacctcgtgatccacccgtctcggcctcccaaagtgctgggatgacaggtgtgagccaccgcatctggcctcaacttctattttaggttcgggggtacatgtgcaggtttgttccctgggtatattgtgtgatgttgaggtttggagcacaaggatcccgtcacccaggtagtcagcacagcactcaatagttttccaacccttgccccatcccttccttgccccattgaattgctcagtgtttattgttcccatctttatgtccatctgtacttgatgtttacctcccagtaagaagtgagaacgtctgatatttagtttcctggttctgtgttaattcacataggagaatggcctcctcttgcatctatattgctgcaaaggacatgatttcattctttttaatgggtgcatagtattccatggtatagatgcaccatgtcttcctaagaattgaattaacatttgagccagcaatcccattactgggtatctacccaagggaaagtaagtcattctaccaaaaagacacacgtactgtgtgttcatcgcagcactattcataaaagcaaagacatggaatcaaacttaggtgtctgtcaactccggattggacaaagtttgggggttttttttgtctttttttttttttttgtgagatggagtctagctctgtcgcccaggctggagtgcagtggcacaatctcggctcactgcaagctctacctcccaggttcacgccattctcctgcctcagccttccgagtagctgggactacaggcgcccgccaccacgccaggctaattttttgtatttttagtagagaccgggtttcaccgtgttagccaggatggtgtcgatctcctgacctcgtgatccacccgcctcggcctcccaaagtgctgggattacaggcatgagccaccgtgcccggccgtcttttttttgttttgttttgagacagtcttgctctgtcacccaggctggagtgcagtggtatgatcggagctcactacagcctcaacctcccagtcttgcgtgatcctctgaactcagcctcccgggtagctgagatgacagccgtgtgccaccatgcctggctaatttttttgtacctttttttttgttttgtagcaatggggcttcactatgttgcccaggctggtcttgaactcctgggctcaagcgatctgcctgccttggcttcccaaagtgctgggattacaggcatgagccactgcgcctgacccatttgggtctttggagaagcacacaccaagaaggaacatgatgggccagagatttactaggggaactgtgtgtgaagggtcaaacaggcgctggcagaagagtggaggaaggcttgcaggtgatggtgtaggtgcctcacacctgtgaagaaagagacggcgaggaattgggtagaaggagcgtccagccagttctctggtcatgccgagtcattggctgtgaaaacccaaaaccctgaggaagcccgatcttgcgaaacatgttccccatctgcagaggcaccgggtggctggtgtcaggcgattgttgcaacctgttgtgtgcgggggtgtctgtgtgggtacatacatacttctcagccccaatgccagcttcctggtccgtaaggaaaacactaaactcttctagctaaagttacaaatgcagcaagggtccattctgcaatctgtgatgcttttttttttttttttgagctggggtctcgctaccttgcccaggctgcggtgcagtggcacaatcacggctcactgtgcgttttcagggaagaccccacgggcacctccaaaaccatgtggcatgacatcctcaccgagacccgagggcatctttccatggcctcaactctacttttatgtctttaggtttcctgatataggttttgcacactctcgatgaccaagtctcatttcagtgttgctgttgtttctatattataagcaggactgtctcttcccctacctttttaacctgccaattgtttgtgtatgtatggaagctattgatatttgcttctgagttttctatctgactaccttcctgaattctcttcttggatttatttaatgttgattttgttagttttttcctggcataccatcatatcatctgcaaagtatattttgactctccctctgccgttcttgtgtctgttgtaattatttgtctgaccatgttggataagatctccagtagcatgttaaatgacagggtgcactcctggaatccagctctttgggaggccggggtgggaggatgacttgagccccggagatcaagaccggtctgggcaacacagcaagaccccatctttacaaaaaaaaaatagtaaaaaaaattagccaagtgtggtggctcacacctgtagtcccagctacttgggaggctgaggcaggaggatcatttgagtccaggaggtcgaggcttcagcgagccatgattgcaccactgcactgcagcctgggcaatgtagtaagaccccagctcaaaaaaaaaaaaaagcatcacagagaacaggatggatacttgctgcttttccaagtttagctggaagattttagagatttctttattgactaggaagttggcattggggctgagaaatatgtatgtacacacacagacacacccacacacagacacacatgtatacatacacagtatatatgcatactgtgtgtctgtaattacaatttaataatacattcctatttttaaaataaacttagtaaattaagaacatcaatacatctactgatactacatatagtatttgcaagtccctcagcttgggtcaggaacacgggaatgtcattgtacaggttctatcttcaggttacgagggatacaccagaaaacctaagcatatggaaaacttattcggcaattttctaagtgaacataccttttcatcgattcatgcgtgtatcaagaaaaacaaaatgaaagtcttacacaccaagaggattgttcgcacaatactgacaacgaaatgtacgggctgacaaataacagattatatgttgaagcctcctccacaggccccacctcctgataccatcaccctggcgattgtatgttctcaacataggaattattttggggggagaggagacacaacattttatacttggaaaggtgaaatggaaaagcagcataggctttattgttttattttattttattatactttaagttctggggtacatgtgcagaacgtgcaggtttgttacataggtatacacgtgccatggtggtttgctgcacccatcaacccatcatctacattaggtgtttgtcctaatgctctccctcccctagtccctcacctcctgacaggccctggtgtgtgatgttcccctccctgtttccatgtgttctcattgttcaactcccacttgtgagtgagaacatgtggtgtttggttttctgttcttgtgttagttcgctgagaaggatggtttccagcttcatccatgtccctgcaaaggacatgaacccatccttttttatggctgcatagtattccatggtgtccatgtgccacattttctttattcagtctatcgttgatgggcatttgggttggttccaagtctttactattgtgaacagtgctgcaataaacatacgtgtgtgtgtcgttatagtggaatgatttataaacctatttctatttaaattacctttgtatttttatagattttgtgggtatgagtacacttgtgttacatgaatatattgcatagtggtaatgtttgggctgttagtgaggccatcactcaaataacgtacatggtagccaataggtaatttctcatccctcatcccatcccaccctgtgagacttctgagtcctcgatgtctattttttatgctctatgtcgacgtgtacacattatttaattcccgcttataagggataacatgtggtacttgactttctgtttctgagccatttcacttaggataatggcctccagttcccttcgtgttgctgcaaaagacacaacatcattccttttcatggctgtgtagtattccatggtatatatgtgccatattttaaaaaatcaaattgtctgatggtggacacttaggctttatattttaataaagaacattccaaatatgttgaacaaaataatctcctaacttgaaaaagatcatatgtgcctataataattcacagaaagggactttcctgactacctgcctgcaaaatccacttttccctcagtctttctttctcaagggaattcatggaaattccctccttgaattttctcagcccccagtacaaggagtcattcttgcctcatcatgtccccctctctgtccttgtcttgtgatttctttttattttgaacgcgagaagtctgactcccaccagcacccctgtggccagtacctgtgagacatattctgaatccagcacctctcataccacctgtgctgaactgtggcggagctcccccgtcagtccctgcagctgcttcaggagacccttgatagccttgtcttcctccagctcaagtggattctccatgaatctattccttcctgtgaaacatatcacagattggctcagagccccgtgatgacgccctgtctgccagagagaagctcacgaactctggggtgcccctactccttcttccctcctctcttccctccttccatgtgcttggctccagctagccagccagccgccttcctcttcctggaatatcccaggcctgctagacttttgctctcaccgtcacaacatcagctcaggagcccctccttggaagattgttctctaaccctccgtccagaatcactgcttctccctttcctcttcttcctttgaagttcattcataactggaagatgtgagatctggaaagttctgcattattgccagacacatctgtgtatttagagtggttggtatctttcccaggggaaccaaatgtccttgaggcagacaacatgtttatctttgtctaattcatttccctgtatgctgggcacagagtgtgggctctacacatattttataaaagaaggagggaagggttagaagatggacagaaggaaggaggaagaaaggaaggaaagagggaggaaagaaaggaaagagggagggaaggaaagagggaaagaaggaaggaaagagtgagagaaggaagtaaagaggaaaggaagggaagggaaggaaggaaggaaaaagtgagagaaagaagtgaagaggaaaggatggaaggagaaaggaaggaaagggagggaaggaaaaaggaaaagaagaaagaaggagtgagacaaggaagtaaagaagaaaggagggaaagaggaaaggaaagaaggaaagagggagggaaggaaggaatgaagaaaagaaagagggaaggaaggaaggaaagaaggaaggaggaaggaaggaaaaagggagggaaggaaggaatgaagaaaggaaagagggagggaaggaaggaaggagggagggaaggaaagagggagggaaggaaagaatgaaggaaggaaggaatgaaggaagaaaggaaaaagagaaggaaggaggaaggaaggaaagagggaaggaaggaaggaaagatggagagaaggaagggaggacaagtggaaggaagaaaaagaaatacaaatctccctcaaaatgtggatcactcgtcttaaccagaaattcaagtgagatgctatctgcacgtgtgataccagcagctatgaagcaaactgtattaaccaagtcttttattttctgtgttctgatgcatgactttcatggccttgtcaaccctagagaccctgcccctcccatagctagcgaatccccagaggtggtgaagagcccacctatgaacctgtctttcatatgcaaacccatcaatccagaatccaccccccagccatctcctttattggggttgcatattccacgtcactctccacctgccctaaccaccccaaagccaggtaccagagagtcagggacagcccctatgccccagagcctgctgaaatcattcacactagccaactgtaagcctactcgcctgttccttcccttggaaaccacagtgagagctctggtctcctttgtcttcccacctgaccaaacttggtgcgcccctgtgtggtcctgagtggtgtcaacacgcccctcctcttgggacctgtgagtaacaaaccacttgcttaacggcagtctcctgatctgttggccccaccatacctacatcataataaagtctacattttacaacgcaaacgaacaaaaatgtcctgctcagtgctgccctgagagcagaggttattccaggattcttgctcgcctctgtaaagggtatccgttctgcagacctttctgccggtcacactgacggcatattgcagagcctgccagggactcacaggggatgacaggggatttatcaggtggttttttactgcactgtcattactgggggcgaatccactttaatacattcatgcctcctgagcctgtgggaattcaagaggaacagaaccagaaataaatgaaccataactccctttggcatcttgcctctctggaggcttaattcttacaaatatgtgctctgctttcaaatcttagtttgatgattttctcttcttctttttcagttttccccccacgacctgaccgtgtcgctatagtgacgggagggacagatggcattggctattctacagcgaagcatctggcgagacttggcatgcatgttatcataggtgatgacttttacagttacttgtgttttttgttttttcggtttttttttttttctgagacaggatcgcagtccgtcaacccgtgctggactgcagtggtgcaatcttggctcactgcagcctccacctcctgggttaaagtgattctcctacctcagcctcccgagtagctgggtttacagacatgcaccaccacgcctggataatttttgtatttttagtagagacagagtttccatatgctggccaggctggtcttgaactcctgagctcaagccatccgcctgccgtggcctcccaaagtgctaggattacaggtgtgagccactgcgcctggcagagttagttgtgtcttatacctaatgtgagctacttaggtgtcgattcagacatgtatgcaaatgttgatgtgcatatagaaaattcagtcagatccagaaagctcatgaaggtgatattcacaacctagaaaacacagaaaattgttgtacccttttggaagtagatatatattctgcttaaatattgatcctgtgtttctttcacatggtttactggaaaaaaataaccatatatctttatgactttactagggctgttataacaaagtatctcaaggagactggaggttgcttaaaaagccaaaatttatttttcacaattccagaggctggaagttcaatatcacagtgtaagtagggctggttcctcccaattccagaggctggaggttcaatatcacagtgtgagtaaggctggttcctcccgacacctcactccttggcttgtagacaccatcttctccctgtgtcctcacagggtcgtccctctgtgtgttttcatctcctcttctcctgagatgtcttagtccatttcaggcgctataacagaattaccatagaatgggcagcttatatacaacagacattgagtttcccacagtcctggaggctggatgtctgagatccaggtgtgggcagggctggttcctcctgaggcctctctccttggtttctctctgtgtcctcacagggtcatccctctgtgtgtgtccgtgtcctcatatgctctccttataaggacaccagttcaattagatcggggcccactctggtgacctcattttaccttaatcaccactttaaagaccttatttccaaacacagtcacattctgaggccctgggctttaggacttcaatttatgaattttgttcaaacacaagctcctaacagaatctgaacaatgttgcgggatacttgtttcttctgcaaccatgacctatagacactcacggtttgatttctgctcttctttttgaaaatttctctaaaagcttatcgtgatctctgactcctcttcctctgtgacctcttcaggtctcccttcaactgggaatatgaggacagttcaaattaacccattccactactgccaatggagacggagtggggggcggggaggaggggagagagtctattgcatacctggggaagtctaaatcagctagcttaaatgatgtgtggagacgagcttggaaaaataaaagccttaatgtgtattatgcccactcttgacactatctgcatttaattaattattttcagacaggatcctactctgtcagcccagactgcagtgcagtgacataatcatagctcactgcaacctcaaactcctgggctccagcaatcctcctgactcagcctcatgagtcgctgatatgacaggcgtgcaccaccatgccaagctcattttatttatttatttattattgttttttttgagacagaatcttgctctgtcacccaggtggaatgcagtgacacgacctcggctcacggcatcccctgcctcctgggttcaagcgactctcctgcctcagcctccagagtagctgggattacaggcgcccgccaccatgccctgctaatttttgtatttttagtagagatggggttttgctttgttggccaggctggtcttgaactcctgacctcacgtgatctgcccacctccgcctcccaaagcgctgggattacagtcatgaaccaccgtgcctggccctggctcatttaaaaaagttattttggcggctgggcgtggtggcttatgcctgtaatcccagcactttgggaggtcaaggtgggcagatcacttgaggttaagagttcaagaccagcctggccaacatggtgaagccctgactgtcctaaaaacacaaaaattagctgggcttgggggtgagtgcctgcgtggtggtgggcgcctgtagtcccagctactcgggaggctgaggcaggtgaattgcttgaacctgagaggcggaggttgcagtgagctgagatcacgccactgcactccagcctgggtgacagagcgagactcagtctcaaaaaaataaacaaaatgttttggagatactgggtcttgctatgttgcccaggctggtcttgaactcctgggttgaagtgatcctcccaccttggcctcccaaagtgctgggattacaagtgtgagccactaggcctgggcaccctttgcttttaataacttttatggtgtctgcttttataaacatcatactgtaggtctggtttgagatatgcaggatcgtattgacttaacactttccaggacgggagcagtggctcatgcctgtaatcccagcactttaggaagccgaggcgggcagatcacgaggtcaggagatcgagaccatcctggctaacatggtgaaaccccgtctctactaaaaatacaaaaagtagctcggcatggtggcgtatgcctgtaatcccagctgctcgggaggctgaggcgggagcatcgcttgagccagggagccggaggttgcagtgaaccgagatcgcgccactgcactccagcctgggtgacagagtgagactctgtctcaaaaaaagactttccaaaaccaatgcccattattgattgacttcttcctctccgccattctctgtccttctttcccttgttgtcattatggaaagatgatcatggatcataaacaatgcttagggctggagatttcaacatgaatttgtctcagttcttccttatctttgaggagctctgtccaggacagacacttttctgggccttgaatgcctttgcgatagcccaaaaggctcaagcataagagcatgagtctgatctggtgaccagggctcagcaaagagtctttccaggccttgaacctctggacatctgttggtgctcattggacaggctaaaagtcatcatgttacgaatcgatgaagttgacatgcagataaaaggtataaggaaaaaatgaactctccacatcattgtatgcattacatctatacgataaaaactgtgatatactcatgcgtttaaatagctgctctggtcctgggcctcatgcgtttcaatagctgctagcgttctgagcctcgatggccatccacttggctttgagttagctctctccaaaaatctccatggcagtttctgctggggcaaatgcacggctgctgcccacacctctgtgttttctcatcttcatttacaaaagaagaaaatgctaaccttgctgatgctaacctcctgaatttcatgcaggaatccccaggagtctttgactcagatggggaaaccccatgttcagcccatgtggccttctggtctccctggagatgcgtggtccatgtcagcgcacatggctccttgctccgtccttcacttaagtttgagcctttttggcttttgcaaaacatgaatgcaaaacttgaaatttttctatgtcatggctcttcccaactttcacatttttgagacagcgtctcactctgtcacccaggctggagtgcaatggcgtgatctcagcccactacaacctctgcctcctgggctcaagcgatcctcccacctcagcctcccaagtagctgggaccacaggcgtgcaccaccaggcttggataattttttgtagttttagtagagatggggcctcaccatgttgcttggacttgtctcaaacacctgagttcaagcgatctgcctgcctcggcttcccaaagtgctgggattacaggtgtgagccactgtgcccagagtcttttaaaataataattttgtacacgcagttccattcctcatataaccatctttctctgatgcacttcagggtttgtaaaatagtatacagagatgtgtactgtttcacatgatgaagcttagttgtattagataatgataacatcgtgtttggctatgtcataatgaggcaattgagtagaatataatgaaatcttgttggattagttaatgacttgttgagcttcggaagcaggtgagcactttttggtctatatcagtctctttctttccatcaagcagttattttcctcaaagttgtgcctaactcccacttgagcattttttttatccattctttttttttttactttgacatgaagtctcactctgttgcccaggctggagtgcagtggcgcgatctcagctcacttcaacctccgcctcccgggttcaagcgattctgctgcctcagcctcctgagtagctgggactacaggagcacaccaccacacccagctaatttttgtatttttagtagagacggggtttcaccatgttggccaagatggtctcgatctcttgaccttgtgatccacctgcctcagcctcccaaaatgctggtattacaggcgtgagccactgtgcccggccccattctctttattttattttattattttattattattattattattattttttgagatggagtttcgctgttattgcccaggctggagtgcagtggcgcgatctcagctcaccgcaaactctgcctcccgggttgaagcgattctcctgcctcagcctcccaagtagctgggattacaggcgcgtgccagcacaccaagctaattttttgtatttttagtagagggggggtttcaccatgtaggtcaggatggtcttgatctcttgacctcgtaatttgcctgcctcggcctcccaaagtgctgggattacaggcgtgagccactgcgcccggcctcattctcttaatagactgggacaagttaaaactttatgacaatttcttgaaattgtcaagttcatccatgtccctaactctcctgtcttggtgtgtttgggctgctgtagcctgagtgccttgcaaaccatagaaactttttttttaaaattttattattatactttaagttttagggtacatgtgcacaacgtgcaggtttgttacatatgtatacatgtgccatgctggtgtgctgcacctattaactcgtcatttagcattaggtatatctcctaatgctatccctcccccctccccccaccccacaacagtccccggtgtgtgatgttccccttcctgtgtccatgtgttctcattgttcagttcccacctatgagtgagaacatgcggtgtttggttttttgtccttgcgatagtttgctgagaatgatggtttccagcttcatccatgtccctacgaaggacatgaactcatcatttttgatggctgcatagtattctgtggtgtatatgtgccacattttcttaatccagtctatcgttgttggacatttaggttggttccaagtctttgctattgtgaatagtgctgctataaacatacgtgtgcgtgtgtctttatagcagcatgatttataatcctttgggtatatacccagtaatgggatggctgggtcaaatggtatttctagttctagatccctgaggaatcgccacactgacttccacaataaaccatagaaacttattgtcctacagttctcaaggctggaagtcccaagaccagggggtcagtgtggtcagattctggtgtagtctgtcttctaggttgtggatggccactttctcctgtgtcctcacatggtggaacctggatggggtctcttttataagggtactaattccattcattgtgctccaccctcgtgacctaatcatcccgcaaagcctccgcctcccaacagaatcactggggatgttagaatttcaacataggaactttggagggatacaaacattcagtttattgcgccccctctagatgcaaaaggattgggtttagatgaggagaccccaggggagagggtgcccatctgagagtgtatttctagaacttcttatgaacttgagcacctccatgatctgtttacatctccctgggacctgagtaaattagagacaagatgtagggcagggggggttctgagatttagcttggagactgtgaggtggtgatggatggcaacccttggttttgaccatccatgctaggtggatatctgctgtatcattaacaacatgacaaactttccaggactttctatatctcagacttctgccaatatttgagatgactgggtcaaaatgatgctgattttttgaacagggagagcaataggtattctctgaaggttggctggatgtgagcctagtggcttcaatgatggtggagtaggatgaagagagaccctcaaggttgaacaaagatgggagggctcacatccattactggttatatttgatcttttgtctcctccagtgcaatgatctttttcatcttcttaattcttaatttagctaggcaatgtttaattattagtttaattcttaatcaaactaggaaaggaagaaaacaccccatttctttgtgcttttttgcctcattgtggtggtttaggtcatgatgaggtctagttgggcaggtcatgatgaagtctagttgtattaggttctgatgatgtctggttgagttagatcatgctgaggtacagtttggtttggtcatgatgaagtctagttgtattagatcatgataacgtctcctttggttatgtcatgatgaagtagttgagtagaatgtaatgaagtcttgttcgattagatcatgatgactggttgagttaggtcattatgaggtatggtttgattaggtcttaatgaagtctagttcagtaacagcatgatgagatctagttggattagacttgatgatgtgtgacttatttaggtgatgatgaaatcttgttgggctaggtcactttgagatctaattgggtaggtcatgatgaggtcttgttgagttaggtcctgatgaaatgtagttgagttaggtcacattgaggtctagttgggtaggccatgatgaggtctatttgtattaagtcatgatgaggtttggttgtattagatcatggtaaggtacagtttggttaggtcatgatgaagtctagttgtattagttcatcataatgtttagtttggctatgtcatgatgaggtagttgagtagaatgtgatgaaatcttgttggattagattaggatgactggttgagttagatcattatgaggtgtgatttaattaggtcttaatgaagtctacttcagtaatagcatgatgagatctagctggatcagatcatggtgatgtgtggtttggctaggtcatgatgaagtctagttgggttaagactcaatgagttctagttgggtcaggtcacattgacgtctagttgggtaggtcatgatgacgtctaattgggttagatcatgaggagatctagttaggaaggtcatgatgaggcctagtggatagatcatgatgaggtctagttgggttaggtcatgataaggtctagttggattaggtcatgataaggtccagctgggttatgtcatcatgaggtagttgaatagaacacaataaagtcctcttggattagatcatgatgacaggttgagttagatcatgatgatgtgtggtttggttaggtcacagtgaggtctagttgactgaggactttgtaggcacaaagcaatgaagacatgtgagcaagcttcttgttcatgtgcatgggaatctcaagtgttaccacttcatttagatgatgtttactgagcatcaggagcagtatatgtcagcaccaatgtgccttttttcttgagataaacagaaagtaaacaccacatctgcaccccacctgtgtctcctatcccacagagctcctgatgtcagtgtttaattttcactgtgagttacagttttgacccttcaggtcaatccaatcaattatgcagtcttatttcccctgtgtgactttgaggataattggatatattctgagagaggcattttttcattttgtatggcagtttgattcaaagtcaattaatgaaaaaatatcattgaacacaatgaattttatattaaatacaaaataagagatgggaaatttaacttcaaaattttaattaaaaatttattaatatttaaagaataatcaattacttgtaaaataattcagattataacctgggtccaactgaagcacattaatattactagacacatatatcagttgttcaaattcccatctgtccacaagatcttagttctcattgtttcaaaatattattttggtgggggatcattttttttcataatgctcaatggactgtcatctaagatgaaagtggggtgggtaaactttttctgtaaagagacagataataaatgtgttcatatgtttctctcataactatgagctctgccctagtagtgagtaaccacccataggtaatacttaaaacaacaggaaagtctatgttgctgtaaaactttttgtacaatatccagctgcaggccaggtttagccgcagattggtgactctggtttgggctcaaaatctttttatttagtaagaggaaattatactgcttttttccaatataagaaatctcttgtacagtcctcaggaagggtagataatgatgaggtctagttgggttataatgaagtttagttgggttatgatgaagtctacttgggttggtcatgatgagatctagttgtattagatcctgatgagatccagttgggtaaggttctgatgaggtctagttgattggtcatgatgagacttagttaggctataatgaggactagttgtgttggtcaggatgagatcaagttgtattaggtcatgacgagatctagttgggtcaggttgtgatgagatctggttggttggtcatgacgagatctagttaggttatgaggaggtccggttgggttggtcatgaggagaactaattgtattaggtcttgatgagatctagttgggttaggttatgatgaggtctagttgggttggtcatgatgagaactagttgtattaggtcatgatgagatctagttaggttctgatgaggtctagttagattggtcatgaggagatctagttgtattaggttatgatgtgatctaattgggtgaagttattatgaggtctagttgggttggtcatgatgagatctggttgggttaggttatgatgcgatctagttggttggtcatgatgagatctaattaggttatgatgaggtctatttgggttggttgtgatgagatctagtcatattcagtcatgatgaggtctagttgggttagattatgatgaggtttagttgggttaggtcatgatgaggtctagttgggttagggtatgaggagatttaattgagttaggttatgatgaggtctagttgggctggtctttatgagatctagttgtattaggtcatgatgagatctaattgaattatattacgatgatatctagttggttggtcatgatgagatctagttgtattaggtcatgatgtgatgtagttggggtaagttatgatgaggtctcattgagtttgtcatgatgagagctagttgtactagatcatgatgagttatagttgggttaggttatgatgagatctagttggttggtcatgttgagatccagttaggttatgatgaggtccagatgcggtggtcataatgaaatctagttgtattaggtcatgatgagatctagttgtggtaggatatgatgaggtctagtgcattggtcatgatgagatctagttgtattaggttatgatgagatctagttggattaggtcatgatgagatctagttgtggtaggatatgatgaggtctagtgcattggtcatgatgagatctagttgtattaggttatgatgagatctagttggattaagttataatgggatctgtttggttggtcacgatgtgatctagttaggtcgtgatgagttctagttgggtaggtcgtgatgagatctagttgtctcatgtcatgatgaggtctagttgggttaggttatgatgaagtccagtttggttaggtcatgatgaggtctagtgggattggtcattatgagaattagttgtattaggtcataatgaaatctagttggcctaggctatgatgagctctggtaggttgttcatgatgagatctacttgtattgggtcatgatgagacccaggtgtgttaggttatgataagatctagttcgttgtcataatgagatgtaatttgtttatgatgcagtctagttgtgttgctcatgatgggatctagttgtattaggtcatgatgagacctagttgggttaggttatgatgaggtctagttggtttggttatgatgaaatcttgttggattatgtcatgaggagatctagttggatggtcatgatgagatataattaggtcatgataaggtctagttgggttggtcttgatgagatatagttgtattaggtcgtgatgaggtctagtttggttaggttatgatgaagtctagtttggttaggtcatgatgagttctagttgggttagggtatgaggagatttacttggataaggttgtgatgaggtctatttgggttggtcatgatgagattttgttaggtcatgatgaggactagttttgttggccttgatgagatgtagttgtattaggtcataatgaagtcttgttgagttaggttatgatgtagttaagttgggttaagttatgatgaggtatagttgggttggtcatgatgagagttagttaggtcacgatgaggtagttgggttggtcatgatgaaatctagtcatagtcagtcatgattagttcttgttgggcttgtttataatgagatttagctgtgtcaggtcatgatgaggtctagttgagttggtcatgatgtgatctagttgtattaggtcatgatgaggtctagtttggttaggttatgaggtctagtgtcgttggttgtgatgagattcagttaagttatgatgaggtgtatttgggttggtcataaagatacctgtttgtattaggtcatgttgaggtttatttgggctaggttataatgagatttagttgggttaggtcatgatgaggtctagttgggttagggtataatcagatctatttgggttaagttatgatgaggtgtattttggttagtcctaatgagatttagttgggttagagtatgatgaggtgtagttgcgttggtcatcataaaatctagttttgtaggtcacaggaagtctagttggttaggttatctaaattgcaactgtcttttaaaaatgacttgtgccacatatactttgtattgtccatgaatagtacatgtgaaacgtgtaaaatatttaaacttgtatttaattatctatttacttattttaatagacaaaaacaagttacatatttttatggtgtacaaaatgtggttttgatatatgtttccatctggaatggccaattcaagctaattcacatatccattaccttacatgtttctttttgtgtgtgtttttggaaacacttaaaatctactctctttgcaattttcaaatattaattatagtcactgtgactaattatagtcaggttcaagattatagtcactaatttagtcaccttaagtacaatagatctcttgaacttataccttctgtcaaactgacatttggtgtcatttgaacaaaatctcagcaacccacccccctagcacctggtaatcaccataattctttttcttttctttctttcttttttttgagatggagtctcactctgtcaccaggctggagtgcagtggcgcaatctcggctcactgcaacctccacctcctgggttcaagcgattctcctgcctcagcctcctgagtagctgggactacaggtgcatgccaccgtacccggctaatttttgtatttttagtagagacaggcttttgccaggttggccaggatggtctcgatctcttgaccttgtgatccacctgccttggcctcccaaagtgctgggattacaggcatgagataccacgcctggccaataatcatcataatactttttcttgtgagttcaacttctggagactctacatatgggtgagatcatgtgggatttggttttatgtggcttattttacttaacatgatgtactcctggttgatccatgttgtatcacaggatagggtcctctggttttcaaagactgaatggtattccatggtgtagctatcccacattttatttatctacccatccttagatggacacttaggttggtttcatatcttggctcttgtgaatcatgctgcaacgaacatgggggtgtagatatctctataaggggctgatttcatttcctttggatctatacagaggagtgagattgctagatcctatggtaggcataatgatcattttttgaggaactcttaaaaaaaaaaaggccacccctttagacacaccttaaaatccaacctttctggtcaaagacatttgaaaaaaatgacgacaacatcaaactatagtctcctgtccaagcacgttcacttcctaagatgtgaaaaaaaccaggccgggtgcagtggctcatgtctgtcatcccagcactttgggaggcaaaggcaaacgggtcacccgaggtcaggcgttcaagaccagcctggccaacatagtgaaaccccatctccactgttttccataatggctataccaatttccattgcacatataacatgtaacgccctcccctgcccccccaaatacaaaggatgaagcagaaggcagatgcactgtgtttgggacgtgtgcggtgtttctgcatatgcagtacttgctcagcaaatgtaggaaccactccagcaaatgcatatgaggccaaatgtcccacgtccagttccttaaagcagctccctccaggtctgaggagacaattgctgaaggtgacattggccaaagaagataccgcacgtgccacctcaccttctccattcctccagtgtggtgcttctgtcctatgccagcgttgacggtgccaccatggaaaatggcctgcccatgaaggtggtcttcccaaataatcacttcacctggctttttttgatgctcccagctttttctggtcacttttgtctttcttgagaaggtggaggctcccatcttacttcgtcccagcttccggcatgtttccctttgtttttttttgttttgttttgttttgttttctttttgagatggagtctcgctgtgttgcccaggctggagtgcagtggcgcaatctcatctcactgcaacctctgcctactgggttcaagcaattcttctgccttagcctccagagtagctgggattacaggtgcctgctaccatgtctggctaacttttttttttttttttttttttgggacagagttgggctctgtcgcccaggctggagtgcagtggtgtgatctcagttcatggcaacctctgcttcccgggtcctggttcaagcaattctcctgcctccgcttccctagtagctgggattacaggcacacatcaccatgcccatctaatttttgtgtttttagtagagatggggtttcctcatgttggccaggctggtcttgaactcctgacctcgtgatccgcttgcctcggcttcccaaatcccaaagggctgagattacaggcatgagccaccgcacccggccgcaccctttgatcttgagatggctgatacggcagagcagcccagcagtggatgagtgcttacatttaaaaagttcatgggatttcataaataagctcatgaatgtacaagtccccagtgtaaaggttaccttgactttgaatttttttatcctttctttttttgttttgtgtttgatgcataggacatttatagatggaatatacctttcaggctatttcttcctctccctcccgtcgaaacccacctccctgaaatgcctgctgcctcctcagtgccaaaggactgtcaaagcaaaaatgtaataatggtatcatgttctgtttctttaaggaagtcaaaggtgcaaattacctttgcagcttcagtcttctgatgtctgcaactttgaattccttcaaggaagtgacaatttagatattccatttactctgccccaaaggatggactttgcactatttatcttagccgtctcccactggagccaaaaacatttccaacttcataagtttcactgcttctcctcttttatatattttttcactctttgctgaaaacattttcattgttttttgaaaagtgcattctaatagttaatttgggagcccatggccttaacacagaagaaagaataccgaatacaatgataggatatcaaacagcatggtctcttccttgtgttagagtgtgtaaattcaatacgccgtgttgactcagtattcaggaatgccaaagagagggattatttggtaatgtattttcatggagacccggggacggtgctgtactacagaacacctcactggcccgggctgggtgcaggtaggatggagatagaccggccccacccccttggtaactgctccttgcagatcagctgtttgaagctctccgggcacccaagacgttcttgttcaagcctgtgcgcttcccctgctagttctcatctcccttctctcaacactttttccgtgaccctccctgaaagggagttttgggcttggctcaccctggaaagcagctaatcccacatgttgccaacaggttaatgaaggatgaggctgaaggaggaaaaatttgccaaactcctttcccctaaagagccgccccttcagaaacaccttaaaatccaacctcccgggtcaaagacatttgaaaaaatgacgaagacaacatcaaactatagtctcctgttcaacgcatgttcacttcctaagacattaaagaaaccaggccgggtgtggtggctcatacctgtcatcccagcactgtggaggccgaggcgggaggatcacctgagatcaggagttcaagaccagccttgccaacatggtgaaaccccctctctactaaagatacgaaaaaattagctgggcatagtggcagtcacctctaatcccagctactcaggaggctgaggcagcagaatcacttgaatcagagaggtggaggttgcagtgagctgagatcgcaccactgcactccagcctgggcaacagagcaagattctgtctcaaaaaaaaaacaaaacaaaaaaacaaaacaaaaaaacccaattaacattctttcaccccggatttcctagtctttattttagctataacaagcaaaacacctctttccatccttctaaaggcgtgttcctgaaacctcacttggagagttttacggaagtgcagtgagaggagtaagaaatcctgagcacacagccaactaacgcaggaacagaaaaccaaagaccccatgttctccttcataagtgggagttgaacaatgagaacgcatggacacagggaggggaacatcccacaccagggcctgtcgaggggttgagggggcagggcagggagagcattaggagaaatacctaatgtagatgatgggttgatgggtgcagcaaactgccatggcacgtgtatacctatgtaaccaacctgcacattccgcacatgtgccccagaacttaaagtagaattaaaaaaaagaaacagaaagaaatcctgagcacgtagtaggaaccacggtctgtgatcacgtgcatcgtgcagtctgtgtgtgcacactgggatgtttccagcataaaagctccttcgaaaattcgtttccatcctgacattttaatgcacattttttatgcttatgctattctcagctctcacgtgcaaattacaccagcaggtgccccgggtccctgtcactattgaaaagtagaatgtcaaatgcatttgtactttttgccaatgcaggctaaagaaaatgactcttaaatggatagctttagtctgccaaaatggctgtcaagttagacgctaggataaagggaaagtccatcaaaggcacatttcagatttgtgttatacttctcttaaaacctctttttttttttgcagttaatagtttctggataatcctacaagtcaccgtatcttttttttctttttccttttagctggaaataatgacagcaaagccaaacaagttgtaagcaaaataaaagaagaaaccttgaacgacaaaggtaccgagagatactccaatggcttttttttgtttttttttttccttgggacaggtcgtttgcgtggttcatggctgagcttcagtcacgtgccaggtggcatttgggagagatggctctgatttttgcactcttcttttggggatttctggccccatcctagagcaggagatggtcaaggcaaggcgaagatagcatcactcagctctgacatctgctaggaaaggcatgcagatgtgctggtagcttgcactcttactcaaatgtgtgttccccagggaacaggagccattgtcctttcctgttgacctccagggcacatgccaggaggtgcctctgctggttgggagttcttgacttaagataaatcaggccgggcgcagtggctcgcgcctgtaatcccagcactttgggaggctgaggcgggtggatcacgaggtcaggagttggagaccagcctggccaacatggtgaaacccaatctctactaaaaatacaaaaattagccaggcatggtggcatgtgcctgtaatcccaatgacccaggaggctgaggcaggagaatcgcttgaatctgggactgcctgggagagagagcaagactccgtctcaaaaaaaaaaaagaaagaaagaaaaaaagataaatcaaacaggaatatgcttgcccttaagattttcgaccaggtgctagaccaaattctggtgtgctctttctgtctgttcacactaaggaaggtgtgcacacaactttctaatatccatctagattctcaatgctctgtccttttatttatttattattttatttttcatttgtatacaggtagggagtgcaagtacagttttgttaacatggatgaatggcgtagtggtgaggtctgggcttttagtatagctaacacctgaatcacgtacattgtacccgagaggtaatttctcatcccttgctcctcttccacctcccacccttctgagtctccagtctctgttattccactctttccatgtggacacattatttagctcctgcttataagtaagaatgtaggaggtcggtcagggtggtaggaaaaattgtagaagatgcaaaccttcttgggaggccagaaggttttgcaaatgctcccgaataagatttggctgaaggcagccagattctcttatccagtgcctgaaagcttaggttagataacgaggggatgtaaagaaactgatctagataagttagtttgcttaggcctcagaacctggcctttaatcatccacgcacagaactactctctccctctctccgggttgcgggggacgaccatatgaattgcccacgaatgtgttgactcaaggcctttgtcattaaatgtatactaaataaaggcccacagcagcagcttgtcaaagccgtggctgctgactctttaaaacaccctcctcagtgtctgtgagtggccccatcccctagcccacgctttcactggaaatctgtgtctgagtgcatttgttcatccgtcgctcagccaaagtctgcgagtcggacccagcaaattggactcgacctaagaagaatggtatttgactttcggtttctgagttatgtcccttagggtaatggcctccagttccatctgtgttgctgcaggagataggatttcctcctttttcatggctgcatagtattccatcaggtatagatatatattttctttatgctttcgtgtgttgttggacacctaggttgtttccatatcttggctcctgtgaatagtgctgcaatgcacataggaatgcaggcatctctttgatacactgatttcatttgctttgagtctgtgcctagcagtggaattgctgaattatgtggtgcttttatttttaatgatttgaggaacttctgtactgtttttcatagtgactgtactaattgacattcccaccagtggtgtacaagggcccccttttctctacaccctccccaacacttgtaattaactgtagaaatcatcattctggccagcgtggtggctggcacctgtaatcccagcactttgggaggccgaggcgggtggatcacctgaggtcaggagttcgagaccagcctggctaacatggtgaaacctcgagtctactaaaaatacaaaaattagccgagcgtggtggcaggggcctgtaaccccagctactcaggaggctgaggcaggagaattgcttgaacctgggagttggaggttgcagtgagctgagatcacacctttgcactccagcctgggtgacagagcaagactctgtctcaaagaaaaaaaaaaacaaaaaacaaaaaaacacaaacaaaaacacccttctgacaatatccattttagctggtgtgagatagtagctcatggtggttttcatttgcatttccctgatgattagtgatgttgagtaccttttctttgtttatttttttgtttctttttgagacggagtctcactctgtcacctaggctggaatgcagtggtgcgatctcggctcactgcaacctccggctcccaggttcaagcgattcttctgcctcagcctcctgagtagctgagattacaggcattggcgaccatgcccagctaatttttgtatttttaatagagacggggtttcgccatgttggccaggctggtctcgaactcctgacctcgtgatccgttcgcctcagcctcccaaagtgttgggattacaggcgtgagccactgcacccggccgactaccttttcctataagcaccttttcatatacctgttggccatccaaatgctaagtgcttttctcggccatgtttatgtgtggtaccttattttttttttttttttaaatgcacatcccttccttggctgtttgaatttgagatggtgttttgagaattcccccaagtgggggatgggtgtattttgattctttatttgtttgtttgttttttgatacagggtctcactctgttgcccaggctggagtacagtggtgttatctcggctcactgcaacctccgcctcccaggcccaagtgtttctcctgcctcagcctccccagtagctgggaatacaggtgtgcagcaccacacccagctactctttgtagagttggggttttgccttgttgcccaggttcatcttgaactactgggttcaagcggtccattcacctcggcctcccaaagtgctgggattataggtgtgagccactgtgcctggcctattttgatgatgatgacgattattattaatattttgagacagagtctcactctatcacccaggctggagtgcagcaatgtgatctcggctcactgcaacctctgtggcccgggttcaagcgattctcctgcctcagcctcccgagtagctgggattacaggcgcccacccaccaagcccggctaatttttgtatttttagtagagacggggtttcaccatcttggccaggctggtcttgaactcctgacctcatgatccacccgcctcagcctcccaaagtgctgagatgaccggtgtgagccaccgcgcccggccttgattctttttaaagccatgagagtgaaatgaacgctacacagagctgagcctggtcactgcctatgcccctatctcctcctttctaccctaagctgctgtgaaacaccttgttattacctctgccaagggctggggtatgttgaaatttcatagccggcattgcaggatccctgtgattttcaggaacacactcccacaggggctcccgctcagccagagccaagcccagtgtacaatgtcacagagtggcagcagcctggccagatcttttctcctcattaggatctgccttggggcaaaaggattggtttctgtgtagagggataattaaggaattagagacaccgaggggttgaggaggaattatttaattatttatttgtaccgaccccgtcggattaacatttaaaggaccgagttttgaacaaagagtttggttattttttaagtattttctggggcggggggagctctgtgtagggggaagtatatcatagaagtgagaaacaaagacagttgtttaattgacacatgcattatattattttttattttttaaggaataatatgttttatgatttgagattatttgcctagtgactttgtagctgtatagctagagaagcagagtttttataatgcttgggaaaggaagagacaaggcttattagccgcagaaaaacaggcagttaatttttaatggacttcaactctttctcttcctcagggagaactgggttttcttacatacaactgagtttttgcttatacatttttaaattttttaaaattcctgtttcatctgtgacagggggtcctattccctgccaccttggcccttcctcatttgcagcaggttttcaaaggagtggcattttctaacacaatgaatccaaaagtgccttctccgggcctgtcacatcagcatttccggggagtaaacaagaaatgcaggtgcccagggcccatctgtgaatcggggcctctgggggtgggggcggggccctggaatctgcattcttatgaggccgttaaatgatccccacgcaccttcaaatggtacacttgctgctgtcctgaaggcattcaaccatcaatctggagcccaaagagaagtttctggaaactgacaagtgaggcattcttttctcatgactttttgcttttaatctgaacggcttaaaaactatatatagttccccaaaattcacatatgtgatccacctaaccaaaatgacagccaagaaacaatgatttataatcaccaacttaattttattagattctgaaaatgtttcagatttagacaacatgaattttgaccaataattttttttttttttttttgagacagagtttcactcttgttgcccacgttagaatgcagtggtgtgatctcggctcactgcaacctccgcctcccgggttcaagcgattctcctgcctcagcctcccgagtaactgggatcacagacacccaccaccaggcccggctaattttttgtatttttagtagagatggggtttcaccgtgttagccaggcttgtctcaaactcttgacctcagatatccacccacctcagcctcccaaattgctgggattacaggcgtgagccactgcatctgaccacaataacaaatcattgctgttttcttggaaaagtttgtgtaggatattcgatcatcagtttttaaagtgcagtgttttgtggacaagtagcatgacgaatacatgatttgtccccaccattaaaaaatgttagtttacttgtggcatataaataccgatggcctttaagccaatcttacagaaaagaagaaaagaatcgtttgcactttctgtggctgtttaaaagctttaccatcttgtaagagggtgggaagatggggtgtgccgtggagatggttaatgggcacaaaaatatactttagatagaatgagtaaggtctcgtatttgatagcacaaaagggtgactacagtcaacaatccttcatggtccatttaaaaataactaaaagttgctggacatggtggctcacccctgaatcccagcactttggaaagccgaggcaggtggatgacttgaggtcaggagttcgagaccagcctggccaacatggtgaaaccccgtctctactaaaaacacaaaaattagccgggcgtggtggtgcacacctgtagtcccagctacttgggaggctgaagcaggagaattgcttgaatctgggaggcggaggttgctgtgagctgagattgtgccaccgcactccaacctggactacagagactccatctcaaaaaaaaaaaaaaaaaaaaagaaaccaattaaaggtgtaattggaatgttagtgacacaaacaagtgatgaatgctcgaggggatggataccctatttgccctgatgtgagtattacacattgcatgcctgtatcaaaatacctcattatcccataaatatatacacctactatgtgtgcatgcaatttttttttttaaaagaaaaaagtttaaaatctgaacaggtttggacattcatcagtggtggccctggtatgtccactgctgggggactctccagtccttgatagatgatgctgaggcccagctgggtggggacatttcggctgtggccattgagcctttacctcgactgagtctgcctccaggctcaggagcccccagatccgtggtccagccacacggcagggtctgccctctgcctgtgagtggtatctgctgcccacaacatcttatggacgaccacagctcctacaggcatcccttccctcctcagctgagacctgggcacacctccaccaaacccgtacgaaccttgctctaaattgtgcttctctctggactggcctgcacctgctggaactctgattcttgtccccacaacctccagttgcccagcgagggacagagggagctgaatgtgctgtttcgttcttgctctgctgggatcccggcatcgggtaaccccggttcagccatgtggatttatttttaagcaagtcggctcacgtcctgactccaggagcacagattgctgtggagtgtcagtcacacaattatttcaacatgctgggcgcctgtctagcctgctttcccctcctgcctttcctgctctcaattctctctccttagttcttgggttaatactctggcctgcgtactttgttgtactttctgtctttgaagtcgtgctcctctgagatcccacgctgggcagggcatgggaagctacgtgcccacagaaggacggctaattgagctctcggaattataaatgcgcgattgttttcaggaatctgggcgagatggctcatttcccaagctagggattttccagggaagcgttttcactccttatcatcacttagccattgtgcccacacctttgtggctcctgggtaattatgtgctgatgaaagctgtcttacttagaacaaatagtctcattcacttaccgaaactcctccaaatataaataaatcaaaccccagcggctccatgaaagcaaacacagaaaggcatagccgtgttcaaatgaactcagatggggagagataaccagttaaacactcttaaaagcactgaaggcaggcccattctcttttgcagctcgtacatgccatggtggaacccctgtaatcctaaatcctaagagagatcagactagacacgtgctgtgtatcctctttggaaggtgcacggtgtcctcattttctataatgattgtgtaactttaatcacaaacagcatcttctgattcatttagcttcctggctaggcacgatggctcacgcctgtcatcccagctctttgggaggcctaggcgggcagatagcttgaggtcaggagtttgaaaccagcctggccaacacggtgaaaccccatctctactaaaaatataaatgttagtcaggtatggtggcgggtgcctgtaattccagctactcaggaggctgaggcaggagaatggcttggacccgggaggcggaggtttgcggtgagccgagatcatgccactgcactccggcctgggcgacagagaaaaacttcatctaaaaaaaaaaaaaaaaaaaagcttcccaaatattattcttccagtagcttgtgccgtcttcatcagaagagggactagctgtttggttcatgtgcttccacccagttattagaccaagtttgttttcaataaaagaaatcactggtcaatgccttctgtaattgatgggtgtcaagaaggtaaattttgcacgccgccttgggaggcacttctactttgaaaatagatctttgtgaaccatcattttggcctatccaatgacctataaaatacttgaatttatcatgaaaacagaatactgtgaaatcaggatgaaggttgataacaggtcatcaacgtaattgagtagattgaaaatacaagagtcagtgaagtgtaggatgaatgcttgttgtcagtaagagagctctttgtgacccgttccacgtgcaagagatgagggttgttgttttgggaatactcaccctcctcatcgcctgtccctgctaaaatcagagctttgtgagggcagagatggattctgtgcacaggtatcttctgagtctctgattcagtgcctgaaacacagtggctcccgagacaatctacctcagtgcctgttttacaggctcacctgtgacacatgactgggacatatgttattcatgatgacatgcaagagtctctgtgtaggtgtctactggtcttcatcatcaaacagagcgagaactccaagtcaggaggcagacatatcttggggcaagaagacacctagaatttttcttcaacctgtagactttcggattgggtagaaggattgttaaggaggttgcgaaacttggaaaaaggatgatgtgagtgttgatggcatggaattctccccacacccctgggtatccatttttaatgtacagaattcttgtgacatgattttagggcatagaatccttgagagatcatgtctgtgctgaagttggaatcacagcactttatgtgaatgtgttcgccaacgattaattatgtttattcccgagaagttttaaccagattgtggatgtgtattctggttcagcatatattcacaattacctttgttttttgttttgttgttttggagacaaggtcttgctctgtcacccaggttggagtgcagtggtgtgatcatagctcactgcagcctcaaactcctcagtaggaaacttcctaccccagcctcccgagtagctgggactagtagcatgcaccactacacatggctaattttgttttttaaattttttctagagacggggtctcattatgtcgcccaggctggtctcaaactcctggcctcaggcgatcctcccaccttccaaagtgctgggattacaggtgtaagacaccaagctcagcccctgtgtttttttgtttttttttttttttttgctttttgtttgtttgttttgagacggagtcttgctctgttgcccaggctggagtgcagtggtgcgatcttggctcactgcaacctctgactccctggttcaagccattctcctgcctcagcctcccaagatgctgggattacaggcgtgcaccatcacacccagctaattttttgtatttttagtagagacagggattcaccgtgttagccaggatggtcttgatctcctgactttgtgatctgcctgccttggcctcccgaagtgctgggattacaggcgtgagctatcacgcctggcctgtgttttttttttttttaaacataaaatggcccttattgactgttttccttttcatagtgagtccttttgtttctttcatgttttcgagaagtgtcccgagtcaggctgtagacaggcatatgcgtagataaacagatagactcatgcgttcctgttggtaatttttccttgaggtcaccgtatgtgttctcatgcgtgggcatagatgtcccacactctctgaaagtttaattggtcctcgcaggtctcattgtgttccttctcttcagggctcttcatatctcagggtggtaataaccttccaaatctctatggccgaggcgggcagatcacgagatcaggagatcgagaccatcctggctaacacagtgaaaccccgtctctactaaaagtacaaaaaaaattagctgggcttggtggcgggtgcctgtagtcccagctactcgggaggctgaggtgggagaatggcgtgaacccgggagggggagcttgcagtgagccgagatcgcgccactgcactccagcctgggcgacagagcgagacaccgtctccaaataaataaacaaataaatagaaatacaaaaattagccaggcatggtggcgcatgcctgtaatcccagctactcaggaggctgatgcaggagaattgcttgaacctgggaggcggagttttcagtgagccgagatcgcaccactgcacttcagcctaggtgacacagcgagagtccatctcaaaaaaaaaaaaaaaaaggaatatgcatttaacgtttctttgcgtcttttcgtggctcgatagagcccagtatatattttcactaaagagcaaaagcgcctttccatgggcctttaaatacttaagaataagcacatccacacatgggcctcccagatagtcggtgcgtttccagaaatgacggtgtgttgtggttcacagcctctttgggttttggtctccaactcccagcctcaggcgatcctcctacctgagcctcccaaagtgctgggatgacaggcacagtgagccaccatacccagctattttttgaaaactcatagtctcatatttccctaatatttagggttagggctagagttaggtagaggttagaggtgctctgacgagtgtttcccaagtcttggagcccacctctggccaaatcaccgcctgcagttggaagcaaggctgtttctgagatgagtcatactgacatattttgctattgaatgcacggttgccctgatccattcagagatacttctgcagcaccatgagctccttaatccctgcccctgttcacctacaagggtctgcaagcgagcccccttccgcaactcatctctttgtgtaatccttctccagaccctgaatatatcagcctgttggcatatgtatctatgtgtgtgagatcagcctgttggcatatgtatctatgtgtgtgagatcagcctgttggcatatgtatctatgtgtgtgtgtgtgtgtgtgtgtgcgcgctctgaggatattggcactttttaatcttcttccattagacgacaaggctgagggcttccacttgccgccgacttgccggcacacctggggcatgtttaataagtaattgtgtatggtctgctttgcaaatgcgctacttcacatttttccatcccgcccgtaacgaggactggggttgttttacaagttaattacccaaaagattatcgagtgggtttagaggcacaaattctacgcgctatttaacagataagaattaatgagtgttgttaaaatgggaaaaaaaaaatgtctctgtcagtggagggagttatctctaccctgcctggctgtgttactgttgtttttttttttgtctgtgaatgagaaccgaggtagagaaacaaggcgagtgttctcattgctcttctcccaccagagcacaggcggcacgtgtgaaaataactattcacagtttctttcccaccgtgtctcaagaggggtgaatgccagggtcgggcccggtggctcacgcttggaattccagcactttgggaggctgaggcaagaagattgcttgaggccaggagttcgacagcagtcagggtggcgtagagagactccgtctctacaaaatattaacaaatcagtctggcttggtggggtgcactgtggtcccagctactcgggaggcagaggcaggaggatcgcttgagcccaggacttcaagaccagcctgggcaacatggcaagaccttgtctctacaactaaataaaaaaattagtcaggcgtggtgtgcgtgcctggagtctcagctactcaggaggctgaggcaggaggatcgtttgagcctggaggtcaaggctgtggtgagccatgatcgcgaccctgtactttagcttgggcgacagagcaagacccttttctctaaataaaaatggaataatagtaaaaagaagctgaatttcagctgttttcagccattctctttattccttcaaatgcctctgtattctgcagtatcctttaaaatattaagagcaattttagctaatcaggaggctgagacaggagaatcgcttgaacccaggaggcggaggttgtggtgagccgagatcgtggtattgcgctccggcctgggcaacaagagtgaaactccatctcaaaaaaaaaaaaaaaagggagacacagataaggccatgtggagacagagactggagtgatgcggccatcaacttagggataccaggagctggaagaggcaggaaggatgccccctagagtcttcagaaagtatcagacacctttgggaggccaaggcgggtggattgcttgaggccaggagttcgagaccagcctggccaacatggtgaaacctcatctctactaaaaatacaaaaattagccaggcgtggtggcgggagcctgtcatcccagctcctcgggaggctgaggctggagaatggcttgaacccgggaggctgaggttgcagtgagctgagatattgccaatgcactccagcctgggagacagagcatgattctgtctcaaaaaaaaaaaaaaaaaaaagaaaaagaaagaaagcatcaaacacaattgcaaggggttgaatgctgatctccaaaagatatgtccatgtcctaatccccagaacctgtgaacaggaacttatttggaaatagggtctttgcagatgtaattagttaaggatctcaagatgagatcattctggattagggtgagtcttaaatccaatgatagctgtccttgtaggagacaggagaggagacacagacacagaggagaaggccttgtggagacagaggcagagactggagcgatgcggccacaaacccagggactcctggagcccccaggaactaggagaggcagggaggccccttcctgagagcccccggagggagcatggtcctgagacacctgatctcagacttttggtctccagagccagtagaggatgaattcctgttgaattaagttccccaggtgtggtcatttgtcacagcagcctcgggagacgagtagagacatagatcgggcaggaatagaatatctagttgcattgctgatagaggcatactacagctgtgtgacatggtgtgacatcagcacactgtgtcctgaccccaggtcatgggacaagaacttggggagacatagtcacccccctggctcatcagggaaatgcatggcttccggtaaggtgaccctgaacatgcgtgtgtcactctgaagtgttggcctcagactctgcctccaaattccaagtcccctgggggttccgctggaggtggacacgcccccatccatgccttccttgcagtcacgggaacatcccttactcagtcctctctggtcaccgatggggcatgacaggaggcgctacatgtttccaagcagccggggttccagatgcttggaaattctgcgtgcggcctctctatgggaaaaagggaggtctgccaggagtggaaccccagtgagaaagtaaactcaaaacagaaatgaaaggtttctagacacagtacaagccccctttgtggtgcgcgcagggacttacgtagctcggcccctccaccccctggctggccccagtggccgaggtgtgttgggtgctgatctgtgacaccctcctgcttcacacgggcagggaggggttctggagagagtgcaggtgggctggagagctgagctccctgcagcaggtgagtgtgagtcctgaacagactcgttccaaggaaacaggtgcaggaaagaacacaggtcttggaggaatcagggttgagccagccctgtgacctcgggctgtccttggccccagtgatggcttatctttacctggaacttcaacctcttatcatcacctataacgctgaccactgatcctcacctgggactcgaacctctccccatcacctgtaactcggaccacttgtcctcacctaggactccaacctccctccatcacctgtaatgctgaccactcattgtcacctggaagtccaacctctcatcactacctggaactccaactccaactcttttttttttttttcatgagacggagtctcactgtgttgcccaggctggagtgcagtggcacaatctcggctcacggcaacttccgcctcccaggttcacgccattctcccgcctcagcctactgagtagctgggactacaggcacgtgccaccacgcccatctaatttatgtatttttagtagagatggggtttcaccatgttggccaggacggtctcgatctcttgaccttgtgatctgcccgcctcagcctcccaaagtgctgggattacaggcgtgagccactgtgcccggccccaactccaactcttatcctcatctgtagctctaacctgttatcctcacgtgtaaatgtgatgtcatcctcacctgtagctgtaatctcatcttcacctggcattctgacctcttaccctcacctgtagctctaaccggctatcctcaccgatagctctgacatcatatcacctgtagctgtaacctcgtcctcacctggaactctgacctggctgacgtgcttgcagcatgtgggtggggccgatttccctcctgccccagctccctgctgctgccaagtccaggtctctcctgtggggcaggtatacccctccctgggtctcagctgggcccactggccttcacagggagcctgctgtctgcactcccattcttgtcctgccctctcctccggcgccctgtctgctcagatgtcctcatggcctaggcacctgcagccgccaggacagtgagcccggacacaagcagccttccatccggttccccctgcatctgccaacccatcttgcccacagccaagcttctgtgaaaaatcatagcagtcatgaaactcatgagtgctcgggcaaatcagaaaaattgccagggatcctaccatggacacgcgtccctgaaccccgaatggtccctgtgtgttgtgtgtgcgcaggagacgggcaggtcactgtgtgtcgtgtgtgcaggagacagggaggtccctgggtgttgtgtgcccaggagatggggaggtccctgtgtgtcgtgtgtgcaggagacggggaggtccctgtgtgtcgtgtgtgcaggagacagggaggtccctgggtgttgtgtgcccaggagatggggaggtccctgtgtgtcgtgtgtgcaggagacggggaggtccctgtgtgtcgtgtgtgcgcaggagacagggaggtccctgtgtgtcgtgtgtgcggaggagacggggaggtccctgtgtgtcgtgtgtgcaggagacggggaggtccctgtgtgtcgtgtgtgcagaggagatggggaggtccctgggtgtcctgtgtgcgccggagacagggaggtccctgtgtgtcgtgtgtgcggaggagacggggaggtccctgtgtgtcatgtgtgtgcaggagatggggaggtccctgtgtgtcatgtgtgtgcacaggagatggggaggtccctgtgtgtcatgtgtgcgcaggagatggggaggtcgctgtgtcttgtgtgtgcacaggagatgggaggcgtcaacacacatttcatgctcacatttccattcactgtccacactgcacacttgtacatggtcaatgtctagacatttatagtttgtttatgtgttatattcatctactttatatatattcatattttaggttcatatatttattgtatacacatttatatatttgatctatattaatattttaggtttatatacttactatatatttattattataaagcatatacattaaattataatgtattattatatatgatgtattatgttcaatgtatatattaaatacataatgacataatatgaatttatattataatgtatatacatatgaattcacattcatatgtatgttacattttgtaatgtatatatattttgtaacatatatttgtaatataaaattatatacaagatatactttgatatattttatttatatatttatatataaaacataatataatatgcacaatacattttgtgtatatataaaatatatattacataaatatataatgataactataaattatatttgtgtcattataaataatttatattaaatatttatgctattctataaatagtatatatatttagtatatatttttatatcatactttataataaacacgaatttataatatataagtataaactatagttattggatgtttaattttatgtatatattattttatatatatcatactatgtaacacataatatataataaatataatatataataagcatatatcataatatataatataaataaacattgtaacatataatatataatacatatatatcagtatacaaaatataaaattaatatatacataaaattatatacctacttattttattttattttttaagagacgtgagtcttgctgtgttgcccgggctggctttgcctctggaactcaagcgatcctcccacctcagcctctcgaggagctgggactacaggcgtgcaccatcatttcctcctaaaattgtatgtgctgcatatataaaatgataaatgctttacatatactttatgaaattatatatgctttagataaaagcagaggtttcataaaactgaactgtaacatgcatggcatttaaatcccattgaagtgaagggctgggcttgagggtagcgtcaccctccctgaccgtcatacccatttccatttccccaggaaggaccaggatgctttgtttaagcagcacgtttgaattgctggcattgcctgtggcctccctgtggcgagggatggtgaacgacagcgttttccctcctccttcctcaccttgcaaacctcacttcgttggatgcataattgctgactcatccccatggatcgccttggactgtgtagcaatcactgctcttttcacagtccctcttgaatttctttcctttttttttcttttagtcggaatttcgctctgtcacccaggctggagtgcagtggtgcaatcttggcccactgcaaccttcacctcctggattcaagcaattctcctgcctcagtctccccagtagctgggattacaggtgtgtcccaccacacccagctaatttttgtatttttagtagagatgggaatttcaccatgttggtcaggctggtctcgaactcctgacctcaggtgatctgcccacctcggcctcccaaagtgctgggattacaggagtcctcttgaatttcacttaagatgggctgggtgcttcgtggcaggcttttcacatcagcctttgcatttctgggtgtgacccctgtgtctgctgccttctatattcctctcttacttggcaggattccacccctaggtgggtttattttttcccccagtcccctgcctgcctgagaattcctacctatggctcctcctgggaaagggctcttggctgcgtcttaaatcttgggttatgccttggtgcatactggtgttgcaccagtggtgcaacgttgccggcatcccttttgcctgagggcaggtcacttgtattctgtcttgaaggaacctgacttttaaggagggacgacctggagagtttctttattattgaacttcactgactccctgaggatagactgatcctgccaaattcttgggtccccaataaaacagcattccatgaaataaaaagtaagaacagatggcaccaggaattccactgctgggtatatacctcaaagaattggaaacagggtctccaacagatatttgcacaaaccacgtttgcagcagcagtattacttacaataacccgaaggtggagagaaactgtgtccttccagaagcaaatggataagcagaatgtggtatatccaaacggtggaatattacgcagccataaaaaaggaagggtattcagatgcatgctgcgatgtgggctaaccttgaggacattaatgctaagtgaaataatccaatcctaaaaggtggagagaaactgtgtccctccacaggcagatggataagcaaaatgtggtgtatccaaatgatggaatattacacagccataaaaaaggaaggatattcagatgcatgctgcaatgtgggctaaccttgaggacattaatgctaagtgaaataaaccaatccccaaaggacaaatactgtaggattccactcctatgaggtacacagagtacctttaaatttttagagacagaaagtagaatggggtagttataggggttgggcgaggaaaaggtggggacttaatgtttaatgggaacagagtttccatttggcaagatgaaaatattttggagatgcatggcagtgatggctacataacaatatgaatgtatttaataccactttactgtgtacgtaaaaatggttaaaatgctaaactttatgtgatgtgtatttttccacaattcaaaattataaaaaaaaaaaatgcagctgggcatggtgactcatgcccgtaatcccagcactttgggaggccgaggcgggtggatcacctgaggtcaggagtttgagacgagcctgaccaacatggagaaacctcctactaaaaatacaaaattagccgagtgtggtggtgggcgcctataatcccagctatttgggaggctgagcaggagaatcgcttgaatccgggaggcagaggttgtggtgagctgagatcgcgctattacactccaggatgggcaacaagagcaaagctccattaaaaaaaaaaaaaaaaaaggttaaaatgctaaactttatgttatgtgtatttttccacaattaaaaattattttaaaaatgaggccgggcacggtggttcatgcctgtaatcccagcaatttgggaggctgaggcgggtggatcacttgaggtcgggagttcgagaccaccgtggccgacatggcgaaaccccttctctactaaaaatacaaaaactagcctggcatggtggctcaagcctgtaatcccagctcctcgggaggctgaggcagcagaatcacttgatccccggaggcggaggtcgcagtgagccgagctcatgccactgcactccagcctgggtgacacggcaagaatccatctaaaacaataaaaaaaaaataaaataagtaattgcccttaaattggaaatgctcaacaacccacgtgattctgaatctgaaaaggccagatcagggagatacagagaagaataaataaaacacaaggcaagagaagatttatctctggagcatccttgtgcagctgttggtgagtgactcgtgtgtgtcaattgatcatacactcatgagtggataaaagtacccatgttttaggtcaagaaagactgtgacacacgtgtccagcacgccaagcacacagcccgtggggtgtcatccatgtgctgtgccctccctgtctccctctcccaagctcctgcatggaaacagaggtggacacgaaacctacctacccaccccctcccaggttaccgccatcactttcatcacaaaacagagtctggattcagggattcagcccagggcaggagctcaggtcatcttcctctttcagaagggagatttctgctgcctctggcccagcctttccctctctttccccccatgagctgccattggagcacccacctgggtgcaggtgagagagaggaggaaggagaccaggtgaccccttcctggctggttaccctatgtcccggtaacagacggttagagctgattctcatggcagaagcgtgactgccagagaccacctgcggcgcttctaatgctctggtccgtgtattcgtcttgtagcgttgccgagtgttacagagatccacagaccaggtggtttaaacaaaagatacttattctctcacagctgtagaggctacatgtctgaggtcaccgtgtcggtaggcttgctttctctctggcttgtagacgccgtcttctccctgtgtcctcacagagtccttcctctgtgtgtgtctgtgtcctcatctcttcttatgaaatgtcttagtctatttcaggctgctgtcacagaataccataggctggatgacttacaaacaagacatttattctcccacagtcctggaggctggatgtctgagatcagggtatgggcaaggctgattcctcctgaggtctctctcctggacttggagatgctgtcttctccctgtgtcctcacagagtccttcctctgtctgtgtctgtgtcctcatctcctcttcttatgagatatcttagtccatttcaggctgctatcacagaataccataggctgggtggcttagaaacaatagacattgattctcccacagtactggaggctggacatctgagatcagggtatgggcagggctggttcctcctgaggtctctctgctggacttggagtcaccgtcttctccctgtgtcctcacagggttgtccctctgtgtgtgtctgtgtcctcatctcctcttcttataaggagccagtcccattggatcagcctccccccaaccccctgaaacctcattttaccttaattgcctctttaaagaccccatatccaaatatgatcacattctgaagtcctaggggtgaggatctcaatgtatgaatttgagggggacaaaattcagcccatgacaaccagtgtttctttccaaggggctacctgaaaacgtttctgcaacccccagcaagctggcatcgtctcagcatcttgccatggggttccctccatgcctcccaatggctcctttgagtaagaccaaggacaaacccataccactcccttctcctgttttctctgccctcattgtcccctcaagccctgaggctgatcagtccccacaggaccacagctaccctgtagctatgagcagtggcttcctcaggagtgagccaggctcctgtaccccatgcctccctggcacagaacaagatttaggttctgggggtacctgagggaatcccgttttttttttttttttttttgcaggggagggtggaggctcagagtagggaatttttttttttttccgcctgctgtgaggaaattcacccctgttatctgatccatgcacactctggagctggctgaggtcctaactatttcctctgtaaacttctgcccttggaatgggttctgcgatgattaatacttagagtaaacttgattggattgaaggatgcaaagtattgatcctgggtgtgtctgtgagggtgttgccaaaggacattaacatttgagtccgtgggctgggaaaggcagacccacccttaatcatctgggtggccaccatgtcatcagcaggccagcgaggctagactataagcaggcagaaaaacatgaaaagactagactggtctagcctcccagcctgcatctttctctgtgctggatacttcctgccctggaaaactggactccaagttcttcagctttgggacttgggctggcttccttgcccctcagcctgcagacagtctattgtgggaccttgtgatcgtgtgagttaataccgaataaatgcccctttctatatatctatcctgttagttctgtccctctagagaaccctgaccaatacagggtccgttccttaccccctacatctataaccctgctgcctcagttgatagggaagcagaaagagccgcttttttaatgtttaattttattaagtttgcagtttcccagtgcccaaactcatgttgatttcaaaaactgtccttttaaagcatgtgggcagggtgacaattcatagcaggtgacaaaaatgttttataaataatatccatggaaatggaagctgtcactgtctgcagaatgcagccaaaatattcagaagatttgtatcactctaagttctcgtgctagtaagaaataaaaaagcaaatgatgactgggcctctaagaaataaagtaaaattaggaagcaggagtatgaaaataatgacattgtgcagaaataaatacaaaaggaaagtagcagagaagcaaaaaaaaaaaaaaacaaaaccatcaatagtagtttccttaagaaaaatgaaagaataatatcccaccatttattcatccttcattccacacacaaaagaagcaaggacagattagcatgaattggaacaagaaagaggaaataacatgtaataaaaatatgatttaaacttatgcaaaaaaagtaatttattcttaactcaactaacatatttgattacctcctcctgggcaaaggatgaaaggctgtcttattgcaaaaaattagaattttgctaaattcatgcaaatggaattacagatcacagataaaacaacatgctgaaatttcaaccgtcagaactttccaccaagtgttcctaatgaattcttgaatatctggttgggtgcagtggctcacgcctgtaatcccagcactttgggaggctgagttgggcgggtcacctgaggtccagagttcgagaccagcctggccaacatggtaaaaccctgtctctactaaaaatacaaaaattagctgggtgtggtggcacaggcctgtaatcccagctacttgggaggctgaggcaggagaattgcttgaacctgggaggtggaggttgtagtgagctgaaatcatgccactgcactctagcctggtgacagagcaagactccgtctctctgtctctctctttctttctctctctctctcacacacaaaataaataaataaataaataaataaataaataaataaataattgattatctatatactttttccaaaccatcaaggacaatctagatcaagaatctggaaactgttgaccctggaacatatctgacccttaacttgtttttctcattaaagttttcttgaaacacagccatatacattcatttacttattgcctgtgactgtttttgccttaggtacacaggtttgaagagttgcaacagagaccttatggcccacaaatcctaaggtgtgtagtatttggccatttatccaaaaatctactggctgtactcttcaaagtgaccagagccaccaacctgtgtctgagtaaaccgttttactcccaaatgaacacttttcaaagaagcatcatcggctggttctacttaccaacctaaataaagaaaatctagtttaatcttatccactgaatagacttccaggttaaaaaaaaaattactcctgacttagttgcaactcatccacctgtagaccaaaggatgcttctcattaggtaacagggaagcatttgggataattcaacatccattaattagtaaacctctgaaggaattaatctcataacagcagccggaatgcaggagatgctctacacccgaatcacaaattgaatggatggcaagtggattttccctcctaaggctgattgattggttctggctgccagcaccctgagataagaatgatcctgcagcaaggaatagtcatcaattagtgatgcctgctgtggctatggaatgagaattacggtctgtgtgctacattctttccattcttggtggttctctcataaaccacaataaagcatgcatcttttaaagcaaccatgaccatcactagccaccaccatagccctctggctgattcatggatgaatttccaaattcaaatgtgaatttccagtgtcacatttgtgttcctttccctaaatgatgatgatggtgatgatggtgatggtaatgatggtacttgttggatgtgtgtatgtatgtatacacacacacacatatatatacacatacacacacacacacacacacacacacatatatatttgagatggagtctcactctgtcgccaggctggagtgcagtggcacaatcttggctcactacaacctccgccttccaggctcaagcgattctcctgcctcagcctcccgagcagctgggactacaggtgcgcagcaaatgtatatatatatatttttttttctttttttttttaaatttatttattttttattattatactttaagttttagggtacatgtgcacattgtgcaggttagttacatacgtatacatgtgccatgccggtgtgctgcacccaccaactggtcatccagcattaggtatatctcccaatgccatcccccccctccccccaccccacaacagtccgcagagtgtgatgttccccttcctgtgtccacgtgatcccattgttcaattttaaatacaaccaaataagcttgcttcttgcctgtgtggaatttatagtccagctggagtgaggaattaaataatcatccacttatctgagtgagcaaaattatgataaacactcttaaaaagtgtcctttaacagctgtcttgaaagattcaattccatcctctcatgaggttccaccctctgggtttgctttctccaagacctaccctcctgtgtggcttctttcttgactgtttcttttatgctgcctttcctcagcgtttcctcgtagcatctcacactacacacctttccttaggtcttgcaaccacgtccgtgttctccaaaactctgctctgctagttctcaccaatatatttgtttccaaactcctgcctcctacacctccctgcttccacagcaagtgcaggaatgtatttgacattttccttctctctgtgtaagtcagtggactaccatcctctcagctgcctacagtcgatcctagagtgtctgagatgcttttctccaccttggcattcctctccctggtggcaactgagagctctgtagaccacctacatgcttatcaaaaacactccgtcattttcggtatcactccctacagcaggtcacacctatcccttacctgcttcataactctgcttcctggctagtctctcggcttccaggtttccctccctgaactgtctacactgcagtcagagagatcctgctgagtcacactgttgtcttaacctgcttaaacccatatgggcagaatgcccttcatgcctccacctgtttgctgtagctgtgcacatgtggttcctggttcttgagaattcttcccctcctctgcctcctgaccatccaagtccctttcatgctagtcttctcagcttttatagcatgctgtaaagcagttgtcctgaagccaggtgccttacaactccctgctcccttgggacacttaatcccttctatcgccaacctcacacattgtatcgttggttgtttaattgtgtcactgatttccccagccccatgatggtccatggaacatcactgggatataaaaagtactggccaaaggaataaaatacaggaaaatattttgtgcattgtgggatctcatgaatgacagctgccacaatgatgatgttgatgataatggtgattctgatggtgatgatggttgtgatgatggtggtagtgatgatggcaatgatgatgacagtggtaatggtgatgatggtgataattatggtgatggtgatatagtaatgactgtgatgatggtgatgatgatgatgatggtgatgatcatgacgatggtgatgatggtgatgataatgattatgctgctgctgctgatgtgataatgatgatggtgatggtgatgatggtgtttatgatggtgatgatagtgatgatgaaaatattggtgttgatgatgctgatgctgatggtgatgatgatggggtgatagaaatgataatgatgatggtgatgaggatggtgatagtgatggtcatggtcatgtgatgatgatgatggtcagtgatgatgatggtcatgatggtgatgacaatggtggtggtgatagaaataatgatgatggtgatggtggtgatgctgctgctgctgatgatggtgatggtggtgatgatgatgatggtgatagtggtggtaatagaaatgataatgatgttggtgatggtgatgatgctgctgatgatggtgatgatggtgatggtgatgatagaaatgataatgatggtgatgatggtcatgctgctgctgctgctaatgatggtgatgatggtgatggtggtgatgatgatgatgatagtgatgatgatggtgataatgatgatggcgatgatgatggtgatgatggtggtgatgacggtgatggtgatgatgatggtgatgatggtgatggtgatgatgatgatgatgatagtgatgatgatggcgatgatgatggtgatgatggtggtgatgatggtgatggtgatgatggtgatgatggtgatggtgatgatgatggtgatgatggtggtgatgatggtgatggtgatgatggtgatgatggtggtgatgatggtgatggtgatgatggtgatgatgatggtgatggtgatgatgatgatggtgatggtgatgatgatgatggtgatgatggtagtgatgatggtggtgatggtgatgatggtaatgatgatggtggtggctatgatgttggtgatggtggtgatagtgatgattatgaaaatggtaatgattgctgttcatggattctgtgaaagaaccaaccccttttcctgaaacaatcttgctctacttgactatctgtggactgttctgtgtccttcctcccaagtctctgtggcttgcatgtcctccttctggtgggtaggttggccaagtctgacaccctcaactctgccctccttccatagctaacaacagccctaatatccgaagactcagggattctgctgtcagctcccttggctcagccaagcaaagactgtgcttgtgggagcccagaaagagggaatggaatacttctccagagagtaggtgttgcatttctgaatattgtaattaagccagatgagtctaggcaggcccacaggacctcttcaggcatcttcttgtccatgttttgcactatgcaggagaagtgatgctgtcagccatgcaagccatggccccccatacagcagactctcctacgaagccatgtagcttgcaaacaatgccatgttttagtttcatgttacccctcctgcagatttgcacatctaggctctgcttttaaaataatcatgcacctgtcaggctggaagttttcaggaaaatccttctcacctcatgtgtgttgctggctttttttttttttttttttttttggttgtggcttcctgagaacggggatgctacagcctgccactgttggaacaaaggtgcttttagtcactctacctgtcgctcttagggaacgtacgtgccctcaggggaaataggcggatgcacattttgcttctggctcttttgcctctttatttttttcatttttatttttttgaggcagagtttccctcttgttgcccaggctggagtgcaatggtgtgatctcggctcaccacaacctctgccctctgggttcaagcgattctcctgcctcagcctcctgagtagctgggattacaggcatgcgccaccatgcccagctaattttgtatttttagtatagacggggtttctccctgttggtcaggctcacacttctggaggctagaagtccaagatcaaagcatgccacgttcagtgtctggtgaggacctgcttcctggttcacagacggtgccttctcactcttgtcatcacgtggcagaagggtcgagggagctctctggggtcccttttagaaggacactcatctcattcctgaggccccaccctcatgacctcatcacgtcttaaagggctccacctcttaacactatcaccttgtaggttatgtctcaagacagggatctggggccgggtgtggtggctcacgcctgtaatcccagcactttaggaggctgaggcaggcggatcacctgaggtcaggagttcgaggccagcctggccaacatggtgaaaccctgtctctactaaaaatacaaaaattagccgggtgtggtggtgcacacctgtaatcccaagctactcaggaagctgaggcaggagaatcgcttgaacctcggaggcggaggttgcagtgagccgagatcacaccactgcactccagcctggcgactgtgtgagactccgtctcaaaaaacaaaacaaaacaaaaaagcaaaagcaaaaacaaaacaaaacaataaccaaaaaatggggatttcgagaggacacagacattgaaaccatagcacatggcgaccttgagtctttgagtttacgtgtgcagcatgaatgctcggtggtgatggatgaagagagagcaaggggggaatgccacacacttctaaactgtcagacctcgtgagaactcactcactatcatgagaacagcaagggggaaatccgccaccatgatccaatcacctcccaccaggtccctccctcaacgctgggaattacaattcaacgtgagatttggatggggacacagagccaaaccataacagcagcaatagtaaactcatacatcatatctatacatctctcctgaaccatccctgctagactcagtaggacctgtagagaccatctttccctgtattccttcaacatcctgcttccttatcatatgtttctaaggttgtatagttccatgagagattacagctacttttttttttttaagacatctcatcctgcaatgcagtcttttttttttttttttttttttttttgagacggagtcttgctctgtagcccaggctggagtgcagtggcatgatctcagctcactgcaacctccgcctcctgggtcccggttcaagcaattctcctgcctcagcctcccgagtagctgggattatggggacgtgccaccatgcacagctaagctctgtatttttagtagagacagggtttcaccatgttggccaggctggtcttggactcctgacctcatggtttgcccgcctcggcctcccgaagtgctgggattacaggtgtgagcgaatgggcccggccaatgcaatcttttagcaggaaatccatccaggattttggaatcaacagaaaagaaaaaccttgggttttggagtctcagattctggcggtcctgctagatgtgttgacgagtgtgttgggccagttaattaccctcataattgttctaattgcttttatcctgcaaatatccctctgtgttcattagctttgccattacgactgagcccaagtggattaaagaaagcctgtgatgccaccagacatcatttttgtttcggcaaaacagctttctctaggaatctggccttaatgtgttttggatgccccccacactgacagggtccttcatgagctctcctggatagaataacacaaaaaactcaaagcccattttaagaaacagcagcatcattaaaaaaaaaaaaaaaaaaaaaaaacctccactgccagcccacaggtcgctcattttcttcctagaaataaattccagttgagtggacacgtcttttacgggggaatttcagtcgtgattgatcatccgttgacctgtttaaaatgattgtcaagtgactgggctatcctcattcacagataactcaggcaggctcagattaattaacccttcgtttgtttgccatgtaggactaattagtcatcatccatctactgggaatcagacgtcattggcacagttatcaaggacagggactttgccggcttatcatgtagaaggaagaattaatggtgttggtgatatatggtcttgtgtagtggtagggtattcctctccctcttttcttcatgttcttctttctttgcttgccacacattcatttacaggggactctgaagccacgtgagggttaggggcacgtgaagaccttgtgtaactcttcactcccccaaaacttaactaatagcttgctgttggctggaagcctttcctgcaactagacggtcccatctaggggtaatgggagacagtgacagatcatgaggcaggtcattattgcaccagacacaaataatatagtaatattcttacaataaagtaagccaaaggccgggcgcggtggctcacgcctgtaatcctaacactttgggaggttgaggcaggcgaatcacctgaggttgggagttcgtgaccagcctgaccatcatggggctaccccgtctgtactaaaaatacaaaaaagtagccaggcgtggtggtgcgcacctgcaatcccagctactcggggggctgaggtaggagaatcacttgaacctgggaggtggaggttgcagtgagccgagatcgcaccactgcactccagcctgggtgacaagagcacaactctgtctcaaaaaaaaaattaatcaagagaaaaaaatatagtatgtattatatactatattcttacaatgaagtaacctagagaaaaatatagtaaatattctatattatattcttacaataaagtaagctgtgattttccttaagaaaatcgtaaggatgagaaaatatctttactgtttatcaggtggaagtggctcatgataaatgtcttcatcctcgtcatcttgacgttgaggaggaggaggaagagaagggggtgtctcgggtggcagaggcagaagaaaatccacatataaggggacacccattcaattcaagcccgtggtgttcaagggtccactgtcataggggaggctcaatattttagtttcctggagctgctgcgacacaattctacaaaccagctggctgaaagccacagaagtcaaatctctgacagctctgaacaccagaagtccacagccaaggcaggctgaccacctggtcatccaagggcagagcccgtgtcaaaggacattcctggagcagaaagccaacacatccgggtggaaatacaaccttccagtcactaagtatatttgcaaatctccagcaggtcactattgcaccagacacaaagaataagcgttcagtaagttgaagtattgtgtgcacacggccgggcgcagtggctcatgcctgttatcccagcactttgggaggccgaggcaggcggatcacgaggtcaagagatcgaggccatcctggccaacatggtgaaactccatctctactaaacatacaaaaaattagccgggtgtggtggcacgcacctgtagtcccagctactcaggaggctgaggcaggagaatcacttgaacccgggaggcggaggttgcagtgagctgagatcatgccactgcactccagcctggcgacagagcaagactctgtctcaaaaaaaaaaaaaaagtattgtgtgcacactgcaattatgaaatgcatttcattctggagtattaaggcagggctgtgccccttgcggaggctctggaggaggatcctccgctatctcttctggcttccttcgctagctagcaatcctggttgtttcttgtcctgtagaacagaggactccaaccccctggctgtggactggtactgagcaaagcttcatgtgtgttcacagccacttcccactgcacgcattaccgcctgaggtcacctcctgtcagatcagcagtggcattagattatcagaagattgagaaccctattgggaagtgggcagaccagggatctgggttgcatgcttcttatgagaatctaatgcctgatgatctgccactgtctcccatcaccccccggatgggaccatctagttgcaggaaaacaagtttggggctcccactgagtctacatggcaatgagttgtattgtagaattacttcatttaacgtatcatcatagaaataaagtgcacaataaatgtcatacgctcaaatcatccccagatccttccccctgcactcacagtgactgtctttctatgaagacagtttttgtgtgtgtgtggaaaaattgtgttccatgaaactagtctctgtgccagaaaggctggggacggctggtgtagaagcatcaatacagtatctgcctttgtcgtggccatctctgtgtctctatgccacagtgttcctcttctccttttttttttttgagatagagtttttgctcttgtcacccaggctggagtgcagtggtgtgatctcggctcactgcaacttctgcctcccgggttcaagtgattctcctgccttagcctcctgagtagctgggactacaggtgtgcaccaccgtgcccggctaatttttgtatttttagtagagacagggtttcaccatgttgggcaggatggtctcagtctcctgacctcaagatctgcctgcctcagcctcccaaagtgctgggatgacaggcgtgagccactatacccggcctccaatgttccttttcttataaggacaccagttattcagttaacagcgtacactactctaatgcaacctaattgtatgcaatgacaacctagttgtatgcaatgacactactctagtgcaacctaattgtatgcaaagatctgatatccaagtgagctttcattcctaggttctgggtggacacatcttggtgaggtcacagttaaacccacgtcacccaaggctaggggcagaatcagagtggatgttagatctccaggctcttgttctgggagtgtcattcaaagcctttcttcatggccacctgaatgacgatgtcatcctctgtgggtaacagacaccagcattgtgaatgatgctggcttcctttgctggtttctttctgacatttcccttttgtgctttcgtttatggcaagtgtagacatacatgcacactcagacacatacacacacgcacacatgcactcttgccatctacaatgcctcagatccgtactgcaattggccccagccaccctgtagaatttagatttagcgaaaaaagacttcacgtgttcgccaaattctgcgtttcctcctgagtcagaggcacctgcaatgcaggcagcgggaagttgttcttctaccagaacaagagcccctaggaaaattgccccttttattactgttttggtcaaaatatggcaacaacattggtgactccaggcgagttagtaaaaatcacagagaggcacattttgtgtccggggaatgctgggatgctcctaaaacccactgagccggccgggtgcagtggctccagcctgtcatcccagcactttgggaggccgaggcaggtggatcacgaggtcaggagatcgagaccagcttggccaacatggtgaaaccccgtctctactaaaaatacaaaaattagccaggcgtgggggtgcacgcctgtagtcgtagctactgaggaggctgaggcaggagaatcacttgaacctaggaggcggacgttgcagtgagccgagatcgcactactgccctccagcttggcgacagagtgagactctgtctcaaaaaccaaccaaccagccaaccaaccaaccaaccgaccaaccaaccaaccatcccatcgagccgttctcttgctgactcaagagagaataaatcaagaaacaaacacacaaggaaaccaaaacaaccctgtagctgaggattctcccctaggaggaagaaaacgggcatccacacggcgtgtgcccagctaaatataaactgcgaggggaagggaggagacagtgatgacaagccccagccttttccacaagaagaaaaaggtttaagttttcaatgctgcccatgatatccaagaacgaaccgcatttcacagccgcggtgtgcataccatactttcacttatcggaagctcattcattgtgtgatgtgcactaattacccgctggagatttgagaacgcacctgctgactgggagggcgtattcccacctgatgtggttgctttctgcactccagaaattccctttgagatgggctccatccttccatgacagcgtgaccgcttgtcctgtagtcacagtgttgtctgaagaatgcaggatagtttattttcatttttgtttatttatgtttctgttttagaggcaggttcttgctctgttgcccaggctggagtgtagtggtgctatctggctcactgcagcctctacctcttggactcaagcgatcctcccacctcagcctcctatgtagctgagactacacatacatgccaccaacacccagctatttttattttttatagagacagggtctcactatcttgccctgggtggtcttgaactccagggctcaagggatccttccaccacggcctcccaaagtgctgggattacaggactgaacctggccttgctgtggtctgtttcgagaagactttgtttttcgttttttgttttttggtttttttgagatggagtctcgctgttgtcacccgggctagagtgcaatggcgtgatctcggctcactgcaacctccgcctcccgggttccagcaattctcctgccttagcctcccaagtagctgggattacaggcatgtaccactatgcctggctaatttttgtatttttagtagagatggggtttctccatgttggtcaggctggcctcgaactcccgacctcaggtgatttgcctgcctcggcctcccaaagtgctgggattacaggcgtgagtcactgtgcccggctgctcacccagctatttttattttttggatggggtctcactatgttgccctgggtggtcttgaactcctgagctcaaggaatcttcccaccacggcctcccaaagtgctgggattacagccctgagcctggcctcactgtggtctgttttgagaagcctttgtttttaaacagaaccacatgttggtatttcagagccaactcttctgtcaagaatccaaatcagccaggcacggtggcatgcctgtgtagtcccagcaattccagaggctgagacagaaggatcatatgagcccaggagtttgagatcagactgggcaacatagtgagactccatttctttagaacaatactaatcacatgagggtggtaggccattgcctgggctggacaggtgagtagagggcaggtgtgcaggtgcagaggtctttttttgtcctcattccatgcacgactgtttctcaaacttgctatgctaagatgctacaggaacttactttacgtcacaatatcattgaccttttttcttccttcctgtggcttcctcttcccccactctctcacctgtgtgccctattttggataaccctcctcctgggttcctttctcaccatctcctgctgtcaacatctcacctctatttcctggccggatgatgcctcctccaggaagcctgcctaggtttcctgttggcttgcaaactctatgtgggtgcgaactgtccacaccgcgtcaggtacgcaggggcccttgaagtatcacacgttggcagctcagccctgaaaacttcagctccagatacaacaaccccttccccttttctccaacctgataatttataactccagggtgactcggttcagcggcactgcagtccctcagctcttccttgcagcagccgtggtttccatgggatgtagagggttatcctgcttggaaagcattagagctgggggactagagaccccctaattctggcgtggggagaatggaggccccagaggaaatggagcaggtgttttagtggaaaagctggttttgaaattccagcctcgcctcagaacacagcatagcttccctagatgatgtttcttttgaaaggtctcctctgaaaagagtgtgaggattctggcaaacttgcaacaatctctgtaacgatgggatggctgtgtccccacccacatggcacctggaattgtaatgattcccacctgtgaagggtggggccaggtggaggaaattgaatcatgggcgcggtgacccgcatactgttctcgtggtagtgagtgtgttctcacgagatctgatgttttataaatggaagttcccctacaggagccattttgcctgccgccgtggaagatatggttttcgtcttccgtcgtgattgtgaggcctccccaaccccgtggaactgtgagtccattaaagctctttttctttataaattaccccgtctcgggtatgtctatcagcagcgtgagaatgaactaatacagatgcaaagtagagccgcggtttatgagccacaagaaataccaacccccagccaggcgcggtggctgacgcctgtaatcccagcactttgggaggccgagaccggcggatcacctgaggttaggggttcgagaccagcctcgccaacatgatgaaaccccgtctctctactaaaaatacaaaaaattagccgggcagggtggcgggtgcctgtaatcccagctactcgggaggctgaggcaggagcatcgcttgaacccgggaggcggaggttgcagtgagccgaggttgcgccattgcactccagcctgggcaacaagaggaaaactccgtctcaaaaaaaaaaaaacaaagaaggaaaagaaaagaaataccaacctctccctttcaaacctaaaaccccaacatgctggatgctctagggggtctctggggcttcgctgcttacgtttgcccttgttgggtcctgggtttttatactcaacgggatcctggaatttatgtttcatttgtgattcggttccaatttgacacaactgcctgccttcccccagcggttcgtgtgatagacacactcacgctgtcaatcatggagctgtggggcgcgtctgggagatctatagcaaaactccatccactccggttcccttgtataatacaaaagggttttatcagtcatgtatttcgcctcaaaactagaagcatggatttcccaacccgattcaccattaaaattgtgaatttttctggttctggtaaggatacgttgactgtataatggattacataacagtgtgttttcttcaccttagtaagtagccctgggagtttgtagcaaagaaagaagaaacccgagcctcaagaaaatttctccgacgatggtgcccagaacaggggtcaggggtcacgtgtgatgcgcgaaaattaaataagtgataattaagggaaaagaaaaactcagtgcctcattgcactaactgtctggcaagcgcccagtgtccagctgtggacagcacagttgtctggggcagggaagatatggactttcctgcagagagtgctactctgcagcagtgaggtacacctttcagggatgtcccatgatggtgacagagacaccagatacacaggtagcaacagtttcatttgaaaagatcattcccacagatgggagcttttgcaataagaggaggagggactactgtaatgggaggaggaggggctgtgataatgggaggaggaggggctgtgataatgggaggaggaggggcggtgataatgggaggaggagggactatggtaaggggaggagtgtggactatggtaacgggaggaggaaggactggtaacagaaggagggactctgctaatgggaggaggtactatggtaatggaaggagggactatggtaacagaaggacggactatggtaacggaggaggggctgtggtaacggggagggtctacggtaacgggaggaggagggtctatggtaacgaggagggactatagtaacgaaaggagggtctgtggtaacagaaggagggactatggtaatgtgagaaggggggactgtggtaacggagggtctatagtaatgggaggagggactatggtaacggaaggagggactatagtaacgggaggagggtctatggtaatggaggagggactatggtaacagaagtagaagggtctatggtaatggaggagggactatggtaatggggagggactacggtaacgggagaagggactgtggtaacggaggagggtctatggtaacggaaggagggactacggtaatggaggaggggggactatggtaatggcggggagggattatggtaataggggaggaactattgtaacaagaggaggagggactaatgcaaccactggtggacgctgcctatagcaccatgaagcacacccgagcagtgacatctgggagcctcttggagcgcaggcagcataccattttcttttctagggacaggcacgtgatgctcggaacaaccgtgattggggtcgttcgatgtggggttcagtcatggataaaagctgccaaaccctgtggctgcatagctaattttgagcaggtcctaaggaagcgttgcttgatcctctgacgtttgctccaggtgaggctggcccaacatcccggggcctgataggaggagagaaacccaaccaaaatgtgatcacgttagatgggaattttgttcaggtcaaggaagacgaggaattcagtccatccctgaaggggcaaataaagaatgtgaatttggaggatgtggccagccttgtcctaggctgacttggaagcatctgtgagtaatgaggaagggaattttttttttttttttttcagtaaaaccattttctggaagacaaaggcagtggggaattcttaaccttcacagattcccaacagcacagttgtgtggaatgatggactgattgtgtctccgtaaaatacaaagccctcagctgggcgcggtggctcagactgtcatcccagcactttgggatgccgaggcgggtggatcacctgaggtcaggactttgagaccagcctgaccaacatggtgaaaccccatctctactaaaactacaaaaattagccgggcatggtggcgggtgcctgtaatcccagctactggggaggctgaggcaggagaatcgcttgaacccaggaggcggaggttgcagtgagccgagattgcgccactgcactccagcctgggagacagagtgagactctgtttcaaaaaaaaagacgaactgggactcctcaaactgggggaatggtgcatttgtagacaaaactcatggtgtgccatctgcaggtgtcattgtcaggaaggtgagcttggttcatctgtgcccacttgcaagctctttggagagtgaggagcaggttgggaagcatctatcctcagtcatgaacccggagctcctgctggaaaagacagccttggggtctctgtcatgcacatttcagtaggggagtccgggccgggcacaggggctcatgcctgtaatcccagcactttggaaggctaaggcgggcagatcacttgatgtcaggagtttgagaccagcctgaccaacatggtgaaacccgtctctactaaaatacaaaaaatagctggggctgggtgctgtggcttaggcctgtaatcccagcacttggggaggccgaagtgggtggattacttgaggtcaggtgttcgagaccagcctggccaacatggtgaaaccccgtctctactaaaaatagaaaaaattagccccggctaattttggtggtgtgagcctgtagtcccagctacttaggaggctgaggcaggggaatcgtttgaacctgggagatggaggttgcagtgagctgagatcgtgccactgcactccagcctgggtgacagggcgagactctgtctccaaaaagaaaaacaaacaaaaaaaaacaaaaactaaacacataggagagtcccttagcccctcacgaatactccacacacacatctagtccagctgcatcttgttgactcacaagacatcaagataagcctgattcaatgaagttcttcaaaatcagagttcatttgctcattttcttttcttctctccaccaattagtggtgagagtttcgcctgaatcacagtacctgctgtctccagttctgatgttggtatcacccatcttcagacaagatttcttgtgttatttccacatcagcttagccactgtctctcaacatgaaatgctggctggggggaagtttcaaccgcagaagcaaagctcttaaactcattgaaaagacaagctctttcccccttggtagggtcacgaaggctcctcagtgaagggtgtggtaggtttgcttctatagggtagaaatgagacaccctgaaaatcaggaggctttcattggcttttaatttacacagaaggcaatgtgtagtttcaaaatattcttttttatttacttatttacttttatttatttatttgagatggagtcttgctctttcgcccaggctggagtgcagtggtgcgatctcggctcactgcaagctccacctcccgggttatttatttttttgagacagagtcttgttctgttgcccaggctggagttcagtggcacaatcttggctcactgcaacctccgcctcccaggttcaagtgattctcctgcctcagcctcctgagtagctgggattacaggcacctgtcaccatgcctggctaatttttgtatttttagtagagacggggttttgacatgttggccaggctggtcttgaactcctgacctcaagtgatccgccctccttggcctcccaaactgctgggattacaggcgtgagcttccgcgcctggcctcaaaatattcttaatgagtaaatacccgtaagcatttgaatacaaccatttatgttttttgttgtttagcaattgtttgaacttcaatgtgcctcataaaaatgtttcattataaaacatttcacacatttgaaagacgcagagaataatttgaacagcatttgtgtacccaccatccagttgtatcaaatcgtaatgttttgccaaattagttataaattacgtatgtgacttgggtacccctctccaattattttgttattacataaaaaatgactttataacatgggtcaataggagaccttttttcttttttttttttttgagacagagtcttattctgttgcccaggctggagttcagtgccacaatcttggctcactgcaacctctgcctcccaggttcaagtgattctcctgcctcagcctcctgagtagctgggattacaggcacacggcaccacgcccggctaatttttgtatttttagtagagatggggttttgacatgttggccaggctggtcttgaactcctgacctcaagtgatccaccctcctcggcctcccaaagtgctgggattacaggtgtgagcctccgtgcctggcctcaaaatattcttaatgagtaaatacccgtaagcatttgaatacaaccatttatctttttcattgtttagcagttgtttgaacttcaatgtgccttctaaaaatgtttcattataaaacatttcacacatttgaaagacgcagagaataatttgaacagcatttgtgtacccaccatccagttgtatcaaatcataatgttttgctaaattagttataaattatgtatgtgtctttgtgtgcctgagtgtacatgaaataagacatttcagagactattgtgctcttgggtacgcctctccaattattttgttattacataaaaaatgactttataacttaggtcaataggagacatttaaaatattattttccatgcatctttgtccttgtttattttctctagaaaagaaaaatgtatttccctgttcttattttcaattcccaaatgaagcttcaatgtaaaactaattttctgagaatgtagcatcgttcttttttttttttcttttttctttttttttttgagacagtcttgctctatctcccaggctggagtgcagtggcacaagcttggctcactgcatcctctgcctcccaggttcaagcgattctcttgcctcagcctcctgagttgctgggattacaggcacctaccaccacgcgtggctaatttttgtatttttagtagagacgggatttcaccatgttggtcaggctggtcttgaactcctgactttgtgatccgcccacctcagcctcccaaagtgctgggattataggtgtgagccactgcgcccggctagcatctctctgtatttgctgaagccatgtgtgctgtgaagattgtagttttagccattgtggttcctcttgaaagggggccctatatcttcctgatggggaatggcttaactgaagcctggggaatggctggtgttcgtgaaatggctgcattcagatgagaaaccgcacatacacatcctcacaaagtctcagagtcagctttccagggggctgggttttattccggtgcaaaggagtgagaatattgtacacacgaatgatccatggtggctcctgcctgtaatcccagcacttttgggaggccaaggcgggagcatcacttgagcccaggaatttgagactagcctgggcaacatagcaagatctcgtctctacaggaaaaaaaaaaaaaattatccgggtatgatggcatatgcttctggtctccctctcaagatgctgaggcaggaggattgcttgagcccaggaggtggaggctgcagtgagctgtgactgctccactgctcttcagcctggctgatggaatgagacagtgtcacagaaaaagaatgagaaaaataagcccaggatgcagcaaagaatgctatcctttatttattaaccccctaccctggttgtatattgatggtcatttaaatattagagggtataaaaatacaatttccaagaattacctgaactattttctttttcttttcttttctttttttttttgagactgagtttcgctcttgttgcccaggctggagtgcagtggcgtggtctcggctcaccgtagcctccacctctgggttcaagtaattcttctgtgtcagcctcccgagtagctgggattacagccatgcccaaccactcctggctagttttgtatttttagtagagatggggttttactaggttggccaggctggtctcaaattcctgacctcagatgatccacctgcctcggcctcccaaagtgctgggattaaaggtgtgtgccaccacacccggcctattttcttagaattaatattttatcctctgccatcagccgtcgtaggggtatgagcagtttcctgcctattgtaagggtttagagaagggtttgtgataaattggccgtgtggtgaagagattcccattcgggaaagacattgggcagagggtaggatgtcatgtgaagacagcattcatttcaggcagggagagggggttcatagaacgctagtgttcagtgaactgttcctagaactagttcatatgtatacatgtgccatggtggtttgctacacctatcaacccgtcatctaggttttaagcccagcatgcattaggtatttgtcctaatgctctccctccccttgccccccacctcccgacaggccccggtgttcacagagctctagtatccacccaaggctcaccaaaggcagtcaccctttgctatggtggagtatcctgggagccataggtatccctgagctacctcaggttaaagactgcatacctgtgaaagcatgtgaggatttacccatttctgtgtattttgaggaaatctcacttccatcttcagagcttggtagccccaaggtaaaattttaagaagtaaagagattgtaagtttgcatattctgggaggtgatatgaggacaagctcttaggatgaactctctaggcatacaggagaaagaagtaaaggtcaaagcaaagtggcatcaaaaaggccaaaacctggccaggcacggtggctcacacctgtaatcccagcactttgggaggccgagatgggtggatcatttgtggtcaggagttcgagaccagcctggccaacatggtgaaaccctgcctctactaaaaatacaaaaatcagccaggcgtggtggtggctgcctgtagtcacagctaccagggaggctgaggcaggagaatttatttaagttccttgtagattctggacattagacctttgtcagatgaatagattgcaaaaattttctcccattctgtaggttacctgtttgctctgatgatagtttcttttgctgtgcagaagctctttagtttaatgagatctcatttgtcaatttttgaggcaggcattgttattaccccaatttcataaatgaggaaatgacagacagatagatagatagatagatatgccagttgtccctgaggaggcgaaattttgctcagttgaaaaccactgtgatatagatagatgatggatacatagatagatattagttagacagaaaatagctagatagataatagctagatagatagtaatggtcaatgatagattgtgatcaatgataggtaatagatgacaggtagataaatgatcgatggtcaatagatgataggtagatgatagacagtagatagagagtaaacagatgctatataatgatcaaagatagataaatgatagataaatatgtacttgatagataataaatggtaaatagataaatgatggtagataagtagatgatagatgataaatggtaaatagataaatgatggtagatagataagtagatgcttgattgtaaatggtaaatagataaatgatagacggtagataagtaggtgataggtggtaaataggtcgatagatattctataaatagttgatagataaatggtaggtgatagatgataggaagtgagttggatgataggcacacagacaaatggatcacatatgcatacaatctgtcatgctaaggcaggctttgtcaaccttggcagtatgtccatctggagctggatgattctctgtggtgaggccatgctgtggactgtagcgtgttgagcaggatccctgggctccacccacttgacatggatgtacccactataccccccaccgcagttataacaaccaaaaatacctccagacatttctatatgttcctgggggagggggaaacaaaaaggcctccaatggaaaaccactgatgtagatccctacagatgccagcccagttctgtggggatgtgcctactaccattcaatggcagtaacctggacctaagaccagtatgctctctgaggctctggaaagggactcccagcctcgcatcttgaggagagcttagacatcctacgtagcattatgattcccctccaaacatggctgtgctgtgtggatcaggggtctcctcccttatctcctccatcccacccagccgtctcctttcacctcagtccctgtgtgttgagtgtggaaatatctctgtgcccaggatcctgggccggttttgtggcggggattcttctcccacagctccatcatgcatgttccctcatctccttcgatgctgatgtgttattattcgtagaacagtgatgaaatggcagcatgataccatagaacggtgataaaatggcagcatgatatcatagaacggtgataaaatggaagcatgataccatagaacggtgataaaatggaggcatgataccatagaacggtgataaaatggcagcatgataccatagaacggtgataaaatggcggcatgataccatagaacagtgataaaatggaggcatgataccatagaacagtgatgaaatggcagcatgataccatagaacagtgataaaatggcggcatgatatcatagaacggtgataaaatggaggcatgataccatagaacggtgataaaatggcggcatgataccatagaacagtgataaaatggaggcatgttaccatagaacagtgataaaatggcggcatgataccatagaacagtgataaaatggcggcatgacaccatagaacagtgataaaatggaggcatgatatagaacagtgataaaatggaggcatgataccatagaacggtgataaaatggcatgataccatagaacggtgataaaatggcagcatgataccatagaaaggtgataaaatggcatgataccatagaacggtgataaaatggcggcatgataccatagaacggtgataaaatggcggcatgataccatagaacggtgataaaatggcggcatgataccatagaacggtgataaaatggcggcatgataccatagaacggtgataaaatggcatgataccatagaacggtgataaaatggcggcatgataccatagaacggtgataaaatggcggcatgatatcatagaacggtgataaaatggcggcatgataccatagaacggtgataaaatggcatgataccatagaacggtgataaaatggtggcatgataccatagaacggtgataaaatggcggcatgatatcatagaacggtgataaaatggcggcatgataccatagaacggtgataaaatggaggcatgataccatagaacggtgataaaatggcggcatgataccatagaacggtgataaaatggcggcatgataccatagaacggtgataaaatggcggcatgatctcaagggttgggattagacacccagaaatgggagcacctgtggttgggtggagttattgatccatccttctccagtgttcaactcctccacctatgctcatatcacttataaggcagacctggccaggcatggtggcttatgccggcaatcctagcactttgggaggctgtggtgggcggatcacgaggtcaggatttcgaggccagtctggccaacatggtgaaaccccatctctactaaaaatacaaaaattagtggcatatggtggtgggcgcctgtaatcccagctacttgggaggctgaggcagaagaattgcttgaacccgggaggcggaggttgcagtgagccaagatcacaccactgcattccaacctggtcaacagagtgagactctgtgtttcaaaaacaaacaaacaaaaacaaggtagaccttatgggtctttccctgggagccttctacagagtggttgttgctacagacagcagtgatatgagacaaaccatctaaggccctgaaatatgagtcttgaaaatggctgtggacaaggaaaatcaatgaaataacagtgacaccagcaccccactctctctagggctcttaaaagttcttagcctgtagcctcttttccaatccactccagccttccttttctttgaatttgaaaatgaactttgaaatttctttcagtgacaagaaaatgtcactgtgttacgtgttgtatatccatgtgtctccttgggaagaaaattaaaggactaattgaagaaagaattagaaacactgaatccacagaaacgcagccacactctgtaattaatttttgaagaaaagaaaatgaaatgcttgccgatggtgaacctctccagcatgttcattagatatttgcattttctgcctattccattaaaagtacctctaatcagacagtcaatcaaaagtgcttatccagacatcttctttttagaatttgaatcatgccatgttctgtataggagtgagaccttaccacataaacagggtagggcttgctgtgtgctcagaaacgacacattaaccaggctgaactgatggaactccagctctctgtatccttctttgtccctctaatacttgggcagattctgccccaccattaaaaattcaatcattaataccaagaagaaaattgaggggtttcaaagaacctcaataaaccacagatttaggtctttataagaccttggtaagcagttgtggattctatagtttgtacctaccataagttatgatgatcattatagcattactgataacattttaaaaacttttattgagctgggtgcggtagctcacacctgtaatcctggcactttgggaggctgaggcaggtgtatcacgaagtcaggagtttgagactagcctgaccaacatggtgaaatcccatctctactaaaaatacaaaaattgggtgtggtggtgggcgcctgtagtcccagctactcaggaggctgaggcaggagaatcgcttgaacccgggaggtggaggttgcagtgagccgagatcgcaccactgcactccagcctggcgacagagtgaaaactccatctcacaaacaaacttttatgataatgtgtatggaaagtgtctcctcttgaaatgttccattttctctaaccaaagccaacgctccagccagccagtaggtagcagccagtaggagctgtcagaactgattgctcttatcatcactaaacacacaaagagggaaaagccatttcctcattccccaaattccagctccatccttcctctgaaagcatcatgccatttctcgctccggatatgtatttggtgtttagtcattcaaccgtgacatatctaacgttggcagagagggggcagaattcgaagttcttgccattccaggaagaggaagccatgttccctgtctaagcatctgcccacatcgggccgtgtctcggtaccaactccaccaagagagcagtgagtgacaaaggcaaggatgttcttaccaaacttggcgataacctggctccattaccatcctagattaataacccttcagtcattccagaggtggatgttgatacccaagaaatggtgggtgatgtgtatttttttgttgttgttgttgaaacagagtctcactctgttgcccaggctggagtgcagtggcgcgatcttggctcactgcaatctccgcctcccgggttcaagcgattctcctgcctcagcctcccaagtagctgggattacaggcacgcaccaccacacctggctcatttttgtatttttagtagagacagggtttcaccatgttggtcaggctggtcttgaactcctgccctcgtgatccgcccaccttggcctcccaaagtgctgggattacaggcgtgagccaccacgcctggccccattataaccctcttgcatagtctatccttcactcttgcgaaatgtttaatgagatgttgaataaatgttactatgctttgtatctttttttttgcttctatgtcacttttctttttgccgtgggtggcaatggtgagttcttttgcactcagggaagcttcatgcctcatcaccccaaccttctggaaattttgattcttatagttcaaacttccataatttttaaaaaccatttttaagttcagggatacaggtgcaggtttgttacataggtaaactcgtgtcatgggggtttgttgtatgattatttcatcacccaggtattaagcccagtacccattagttattttcctgatcctgtccctcctcccaccttctgataggcctcaatgaatgctattcccctctctgtgtccatatgttctcatcatttagctctcacttataagtgagaacatgtagtaatttggttttgctgttcctacatagtttgctgaggataatcgcctccagctccatccatgtttctgcaaaggacatgatcttgttcttatttatggctgcatagtattccatggtgtctatgtaccatattttctttttctttctttctttttttttgatatggagtctcgctgtgtcacccaggctgctggagtgcagtacccttgaaaattcctctgcctcagctcactgcacccttgaaaattcctctgcctcagcctcccaagtagctgggattacaggtgcacgcccccacgcccagctaatttttttgtatttttagtagagacggggtttcaccatgtgttggccagactggtctcgaactcctgacctcgcgatccacccgccttggcctcccaaagtgctggaattacaggcgtgagccaccgcacctggcctatgtaccatattttctttattctgtctaccactgatgggcattcagattgatcccatgtctttgctattgtgaaaggtgctgccacgaacatacacgtgcatgtgtctttatgacagaatgattgatgttcctttgggtatatacccaggcatgggattgctgagtggaatgatatttctgtttttaggtctttgaggaatggccacactgtcttacacaatgttggaactaatttacactcccgccaacagtgtttaggtgttcctttttgtctgccaccttgccagcatctgttgttttttgatgttttagtaatagcctttatgactggtgtgagatggtatctcattctggttttgatttgcgtgtctctaatgagcagtgatgttgaatgtttttgcataggcttgtcggctggatgtatgtcttttttttttttttttccgagacagagtctcactctgtcgcccaggctggagtgcggtggcgcgatctcggctcactgcaacctctgctccccgggttcacgccattctcctgcctcagcctcgcaagtagctttggtttttgactttagttacatgcactttttcagaaatcaaggtatgcataagcaaagcacatctgtctttccaaactggatttaaattcgccatttactaactaaggaatattgtgcaatttagttaacttctctaagcctcattttcctcgtctatgaaatgggaagaatagtaagatctacctcaaaagaatgttgtaaaggttaaacaaggtaatcaaattgtttagtaatatgcctcccacatatcaagccctcaaccccgccaccatgcctggctaattttttttgtattcttagtagaggcagggtttcaccgtgttagccaggatggtcttgatctcctgaccttgtgatccacccgcctcggcctcccaaagtgctgggatgacaggtgtgagccaccgcgcccggccagctgcatgtgtatcttcttttgaaaagtgtctgttcatgtcctttgcctgacgtggcaaagggtgtgctttcaatgggattttttttgtttttatttttgttttgttttgtaaatttgtttaagttccttataaattctggatattaaacctttatcagatgcatagttggcagatactttctctcattctgtaggttgtctgttcacgctgttgatagtttcctgggctgtgcagaagctctttgaaactttcgtaactttaaaccaagtgttagctaactccgtttctcaactgagtaacttcagaaattaaattagaacaacaggttctgccttttgaagacaaagtagcataaccctagccatccaccacatgctatcacttgattctgattgctgttttgaggattctttttgtcccaatctctaattagttttttaaaataagcgttttgtagagaggatgtttttctcaagagttaccctgttttgactatggtagccacaccccagtgatgtacatgtgtttctctattttccatttcataaccaccgttatgtaggtgaatccttgatctgacacacagtgcctgtctttccctatgaatggcttagtgatttgcctggaaatcttagcttgctgtagtgtgtgtgtgtgtctgggcacagttttagagaaacaagcaatgattcttttttttttttttttttttaatttcctgagtcccaaagtgtttgagacaaatctcgttttcccatatcgggtctagggttatttgttcagatcctttgtcattcaggactctgtagctctttctttattccttactgaaatctcacattgacgaagagctctttccacctgatttgcttttccattggcagatgtcctttttgttcctcccttgatgcttttaggattttctcttgatctttaaagctccacggtttcatcaggatgaggttgatggacatatgggcatttaaaaataaatcgtatggcttactatacatcttataatggcagatctgggtttttatctcagggattttttttttctttgcacgaaacctttccatttacaattgacccttgaaaaacatgggggttagggacaccaacccctcacacagtcaaaaatccatgtgtaactttttttttctttttcgagacagagtttcactgttactgcccaggccagagtgcaatggtgtgatcttagctcactgcaatctccgcctcctgggttcaagcgattctcctgcctcagcctcctgagtagctggcattacaggcgcacgccaccatgcctggctaatttttgtattttcagtagagacggggttttaccatcttggtcaggctggtcttgaacttgtgacctcaggtgatccacccactttggcctcccaaagtgctgggattacagatgtgagcccctacgcctggcccatgtgcaccttttgattctccaaaaacttaattattaatagcctactgtttacaggaacccttgccaataacataaacaggtgattcactcattcatattttctatgttctatgtattgcatactttatgcttagactaaagtaagctagagaaaagaaaacgttaccaagagaatcatgagaaagagaaactacatttactattcatcaaatggaaagggatcatccccgaggtcttcatcctcatcatcttcacatggaggaggctgaggaggagaaggaggaagagggaggttggtctggctttctcaggggtggcagaggcagaagaaaatccacatataactgacctgtacagtccaaacctgtgaaggatcaactatgtttctgtgtctctttctcccagttcttgtcttcagagataccaacattggatgttgcctctcaactggtttccttctctttcatgttcttttctccaatcacttcatgtcatcatctttttcttctacattctacacgcttccacaagcctgccctctgcacccctgacatgattctccacattcattttttttctttttttgagacagagtcttgctttgtcacccaggctggagtgcagtggcacgatcacggctcactgcaacctctgcctcctgggttgaagcaattctcctgcctcagcctcgtgagtagctgggattacaggtgcccaccaccacacccagctgtattttgtatttttagtatgacagtgtttcaccatgttggcctgcctggtctcgaactcccgacttcagttgatctgcctgcctcggcctcccaaagtgctgggattacaggtgcacaccaccagacccggctaattattgtatttttttttttttttttgagacggagtctcgcacttgttgcccagggtggagtgcaatggcgcaatctcggctcactgcaaactccacctcctgggttcaagtgattctcctgccttagcctcccgagtagctggaactacatatacctgccaccacacctggctacattttgtatttttagtagagatggggttttaccatgttggcctgggtggtctcaaactcccgactttagatgatctgcccacctcaacctcccaaagtactgggattacagggtgagccaccatacccagctgagtctcctcattcttgattttgatcttccctctgtctactattgtccgggcttctctaggatgtgatgttatatctcctactcgtttccggcacccttcttattatgttaccgcattaacccttttgttaaacgtttaatatttttgtgctctgaatttattattttttatctgatatgaatatattaggttggtgcaaaagtaattgctgtttttgccattaaaagtaatgatagtcttttttttttttttttttttttttttttttttttagatggggtctcgctcttgtcacccaggcaggagtgcagtggcaccatcttggttcactgcaacctttgcgtcccaggctgaagacatcgtcccacctcagcctcccgagtagctgggactacaggcatgcgccacaacgcatagctaatttttgtattttttgtagaaacaggctctcactatgttgctcaggctagtctcaaactcctgagctcaagcaatccgtcgtcctcggcttcgcaaaatgcagggattccaggtgcgagccattgtgcccggcctgataatattttgactctgactttcttttcgtttctatttacctttaaatctcttttatgttccacctgaattactcctctgtgggtatcttttataggctgtatatttgtgttttccttccaacctatttcttgctataattgagatagtgaaggattagtggtctcaggtccttctgcctcgccccacataaatcttcatttcaactgatgctcttcatttcttttttatggaatattactttcctgttttttgtgtttgcctgtttttcccatgagtcccaagatggatattttccctccatacgggcatttattttaatgcccagtcttcacccctggaggatgcgtgagttggttcttttttcctccttgccccgtggacctcagacatggacacacgtgtctgtggttttgagggctttgttttatccgttcagttcttcagctgcttaagatggacggacagaggccgagcgcagtggcttacacctgtagtcccagcactttgggaggctgaggcgggcagaccacaaggtcaggagttcgagaccagcctggccaatatggggaaaccccatctctactaaaaatacaaaagttagccaggcgtggtggtgggtgcctgtggtcccagctattcgggaggctgaggcaggagaatggtgtgaacccgggagacagaggttccagtgagccgagattgcgccactgcactccagcctggctgacagagcgagattccatctcaaaaacaaaaacaaaaaagatggatgggcagggagtggaggctgtgggtagtgattgctgtccatgacccctgtctgtgagcacctgctctctaagctgagggaatccctggtgtcatcccagcagtggcgtgttccatgctgctgtaggccaggaacatggtgcagccgaagtggacggccatccagtgatgacttggccccagtggacagctgcccagtgatgggacatctggagtagatggccgtccaacaacagttcattattgttgtgctacgtctggtgtttccagtggctggaaccactagagctccgctccattgggttggagccattccagggtgggaatggccaccaggagacgatgcctacccttctcttcttgcaccaagtcagcacccatactcaggcgaggccctgtgtctcctcctcctccccagcatagtcttgctggagtcatgtagaaaagtcatggaaaggggcttgtgaagggatacgctgccttcttcctgggctctcctggtatcccactggtactcagtcattctccttccaaactgaggtgtgtgcatacatataatttgctggcccttaaaaaccacgtgtaggcctggctcctgtaatcccagcaatttgggaggccaaggcaggaggatcacctgaggtcaggagttcgagaccagcctgaccaacgtggagagaccccatctctactaaaaaaaaacaaaattagctgggtgtggtggtgcatgcctgtagtcccacctactcagggggctgaggcaggagaatcgcttgaacccgggaggcggagattgaggtgagccgagatcgcgccattgcactccagcctgggcaacaagagtgaaactccatctcaaaaaaaaaaaaaaaatgcaatcagctataatccttccctaaactactggtgtgactgtcttctgactccttcaactattacccaaaagatgaatgacttcttagtgaccctttgtcctaggaattatttcataggcttctgtagcaaatggaaccttgggtctcactaggataataagcatgttctgaattcctggacgcttttttctttttttcctgcacaacttcatttcggggtaaatgaggacagcacctgagttccccactcccctttggattctctagggggttgaaggtttcttctactgacatacacatggcttcaggaagatggtgttggacgctttttctttttttgagacagggtctggctctgtcgcccaggctgaagtgtaatagtgcagtcttggctcactgcaatttctgcctccgggctcaagcaatcttcccacctcagtctctcgagtagctacgactgtaggcacgtgctaccatgccctgctaatatttgtatttttttttgtaaagatgaggttttgccatttgtcccaggctggtctcaaactcccgagctcaagccatcttgcctgccatggcttcccaaagttctgggactacaggcaggagccactgcgtccagcctggttttggactcttggtcttgggtttggccaaaactttggtggttcagatggactcttgtagattttaaggagaattgaagttttgtggcttaagctgaactgctgttctcaatgcccgtgctggtccgaatgcccatgctggtccctatagcccttcatctactgtggctggtcttgtaggtctgttttatttgctgtaggagcctttgcctgtgcttgtagctatcaccgtagcattcaacacacctctgctgtatcccctgaagacgccgaaacgtggtattctcaccccaaagagtttccaccctgataagttccagcaaggcagcccagcagctacgcctgcagacacttgttggtaggaagaagtgtcagatgatctgtaacactgtgcgttgatcctgcatgtctgaagaacttcacagaattgtcgcatggtgagcagtgatactaagcaaagctgagtcacccgtaagctcccaggccctcagcccggcaagtaggacggtattttcacacctctgttgatgaagcacctcagatagctcaagtttttggagacagcctcgtaggagttttagtttaaccataatctgcttgcggatcactgatgtttccatgagtcattccctgagattgtagtgaagaaaacagatactatcccattcgcttctttgcaaaatacccacaaagccacatgcattttcatactgaacatcttgggataccatttattttcctgcaggattatatcatagtttagggttgagtgtgcctccaggagtcatcagctaagcttcctgttttgtggatagagaatacgggaggacatctgatcccctatgactgccagcatcaggcctgggattgtggttgtccaatggtgcttttagggggcaaaaatgcacagctgtttattgaaacaacaaatgttccaggctgggcacggtgactcacgcctgtaaccccagcactttgggaggccgaggcgggtggatcacctgaggtcaggagtttgagaccagcctggctgttatggtggaaccctgtctctactaaaaatacaaaaattagccgggtgtagtgttgggcatctgtaattccagctactcaggaggctgaggctggagaatcgcttgaatcgaggaggtggaggttgcagtgagttgggattgcgccactgcactccagcctgggcgacagagtaagggcagggagggctctcagtctggtagtctcacccaggtggtccagggttccagcactgagagccaggatgccaactcccaatgcatcatcagcctcctcttcagccatgcaggaagtcagggctggtcccagtggttaatccagacaccagagtgcatagcatggccctccccatgtccagcacactggcctttcactgtaccatgtcctctttctcccattgggtggcctgtgttgctttctcaatctccaagtctgtgtcagcaaggaagtgttccatcctttactgagtcatgacctgtctgaggctgacaagtgccagagctcatgttattcaggcatatttataagcaggtgtttttatttaaagacttagtccacatattacaagtattctgatggactcatcaaagcagatagggaaagttggccagtctcattttgaatgttacgatgtagccgaacatttacaaaactgtctttgactttctttctttttaattttactctaagttctgggatacatgtgcagaacgtgcaggttcgttacataggtgtgcgtgtgccatggtggtttgctgcgcctatcaaccaatcttctacgttttaagccctgcatgcattaagtatttgccctgatgccctccctccccttgcccccagctccctgacaggccccggtgtgtgatgttcccttccctgtgtccatgtgttctcattgttcaactcccacttatgagtgaaaacaggcagtgtttggttttctgttcctctgttagtttgctgagaataacagtttccagcttcatccatgtccctgcagaggagatgaactcatccttttttatggctgcatagtattccatagtgtctacataccacattttctttatccagtcttatcattgatggacatttgggttggttccaagtctttgctgttataaatagtattgcaataaacatacgtgttgaaatttttattttatcacggtcaaacgcttaccatgagagccaccctcttgacaaagtgttacatgtataatacggtcttgttaactctaggcacaactgctgtggtgtgcacagttgtacccagactgcagaactgattcatgttatataccaaaaccttatacttgtggaacagcatctccctacgtccctctctcctcatcttctgaaaaccatcattctactgtctgcttctgtgaatttgactattttagattctacatgtcagtgacatcatgcggtatttgtctctctgtgtctggtgtatttcacgttaacatcccccaggttcatccatgttgtggcaaatgacagaattcccttctttttaaggctgcgtggtattccattgtctgtatgtactgcattttctttctttttttgagatggagtcttgctctgtcacccaggctgcagtgcagtggcgtgatctcggctcactgcaacctccgcctcccaagttcaaatgattctcctgcctcagcctctggagtagctgagactacaggcacccgccaccatgcccggctaatttttgtacttcttagtagagacggtgtttccccatgttggccaggctggtctcaaactcctaactaactgcaagtgatctgcctgcctcagcctcccaaagtgctgggataccaggcgtgggccactgcacctggccaattacgttctttttttattttttttcttgagacagagtctctgtcgcccaggctggagtgcagtggcgcgatctcggcttactgcaagctccacctcccaggttcacgccattctcctgcttcagcctcctgagtagctgggactgcaggcgcctgccaccacgcctggctaatttttttgtatttttagtggaaacggggtttcaccctgttagccaggatggtctcgatctgacctcgtgatccgcccgcctcggcctcccaaagtgctggaattacaggcgtgagccaccttgctcagcccaattaccttccgtttaaggctgtaaagtatcccattgtgtgtatttacagcattttctttatttctttctttgagactgagtgtcactctgtcgcccagtctggagtgcagtggcgtgatctcagctcactgcaacctccgcctcccaagttcaagtgattctcttgcctcagcctcccaagtagctgagattacaggtgcctgccaccatgcccggctaatttttgtacttcttagtggacacggggtttcaccatgttggctgggctggtctcaaactcctaactaactgcaagtgatccacccgcctcagtctcccaaggtgctgggattccaggcaccgcgcctggcccaactaccttcttttgaaggctgcatagtatcccattgtgtgcgtgtaccgcattttcttttttttttgtttgagacggagtgtcagtctgtcgccaggcctgagccaccgcacccagctgtaccgcattttcttcatccattcatctattgaacgcttgggttcattccatatcttggtgattgtgaatactgctgccataaacatgggggtgcaaatgtctctcatagaccgatttatcttttggataaatacctagaagcatgcttgctggatcatcgagtagttctatttttaatttttttgaggaacgtccgtaccatttactgtattcacccatttctgcaggaaacagtggcagaggaacacaagttttcttcttccctgtcccagctgtgcaaaaagagacccacagccgggcgcggtggctcatgcttgtaatcccagcactttgggaggctgaggcaagcggagcacctgaggtcaggagtttgagaccagcttggccaacgtggtgaaatgtcgtctctactaaaaatacaaaaattagctgagtgtggtcgtgggtgcctgaaatcccagttacgtgggaggctgaggagggagaataccttgaacctgggaggcggaggttgccgtgagccgagatcgtgccactgcactccagcctgggcaacaggctctctcaacaaaacaaaataaaaaaaaaaaaaataaaaataagagacccacaagggctttggacctcctttctttgcaaaacaagaaaataatatagcagacattgggcagtttttcattctgactttccagtttcatttttgcttcttcctgtatggttgctgcctggacctctttcttattgctgggaggtctttcccctgcccccatccttttgagcctttctatctacttttcttttgaaagaaagtaaataaaaccccacacatccagacaataggagcgcacgcctcagaattctggctgcgagggactgaccccatccagagagaacgaacaaatgcatcaaaaccctggctgcaagcgactgaccccagcttgatccacttaagccagaagagcctttgcttctatgtttaatctgcaccaagcttagtgatcactttcttctcagaggccagaacacagagtccaacctttccaggatgccagcttcctatctctggggtctcctcttcctgcagagaagctttagtctcttacccgagctgcttctctattctcttttgccttgctttgcctataatactaacacactgtctttttcttatgttacgttggactatcccaaggcagggacccaattggcctggcttgggttccctgcctgactgtgggtttggctgaggagtgggcagcaatttccagccgttggcactgccagaacgcatgggtgtatggggtttctggaggcagcagctctatagtgaagcagatatgtagggggtgttcattaccaagacagcagtgattgtccacgagcagggtggttccaacagggagcctacagtctaactgcagatggatgctaccattttacatgtcccatgtatgacatccatgtaccgtatgttgctggacaccgcattatggcaactgaaaaacaaaaaggcattaaatgcctgggaaaatgtacagctcattacatctcatatggtttggctctgtccccactcaaatcttatttatttatttagagacagagtctcgctcactcaggctggagtgccgtggcatgatctcggctcactacagcctccacctcctgggttccagcgattctcctgcctcagccttttaattagctgggattacaggtgcccgccaccatgcacggctaatttttgtgtttttactagagacgggcttttgccaaattggccaagctggtcttgaactcctgagctcaggtgatccacctgtgttggcctcccaaagtgctgggattacaggcgtgagccaccgcgcccggccccaaatctcatcttgtattcccacctgttgtgggagggacccagtgggaggtaaccgaatcatgggggcaggtctttgccctgctgttctcatgatagtgagtaagttttatgagatctgatggttattataaaggggagtttcctgcacatgctctcttctcttgtctgtcacaatgtgagacgtgcctttcaccttttgctttccaccatgattgtgaggcttccccagccacgtggaactgtaagtccagttaaacctttcttttctaaattgcccattctcagatatgtctttatctacagcatgaaaacatacttatactttatttatccatccttatctatatcaaatactatttgaccatagattgtgtaaagacaatatggcacagagacaccatggaatactatgcagccataaaaaagaatgagttcatgtcctttgcagggacatggatgaagctggaaaccatcattctcagcaaactatcacaaggacagaaaaccaaacacctcatgttctcactcataagtgggagttgaacaatgagaacacatggacacagggaggggaacatcacacactggggcctgtcggggagtaggggactgggggagggatagcattaggagaaatacctaatgtagatgacgggttgataggtgcagcaaaccaccatggcacatggatacctatgtaacctgcatgttctgcacatgtaccccaggacttaaagtattaaacaacaacaacaaaaaaaaaaccagactcatacaacatccctacaaacaggaaaaatggggaggggaacatgggagtcaccttgtagtttacttagatttgctgtgagaagaagctatgggaggctttccaaaggctgcgggaaggatttgggctatcttcaggagattgagcttgacagcagcttcaaggcgccttgtgggaggggaggctgggggcaggaaaatcaggtgggtgaaaaatacactgatttgcagagaaatggtgccagcctggactgtgaaaacagagacgagaaaaaccacactcggcaatatttgagcacgtattaaatcctggatggcacattgcatttttatggatgtcattcctaagagattcacagtcaggggaagatggtacataacaactcgggcatgtcagatgcacctctgtagctgcgtgtccagatgccatggagtgagatgcctggttttgctcatagagttagaaacattatcagaaaatacatgtatttgagttaaattttagagagtgagtagaaattcatcgggtctacaaggaggcaaagagctttcctggatgaaattcctccttggcgttcacctaaaacttactaatttcttacagaacaaggataccacgggaggtgggtgccgcagaaccagggaactgtgtgtctgagtcaagatactgcagagaaatagaaccaatatgatgtgtgtactgatagaaagcacatttattttaaggaattttgctcatatggtgatggaggctggcaagtctcaagatgtatggggtagaccagccagctggagacccagggaggagctgatgatgtagttggagtccaaagtccatctgttggcagaatcccttctggctcaggtaacattagtcttctgttctagtcagaccttcaactgattggaccaggcccacccaccataggaaggacaaattgctttactcaaagtgtactgatttagatttttttttttttttttttgagacagagtttcactcttgttgcccaggctggggtacgatgcgatctcggtgcgatcttggctcaatgcaacttctatctcccaggtttgagcaattcttctgcctcatcctcccgagtagttgtgattataggcacacaccaccacgcccagctaatttatttttatttttttggtagagacaaggtttcaccatgttggccaggctgatctcaaactcctgacctcagatgatccacctgcctcagctgcccaaagtgctgggattataggtgtgagccactgcacccagcccagtcttttgttctattatgaccttcaactgattagaccaggcctacccaccaattcctttactcaaagtctcctgatttcgatatttatctcatttaaagcaacctcaaagaaacacccagaagaacatttaatcacatatgtgggcaccatggctcagccaagtggacttataaaatcaaggatcaagggtgcctcagaacaagagtacccagacagaacacaagttgggcagtatttcaagaggcaggggaagccatggaagctgctctgaggggacttgtgatcaggtgtgtatgttagggaggtcactgtggcagcagggtatagggtagactgcaggggtcttgtggcctctgtctctgtcacaggccaagtcatattcaaatttataaaattcaaaatttttacatcattaatttgaaattttattaaataaatacagtatatatatatatatatatatatatatatatatatatatatatgcttctttttatatactttaagttctggggtacatgtgcagaacgtgcaggtttgttacataggtatacatgtgccatggtgggttgctgcacccatcaacccatcatctacattaggtatttctcctaatgctatacctccactagcccctgaccccctgacagaccctggtgtgtgatgttccccaccctgtgtccatgtgttctcattgttcaactctcacttatgagtgagaacatgtggtgtttgcttttctgttcttgtgttagtttgctgagaatgatggtttccagcttcatccatgtccctgcaaaggacatgaacccatcctttttatggctgcatagtattccatggtgtgtctgtgtaccacattttctttatccagtctgtggtcgtatagtatttctggttctggattcttgaggaatcgccacactgtcttccacaatggttgaactaatttacactctcaataacagtgtaaaagcgttcctatttctccacatcctctccagcatctctcgtttcctgacttttttagtgatcgccattctaactggcataagttggtatttcattgtggttttgatttgcatttctctaatgacccgtgatgatgggctaaaaattcagagaaaatgtaataaaatgtttaatctagctcaagtatccttcctttgttgaatcagttttcaccttttctgtctttcctgctggctggcttgctggagcccgctctcatgagtggtgcaaggtcagagatagaaaaccaggcccatgtatggttgtgtcttttcacaagttcagccttttattgatgctatttcagtttacagaagccccaagatgcacggagttttcaaggaggcaattctccttaggacttcccatttagtactgaaatggcttgagcccttggagtactggagcctgtgtgccggcagcatttagtcagagctacaggcgcacaggctcctgctgtgacccaagtcagtcagtattgcaacctatacatactaatacacttcaccaatatatgcatgttatagattaaacattctacatcaaacaacgtaacatttatcatcaagagaaaaggggtaggaaaaagcttaacaaaggagcacagggatattgatgtggacaaaaaaaagtctcctggcctggccctggagggccatcagtggtcgccatcttgcaaggaagagcctttgatatcagtggggcagagccttttgcggtggatgctgcgtaatgattacaagtgacagcaagatggcatctgttaaggtagccatttggagctgctgaagccctgttctttcatgaccacagagtcctctggtgaggattgacaatggaagagggtgtttggttgtgtccttaactgtttggatgtggtctttattgatcaggtgaacatctggctcctgtaggcatgatgccttttgaatgaaatgtaacatggaatctttttctaaggtggagtcacttatgtcaagcgtgctctacacactcactgtaagaattaaagaggaaagaagcatgaaatgtcacttgacagttaaacacaggtttattttagagaaacctgagaggggcttctggctgagttaggtcagagctcttctctcttatagactaagcacatttaagggttttggaagggggtgcttatcataggttcagaatgtttgtatgtgagggagagtttattgcagggttgaatatctctggtcagaggggaggctgtctcagggttggtatgtttttggtcggagacgggtttatcttagggttggaatgtttctggttatgctgacatgagtcatgaggctgatgttttcgggctggatttaggcggtttttaatcaaggggagcctagaatggtggtgtttgttcaagatggccatgctcccgctctgtcacccacaacctgaagaccgttatcatattgattttgtatctcctgtgcgtacctgatggagaatgactgaatgtttgaattaaaagactcagggagaaggcaaagttgtgtttaagttgcaagttgaaaaaaacaatccattggctctgttagcagctattagagaggttggggcgggagcagagtctgtagcttaactttgcttttgttatgtcgatgctatgagcgtgggaatcatggaaactgtgaataaatggaagagagtctgtcagtgacctactgctgcatcttgggccagcccaggcatccgtgagtgttcagggagacctcgggagagttctcaggcagaaactagccactcacatgcttgtcatctgcggggttgacatggtgggctatttttatgctcagacacttgggagaaagggcaggctgtacccaaaggcagataagtgctggccagatgggcttgctgggcaccgtcgaactcatggtcaccgtcctgcccaggagctagaaatagaactagccccgggacaatccgtgaggtatcaggtgagtatggcccgatacatgtgactcagagacacaaggagtgagggtgtgtgctctgtctcaatgagagaagagagaagtcagggcttgctttggcaacaccaaatgcagatatcagactcctattcagaaaccagaattctcatctcagcatttattttctggatatgtggccgacagataggcatctctgtttataatgcctttaattttgatcttgacaaggactagaggaagctcttactgaaccttcacgcccacaaacaaaagcttctaaatcggccgggcgaggtggctcacgcctgtaatcccagcacattgggaggccgaggcggacagatcacctgaggtcaggggtttgaaaccagcctggccaacatggtgaaaccccatgtctactaaaaatacaaaaaattagccgggagtggtagcgggcatctgtagtcccagatacttgggaggctaaggcaggagagttacttgaacccaggaggtagaggttgcggtgagctgacatcacgccattgcgctccagcctgggcagtaagagtgaaactccatttaaaaacaaaacaaaacaaacaaaaaaacttctaaatcacattcaggaagcattttgtaatattttatttcttatcagggagcattttgtaatattttatttcttctcaacccctgtagtggattgaatggtgcctctattttacccccacccccaccaaaaaaaaaaaaaagacaagttcaccttgaatctgtacatgtgattttttatttggaaataaggtctttgcagatgtaaaaaaggatctggagatgagatcatcctggattgcagtggatcctaaatctaatgacaggtgtccttgtaagagacggaagaggagacacagacacagaggagaaggccacgtggagacggaggcagagactggagtgatgcggccataagcccagggatgcctggagcccccaggagctgggagaggcaggaagaattcttccctagagcagggagcatgtccctgtaggcacctcgatttcacagatgtagtctccaggactgggagaggttaaatggctgcttttgtaagctccctagtttggggtcatgggttacagtggtcccatcccaacctgtaagctctggagaacatgagtctggaatgcaagcgtgtgcggtgattcagcttgatgcctgtggtgggaaaagagccccttgtattatggcttcctgctgtgtgtaagtaaaaccagtcctctgaggaaatcaaagcccagtaaacccgtgcaccctaacttcccaggatcgcaaactggagagagagcggcagccattttctccccctgccttgatttgctgaacctgccacccgtgcagcatttcccaggaggctaacctggtgatattgtccattcttggtcctccgcaatgcaggcaatattcgttgctcagctcaaatgcttgcgtctcctctttcttctctccacctgcaaaacatcttttcataggtcccattgggaacaccagctcgttggctggtatttccacactctttttccttccttttgttgcttcatctacctctgatttgccagttgtctgatgtctcctctcacgagcctatctttctcccaagcctagtagacacgaaccattgaaagcatccttgaatgacaaaagtccaaatatcaatttgcaaggtgaagactgtggcttttattatttgttctcaatggcgggtgtctggcggggagtccagtcgcctgacgttgaatgcagtcatttcctaggtgtgggtcaagattctgatgtccacaggcaataatgtccgtgaacgtgtgtatgtaccttgatggacattactgactgtggactccagaacattggacattgtatatattgatggacatcatatatatatatacacacacacacacagacagacgcacacacacaccatggaatactacacagccacaaaaaagaatgaattaacagcatttgcagtgacctggatgagactggagactattactttttttattattatactttaagttctggggtacatgtgcaggacgtgcagtttttgttacataggtatacatgtgccatggtggtttgctgcacccctcaacccgtcatctacattagatacttgtcctaatactatcactcccctagccccccacccctcgacaggccccagtgtgtgatgttcccctccccgtgtccatgtgttcttattgttcagctcccacttatgagtgagaacatgtggtgtttggttttctgttcttgtgttagtttgctgagaagaatggtttccagctttattaaaagtcaggaaacaacagatgctagagaggatgtggagaaataggaatggttttacactgttggtgggagtgtaaattagttcaaccattgtggaagacagtgtggggattcctcaaggatctagaaccagaaataccatttgacccagtaatcacatgactgagtatatacccaaaggattataaatcattctactataaagacacatgcacacgtatgtttattgtggcactattcacatagcaaagacttggaaccaacccaaatgcccatcaatgatagaatgtataaagaaaatgtggcacatagacaccatggaatactatgcagccataaaaaaggacaagttcatgtcctttggagactattactctaagtgaagtaactcaggaatggaaaaccaaacatcgtctgttgtcactgatacgtggaagctaagctatgaggacacaaaggcatgagaatgatacaatggactttggggacttggggagagcttgggagggggcagcgagggataaaagactacaaatagtgtggaatgtgtactgcttgggtaatgggtgcaccaaaatctcacaaatcaccactaaagaacttactcgtgatcggatgtggtggctcacacctgtaatcccaacagtttgggaggctgaggcgagcggattaccttaagtcaggagttcaagaccagcctggccaacatggtgaaaccctgtctatactaaaaatacaaaaggaattagccaggcctggtggcacacacctgtaatcccagctgcttgggaggctgaggtaggagaattgcttgagcgtgggaggtggaggttgcagtgagccgagatcatgccactgcgctccagcctggctgacagagcgagactctgtctcagaaaaaaataaaaagaacttacttatataaccagatactgcctgtaacccaataagttatggaaaattaaagaaaaacacacaaaaagagtatattcaggatcacttaagtaagcatgatactacatcacatctcgttgcggaaattatatggattatcattccatgagtgtaccagcttccggaagtttctgagctcatatggggagtgggaagtaggtggtctcgtgggaactgcagggctggccccttgtcaggacggtcatcactagtgacataaataccccatggtagagagagctggggtgtcttcgtcggttttgtgtcactagaaaggaacactggaggctggataatttatagaggaaagaggtttatttgggttatgattctgcaggctgtacaagaagcacagggccagcatctgtctctgctgaggacctcaggaggcttccactcatggtggaacgggaaggggagctggtatgtgtacagagaccacacgaagagacaggagggaagacagacgggagacgccaggctctatttaacaaccagcctgtggagaactcatagagtaaaaactcactcatgcttcaagaaaggacattgatctcttcaggaagaatccatcgtccgttgctcaaacccctcccattcgacctcccatccagcactgaggcttacattttaacctgagtttgggagaggaggaattttaaagcagagcctgtagattctaaagcaaaatattctgggtctcctgcttgtagaatggttgtgagtgtgacttcctttttctatttttattttatttttttgaaacagagtctcgctctgttgcacaggctggagtgcaatggcactgtctcggctcgccgcaaccttcatctcccaggttcaagcgattctcctgcctcagcctcccaagtagctgggattacaggcgcgcaccaccatgcctggctaatttttgcatttttagtagagacggggtttcaccatgttgaccaggctggtcttgaactcctgacctcgggtgatctgctggcctcggcctcccaaaatgttgggattacaggcatgagccaccatgcctggcctgggattgttatttctaaatgattccagctttttttttttttttgtctcagctgaggcacagcggtggaacttgtcgtcttatcattgacttgttatgttcatgaaggacttggaaaaccaacgctgatcctcagagtaacagcatagatcctcacaagacagtctatgaagctggagccccctgggttgtaaaatgcctccgcaccccgtctctgtttctgaagaaggaagctctgctgagcagctaaacatgacgtgcttgttaagtgtgcattggttaaagaacagatgaaggtacaggctcagtctccaaaacttcattatacaatctcacagatgagtagcaccgttcagcattgagtgacacctactttcccgtctccaggtggttagatatcatcatctccaatttaaggcccatctaagaggtgcaccttttctcgatcctgaggctcaagtgtctaaacagcaactgtaaattttctccaatcagtgtttctcccctgtgtggaaataaattcgcatccttgaagttcagctctctccttcattttacaaaaaaacaaaaaacaaaaaaacttgttttaagcaagattaaaagtgaattttctattagcagtaattttatatcactccctgtcttgcttcttttgcactcactgaattgaagagaacgatatgaaattgcctggaaataaaaatgaaagtgcttctcagagccaaacaacactactcgtgtgaaagaatatagaatgaaagtttgaagtgtccatcagtcctgaacctgggatgatcctgtcctgatatccttaacgagaatgcatctaccaagaccctattcgcaaatcagttcacattcacggtgtttgggggttaggacttgggcatgtcattacgggaaatagctttgttggcttttctggttttacatagaaagagcaataaaggtcagccgcggtggctcacgcctgtaatcccagcactttgggaggccgaggtgggtggatcatgatgtcaggagttcaagaccagcctggccaacatggcgaaaccccatttctaatgcaagcagggcttaaaacctagatgacgggttgatgggtgcaggaaaccagcatggcacatgtatacctatgtaacaaacctgcatgttctgcatatgtatcttgcaacttaaagtaaaataaatctatctatctatatctatctatctatcttagggctgctgtaataaacgaccacacacttggaagtcttaaagccacaacaagtttattcttttccagtcctggagaccagaagtctgaaataacgatgtgggcagtactgtgcttcctctggaggctcacttgaacctgggaggcagaggttgcagtgagccaagatcatgcctttgcactccagcctgggcaacaacagcaaaactccgtctcaaaaaaaaaaaacaaaacaaaaaacaaaataccgtgaatatgttctctaaattaatctcacagcatgggagaaggtgaacaggataccccagtactgatgacaagtattatgggatggaaaagagaactggcattcttctttgctggcaacacaacctgtttttgttgatgtgaaggcagttaaccttgttgctagataaatgttactgcagatgtctgacgtaatgagaatgcgttatccacagcaaaatgcttttgaaaaagaaactgcagggaacttcacagtgagtgactaagactcactactgcagtctggcgtggtggctcacgcctgtaatcccagcattctgggagggtgaggcaggcggatcatgaggtcagtagatcgagaccatcctgggcaacagggtgaaaccccgtctctactaaaagtacaaaaaaactagctgggcatggtggcgggcgcctgtagtcccagctacttgggaggctgaggcaggagaatggcttgaaattgagaggcggaggttgcagtgagccgagatcacgccactgcactccctggtaccagagcaagactctgtctcaacgacaacaaaaaaacaaaaacaaaaacaaaagcatgatattaaagacactgtgctccatgactcagaagttgaaagagctactttgaatctgcaaatgatacctccatggatgtcgcctaagttcatgaaagatggaagcatagtgacagtaacaataatttaagaaggtttgaaaggaaaatcttggggtccccaaatcactaagctcaagggaaaagtcaagctgggaacttctcagagcaaacttgcctcccgttttattcaaagttactcctggccaggtgcggtggctcacgcctgtaatcccagcactttgggaggccagggcaggcagaacacgaggtaaagagatcaagaccatcctggcctatatgatgaagccccatctctactaaaaatattttaaaaactagctgggcatggtggcgggcacctgtagtcccggctactcgggaggctgaggcaggagaatggcttgaacctgggaggctgaggttgcagtgagccgaggtcgcgccactgcactccagcctggtgccagagcaatactctgtctaaacacacacacacacacaccccaaaaaaataatgaatgcaaccatttgtctcttatccacctatgacctggaagccccctccccacttcgagtcgtccccgtgtttctggatggaaccagtgtacctctcaacatatattgattgatgtctcatgtctgcctaaaatgtataaaaccagcgtgtgccctgaccaccttgggaacatgtcgtcaggaccacctgaggctgtgtcatgggtgcgtcctcaactgtggcaaaataaatttttctttttttttttttttgagatggagtcctactctgttgtccaggctggagtgcagtggtacgatctcggctcactgcaacctccacctccctggttccagcgattcccctgcctcagcctcctcaatagctgggattacaggtgcccgccaccatgtccagctaaagttttttttgcatttttagtagagacggagtttcaccatgttggccagacttgtcttgagctcctgacctcagacaatccgcccgcctcgacctcccaaagtgctgggattacaggcgtgagccaccacgcccggacttaactttctaaattaactgacaccatctcagatattcagggttcacaaaggcttggaggggcctgcaaatatatacaattatagaattaaatagtgatggatagagtcccttattcaaaaatactgttataaattaagttaaaatattaaagtcaaagaaacttcacacccataatcgcaatgctttcagaagatggaggattattttgagctcaggactttgagagcagcttgggcaacacagcaagatgccatttctacaaaaatttttcaaaaatagctgggcatggtggtgtgtacatgtggtcccagctactggggaggttgaggcgggaggatcacttgagcccaggagtttgaggctgcagtgagatgtgctcaaatcactgcactccagcctggctgagagaccaagaccttatctcttaaagaaagaaaataggcggctgggtccggtgactcacgcctgtaatcccagccagggcacgcgaatcacctgaggtcaggagttcgagaccagtctagcgaacatggtgaaactccgtctctactaaaaataccaatattagccaggcatggtggcaggtgcctagaattccagctacttgggaggctaaggcagggagaatcacttgaacctaggaggtggaggttgcagtgagccaagatcatgccattgcactccagcctgggtgacagagtaagactgtgtctcaaaaaaaaaaagcatacttttgagttaaaacaacagaattaccattcaacccagcaaccattcctgggtacatacctaaagaaataccaattattctaccgtaaagacacttttgcacatgaatgttcattgcagcattatttgcaatagcaaagacatgggaattaagctagatacccatcagtggtagactgggtaaagaaaatgtggtacatgtacgtcgtggaatactgtgcagctgtaaaaaagaacaagatcttattattttttgcaggaacatggatggagctggagatcattgtccttagcaaactaatacaagaacataaaagcaaatatcgcatgttctcacttataattggaagttcaacattgagtaaaggtggcctcaaagaaaggaacaacagacattggggtctgcttgagggtgaagggtgggaggagagggaggattaaaaagctgcctattggccgggcgcagtggctcacacctgtaatcccagcactttgggaggccgaggtgggcagatcacgaggtcaggagttcgagaccagcctggccaagatggtgaaaccctgtctctactaaaaatacaaaaattagccaggcagagtagcaggcatctgtaatcccagctactcgggaggctgaggcacaagaatcacttgaacccatgaggcggaggttgcagtgagccgggatcgcaccattgcactcaagcctgggcggcagagtggcactctgtctctactgcatatcagatattgtgctgattatgtgggtgacaaaataatctgtacaccaaactcccatgtcacgtaatttgcctgtgcaacaaacctgcacatggactcctcccgaatctaacatacaagtttaaaaaaatacatgtttgtacagctgcaccacgtgtgtatgtgttttaagctatgtgttatgatgactcaaaaacgttcaaaaaattaaaaggtgttaaagttataaaaaagaataaaatgcatcacacttttcaaatcatgaaatacctttttttacccatcgtgaatgtaaacattgacaccaatgggaagcttgagtattgtgtccattttacagggcaagaaaacaggggaatgggtaaatagcaaaacgagcaaagaaatgagtaggcaaaggcccatcacctatttctttgtggatgtctttgttgaactttttttcaacaaaatgaaaccaagccccctgattgttagttacctcacgcccatagtcttggccagtgagtcttttcgtaaaatggtactcaccgcagagtacattctgaatacacgttagacaacgatgaccaggaaaattcctgagtttttgatcgatcacattcctggccaaatcagatggatatttaagacctcagtgtgccctttgcaatcttgcaactcctgctttggttctctggaagaaatcttcttgtcgaagattcttactaaaactcaatgggttaaaatgcaaagatcttatttgttgcatagaatcaagactctgggtcaatacctggcagagtgactggaggctgcattggggtggactgtttttagacggcaggtcaggccccagagagaggtagttgggtgggaaacataagtcctatttctaatgcacagttgttgtgcctcctctggatatccaaatgtttggcacaatctgttttcctagaatcccagctgacatagagcagctaatgctcacatactgtcatccagccagtggctcatttagccaattaacacgctgatttcaaaagcattgtgaaaatatcactgcacacactaactagcttctgaccatcccttcccttcccttcctggcatatttctccagcgtaatctctgctcatagcctttcttacgagctacccacacccttgagcttcacaggacccattcagtctgtttgtgttttctccccgacctttcagcaatgtcaccatgatcttttcaagaatctttttctttgcttctcctgacaaatgcatcatccttctgagcaataaacagaggaattggcaaagttaataatgtcgttattgagcacttagtgaatggtgagcattatgctaagactgttttgtggtgtatccatacaccattccaacgatatatattttttaatttaagcatactttattggtaaacaatactaacaattatctgaacatttcgcgagtcaaaaccttattgctggtggagagtcttgcctcaatgttgctggctgtggactgatcagggtggtggttgctgagggtagagggtgctttggcaatttcttaaaatagacaacagtgatgtttgtcacatcagttgaccctttctgtcatgaaagatttttctgtatcaagcgatgctgtttgatagggttttacccagagtagaacttttttcaaaattcgagtcagggccgggcgtggtggctcacgcctgtaatcccagcactttgagaggccaaggcaggtggatcacctgaggtcaggagtttgagaccagtctgaccaacatggtgaaaccccatctctactaaaactacaaaaaaattagctgggcatggtggcgggcacctgtaatcccagctactcggcaggctgaggcaggagaatcgcttgaacctgggaggtggaggttgcagtgagccaagatcgcgctatggcactccagcctgggcaacaagagcaaaactccgtctcaaaaaaaaaaaaaaaaaaaaaaaaaaaaccaaaaaaccttcctgaaaggattcctcattctgaatgccatttagaaccttggtgattcatggcaggaagttaagatatccacattaacagaaatcgggaaaaagtgaattccaatattcatgaatgacattgagggggttcaagacttcagtggaggaagtcacttctgctatggtgaaaatagcagaagtaaaggtgcaggttgaagatggggctgaactcctgtaatctcatgataaaactggaatggaagaggagtttcttctcatgaaggagcagagaaaatggtttcttgagatagatactattcttgggcccatttcactgatgagaaaactgaggcctctccaggttgaagggtacaactaccaagtgtgggagtctgggctctaccccattactggacatctccagagcctgttctcccttctgctaagtttgcgggtcgctcaacattgtctccttggacgtgtgataagtcttcctgctcctccttcatcagtctttaacatttgagagacatttagagtggcctggaccaggctctttgctcattctcttttcttctactgaggcctctttcacaagtaggttttctcatctctctcttctttcatttattctctccttcattctctctttctcattctcttattctctctccctgtcttctttcctcttctcttccctcctcttcccctcctacttcttccttcccctccttctcctgcccctcatctcctcctacttctcctcctccttctccttcttctccttcatcttctttcgtttcttctccttccctttctctcctcctccttctccttctccctttccttcccttcccctctcttcccctccccttccctcccctcccctcccttcccttcccttttcttttctttttttttttctttcacggagtctcactctgttgccaggctggagtgccgtggcgcgatctcagctcactgcaacctctgcctccccggttcaagcgattcttctgcctcagcctcctgagtagctgggattacaggcatgcaccaccctgcccagctaatttttgtatttttagtagagatggggtttcaccatgttggccaggatgatctcagtctcctgacctcgtgatccacctgcctcagcctcccaaagtgctaggattacaggcatgagacaccgcacctggccccttctactttttttttcccttctccttcacctcctcttccccctcctcctgcttctcctcctcctctttcacctcctcctccttcctttctcctcctcctccttcctttctctctgtctctctctctctctctctctccctccctcccccccccccccccccccccgccgtctctctgcttctctctcattcactctcattgacgtccatatccaaatttttggaatcgcagtgctgccctcttagttctttgtcatgaaccatctgttgcccttggattgttttaccttttgtatccttggcagcttgacatacccatggtctaagcaagagtgttttctctgaaagtgcaggcatgagctgatacttgtgtgtttcatccattatcagcactgttttatgcatgtaaggagggtgtgtggcatttgcttcgtgggttgtaggaagggacacccaggaaacaaacaactaaagtgaagctttcctgcgggctaggatttgaaggtcatactaatgtccttcgagagagttaatgtcaagaattggtgtgaccaaacagtggtggatgtcatagtgttttcctcttttcataggttcacttttcaaatgagacagtagccatgagggaccatccatgcaggctgagactagtcttcaggaaaatatctatgcctagtagtttcagaaaggttagggttgcatagatgtacccacctgtccatcctgatccttactctaaattcgacctcttctatcattgctttcaccatcactgtcttgttggtgatgggcccagcttcgagaaactcagatctgcctcagtgctgctggagctggagagctggaagaaaaccaatatggcgtttgaaccgcacaatccaaaagtattgtagcagcactgattcataggttccttctcagtagaacctcttttgaattcctccaaacaaagccttctatttgagccatggcccttgagtagaccgatgtcatggactattagagtatgctattggtgctccagctacccatggccaaccaccaggcattacttaggtagagccccactgcctggcctatgcaccaggcatcaacatgaggtttcataaatacctgggagtacaagtgcagaatctctgttgaaagaatgcaatactctttttatttcttcaccgaataattaaataatttttatttcttcattaaagggcaattgaagagaagacaacatgtctctcttagtaggtaccatccccgagtagaactcatcctcctctgtgcaaagattcccattgttcagatcactctaatgctttgaggaaaacctccccacagtgtaacatacagaacactcttccgggggttatggcagatgctggagtctcttctaccaccacctaaagatgctggggtactctgcaacaccacctgaggaaaggaacaggatgaaacacctgttgtattagtcacctagggctgccatgacaaaatactacaggctgggccgcttaaacagcagacttttattttcccacagttctgaaggctggaagtctgtgagatcaaagtgtgggcagggctggttcttcctgaggcctctctgctgggcttgtagacaccgtcttctccctgtgtcctcatagggtcgcccctctgtgtgtgtctgtgtcctcatctcctcttatgaggtgtcttagtccatctcaggctgctatcacagaataccatagactgggtgacttataaacaacagacattgattctctcacagtcctggaggctggaagtctgagatccaggtatgggcagggctggttcctcctgaggcctctctcctgggcttggagacgccatcttctccctgtgtcctcacagggttgtcccaatgtgtgtgtctgtgtcctcatctccttttcttatgaggtgtcttagtccatttcaggctgctatcacagaataccatagactgggtggcttgtaaacaacagacgtttattctcccacaatcctggaggctgtaagtccaagatcaaggtgtaggcagggctggttcctcctgaggcctctcttgtaggcttgtagatgccatcttctcactgtgtcctcgcagggtcgtcactctgtgtgtctgtgtcctcatctcctcctctttttttttttgagacggagtctcgctctgtcgcccaggctggagtgcagtggcgggatctcggctcactgcaagctccacctcccaggttcaagcgattttcctgcctcagcctcccaagtagctggaactacaggtgcgtgccaccatgcctagctaattttttctatttttagtagagatggagtttcaccgtgttagccaggatggtctcgatcacctgacctcgtgatccacccacctcagcctcccaaagtactgggattacaggcgtgagccaccacacccggcctcatctcctcttcttataagcatcccagtcttctcggattaggggcctccctggtgactttgttttaccttaatcacctctttaaagactatctccaaatatggtgacattctgaggtcctgggcgttagggctttaacatagggatttgggagaaggaatcagcccatcacagctgtgcattctaagactccagtgactttgtgctgacaatggcttttccttgggtagctctaaccagatggtctggctgggtctatcttgagtctagtgactcccaccacgaggccaactgagcagggtggccaggaaagcctgtggccttacaacaaggtgatgctcacctgcagcacacaggccatcactgtagctctgctggctttattcttgggtttatagtgatggcttctttctgcctctgcctcccttgaggcatctcgtttctgtggttggagtactgtgagcctaagagacagagagcatgtccacagtcaggcttcccttacttgcttcagtagcatctcatgagtgtttccaatgcattcagggagactcttcttcactgaaggagtcagatccattttgcagctttgctgcttggaaccttgatggaatggctgagtacatggccgccagcgtcactcatgcacgaaaagtgttgttgaaagctaatagaaactgaaatctggtcgggcacggtggctcacgcctgtaatcccagcaccttgggaggctgaggcgggtggatcacctgaggtcaggagtgcgagaccagcctggccaacatggcgaaaccccatctctactaaaaatacgaaaaattagccgggcatggtggcaggcacctgtcatcccagctactcaggaggctgaggcaggagaatcgcttgaaccctggaggtggaggtttcagtgagccgagattgcgccattatactccagcttgggcaacaagagtgaaaatctgcctggaaagaaaaaaaaaaaaaagaaaaactgaaatagaagatttcccttcccccagttcactttgactgcgctaaagtaatttcctttgagggcagagaggacacggattgctttgggcatacttcaaaatgctactgtctccctaggaatattgcaaagtggttactttcccccaataacacacaactggatatttctttgatcttcaccctgggaacctggtggagctcccggaggtaaaatttgtgaaagtacaaggtcccctctaagatgggcccccagaagtttttctgttgttgttgttttttgagacagagtctcgctctgtcactcaggctggagtgcagtggtgcgatctgggctcactacaacctccacctcccagggtcaagcaattctcctgcctcagcctcccgagtagctgggattacaggtgcctgccaccacgcccggctaatttttgtatttttagtagagacggggtttcactatgttggccaggctggtctcgaactcctgacctcaggtgatctgcccgccttggcctcccaaagtgctgggattacaggtgcgagccaccatgcctggccaggagtttttaacttacttaggcttgtccactgtcagcctgcagctgtttaataattaccctgcaaatgtgtccatcaggtgctggctccagcaggaactcctagacaagcacaattccacttgccacctgtctgtccagtcttcaggcagcatttcgtcttgtgatctctattttctgatggatcgcagagttgctgattttcagtatgttctgctctttgcctattgtgaggataggaattaaaatgcgcaagctctctacatgttagtgaagtggctacgttgtctggggtatataccctggggttcgtcattgggcatcaggaaaatttaggacaaagacacacacgaggagtttaggagtggaagtttaatcaggagaagagaaagagaaatggttttctctatagagaaaggggtctccgagcggaaaggaccagctggcaccaaatgtgatggattttatagtccagtttgaggaggcggtgtctcatttacatagagctcagagattggttccatcaagcatggcatttacatagcccacaggaaaggctggttgcccaccctaatcgtttatgcaaatgggctttgtagttggtcggggctctccgagagattggttccatcaagcatgacatttacatagcccacaggaaaggctggttgcccaccctaatcggttatgcaaatgggctttgtagttggtcggggctctcggtcctgtttttcttactttacatgtggctgacaaagaggagggaagatggagccactgtcttgaacgtgtctagtctctagttcctgctgggaagatggagccgccgttttgaatgtgtctagtccctagttcctgccgggaagatggaaccgccatcttgaacgtgtctagtccctagttcctgccgggaagatggagccgccatcttgaacgtgtctagtccctagttcctgcccggaagatggagccgccatcttgaacgtgtctagtcgttagttcctcccgggaagatggagccgccatcttgaacgtgtctagtccctaggtcctcccgacattcacccgtacaagctcccagctggcttgtgtatgtctgcagctcgacttgacaggctgttcattgttagaaaatgacttggggctgcttttcgttaaagagaaaagctgccgggcgcagtggctcacacctgtcatcccagcacttttggaggctgaggcgggtggatcattaggtcaggggttcgagacgagcctgaccagtgaaaccgcgtctctactaaaaaaaaaaaaaacaaaacaaaaattagccgggcttggtggtgcgtacctataatgccagctacttaggaggctgaggcaggcgaattgcttgaacccgggaggcggaggttgcaatgagcgaacatcacgccactacactccagcctgggcgacagagcgggactccatctcaaaaaaaaaaaaaaaaagaaaagaaaaaagccttgccgaggactcccatacccttactgtctgcctaagtgatttcttcttaactcctgtatcactggcagactctgagttgcctgttgggtggagtactatattgccgagtatcatgactgtattagatgtgagggagacagtgtgaataggacatggtccctgaagagcacagagctttcacctggggctgggcggagcttctgtcctatccagtgttatggaacccttgcaagcacaggtcaagcagctcaagggctggaagacgtgcacacaaaatccaagggcaacgttggaaagaggtttagtgtttcttagaaaaatgccagaaggctgaagaagtgggggccccgagcagctctgaagggtgtgtatgcaattaaactgaagccaaaggctgagagagaggagtgagagccgcctacggagctctgtgcagcttcatcataaactcacagacaggcttcatgcagcgccgtctcagtgcattcaatgtttggattccacatgcatgcgtcctcaacccccttgcaatgctgttctccttggagggaaatgggtccttcttaccctatcacatgcaggtatctggtctaccagataaatgtgtgagaaatcaccaacaaagcagaaattacttttaattacaaagcagagtcatcgtaaaactttgtgcaaaatctttttttttttttttttccagacagggtctccatctgttacccaggctggagtgcagtggtgtgatcatggctcactgcaacttcaacttccgaggctcaggtgatcctcacatctcagcctcccaagtagctgggatgacaggtgtgcaccaccacacccagctaatttttactatctgcttaagtcatttcttcttaacccctgtatcattagaggagaaaccggaagcccctatttttgaaattagtaaccacctatcacctaaaattcctctcattactgtgacgataatgatgattttttcgagaccggatctcactctgtcacccaggctggagtgcagtggtgtgactgtggctcacgacagcttcagcctcccgggctcgagtgatcttcccaccacagtgtctaaagtagctggggctgtaggtacgcatcatcattcccagctatgtatatattttaaatattttgtagagatgggatcttcctctgttgctcaggctggtcttaaactcctggcctccagcagtcttctcacctgggcctcttaaagtgctgggattacaggcgtgtaccaccgtgtctggccaaaaaacatatctattctggggttcatagtgatgcttgtttctgccttggcctgtcttgaggcatctcactcctgtagttggagtactctgagtgtaacagatggagagtatgtccacacccactcttccctcacgtgtttctgtagcatcccgtaggagttttcaaatgcatttggagatgtattcaccctgtgacagattcaatgcatctctacaaggcagaatagctctaccatggtgtggctatggcgcttggctacctgagtctttattctgccttccaggtgcttgttggttggataactttgggtaggttcttgtacctctttgagcttcaagactgtcttagtcagctctggctgttgcaagaaaatacagttgaccttgatacaaaaattagctgggtgtggcgcctgtaatcccagatactcaggaggctgaggcaggagaatcgcttgaacctgggaggcggagattgcagggagccaagatcacaccattgcactccagcctgggcgacagagcaagattccatctcaaaaacaacaacaacaacaacaaaaaactagagttgacccttgaacaatgtgggagttaggggcgtcacacacgtccctggcacagttgaaaatccaaagataacttttgactcacccaaaacttatgaatatcctattgttgagcagaagccttatcaataccataaagtcgattaacatatattttgtatgttttatgtattgtatactgtattattaaagtatgctagagaaaagaaaatgctgtttgtttttttttagccgggcgtggtggcgcacgcctgtaatcccagctactcaggaggctgaggcaggagaatcgccttataaggaactttgagaatcaaaaatcataaggaactttcattcttttttttttttttttgagatggagtttcactctgttgccctggagtcaggctggagttcagtggtgtgatctctgctcagtacagcctacgcctcccacgttcaagtgattctcctgcctcagcctcccgagtagctggcactaaaggtgcacgccaccacgcccagctaatttttgtatttttagtagagacagggtttcaccacgttggtcaggctggtcttgaactcctgaccttaggtgacctacccgccttggcgtcccaaagtgtggagattacaggcttgagccaccacgcctgataaggaacttttattctaagtgaagtaactcagggatgaaaaaccaacatcgtatgttctcagtgttacgtgggagctaagctatgaggacacaaaggcataagaatgataaaatggaatttggggtcttgggggggaagagtgggaggggggtgagggataaacactacaaatagggtgcagtatatactgttcgggtgatgggtgtaccaaaatctcacagatcaccactaaagaacttaggtaaccaaataccaccagtaccccaatcacttatggaaagataattaaaaacaaaaaaggacaccaaactaaatttttaaaaatcatagagaagagaaaatatatttactatttctgaagtgggagtggatcgtcatgaaggtcttcatccttatcgtcttcaccttgagtagcctaagatgagagcggacaggagggattggtcttgctggctccggggtggcagaggtagaagaaaatgcccgtagaagtggacccgtgcaattcaaacctgtgttgtttaagggttaactggaccatagatggggtggcataaataacagaaatttatttctctatagtactggaggcagaaatgtttacatccaggtggcaccatggttgggtacttgagaggttcctcttcttggtttacagatggtctcgcagggcagagagagaggggggtggagcacgagggagcatgtgtgccctggtgtctcttcttacaagggcacgaatcccaacataaggatcccaccttcacgacctgatgtaaacatcatcatctcccaaaggctccgtctccaaataccatcccctttggcattagggtttccacacatgagattcggggtgacaccattcattccatagcaggagccctccttggcagactgggacaccaacgcctcttccctcttgggctgacacgagctgtaaatgtcagtggacatttaaatactgcgttacacattcgatgtcctgtctgcaatggagccgggttctgtaaacataagctgccatggcgaaatcggatcatcatcgcccatcaagctctttggcagcagtgctgtaatcagtgcaaacatttatttatataaatgctcccatcccctcggcatgaagatatacttaggctctctcaatggacagccacgccacaagcccaggaatgagagcttgtcagatactgaggctgttttcagagccagtgttcggctgaagtggcacagaagctatcattgtttgcaaatctctgctgcttgtcaagccacagggttaagtaaccccggatgttgcgaacactctgaagtgctgacctgcagtgtctttttggatcactgagccctcaggcagacaggctgtacgtggaccgacacgtcatggctgctgtcttgcacttaaccctctttatctttagaccttgattgtgcacctgtttctcattggaagctaatgacaatccacgaagcggcttggcagtgactgtctctgattgtgtaaggaggggttgccacattcacccatgttgttgactttcaactgtacacttgaaaacgtcaaaagtcagagtaagcattgcctcatgtctccgagtgtagcaattctaggaaaactcttccgaatgggtttaaagtcaaacaaatccaatcaaaacagacttgcagggccaggcacggtggctcatgcctgcaatcccagcactttgggaagccaaggtgggcagatcacttgaggtcaggagttggagaccaacctggccaacatggcgaaaccccgcctccactaaaaatacaaaaagttagccaggtgtagtggtgcgtgtctgtaatcccagctactcaggaggattagggaggagaatctcttgaacctgggaggtggaggttgcagtgagctgagatcaccccactgcagtccagcctgggtgacagagcaagatcccatctcaaaaaaaaaaaaaagaaaagaaaagtccacatagggaaatatgtgaagctctttgggtcatatgatcgctaccacaacagcgcaatatgtaaatgaatgggcaagttctgtgttctaagaatcttgagggacactgagatgtaaatgtatatatttatcacgtggcacaaaatacagttgacccggccgggcacagtggctcacaactgtcatcccagcactttgggaggccgaggcgggtggatcacctgaggtcgggagttcaagaccagcctgaccaacatggtgaaacccgtctctactaaaaatacaaaaaattagctgggaatggtggtgcgtgcctgtaatcccagctactcatgacgctgaggcaggagaatcgcttgaattcgggaggtggagattgcagtgagctgagatcacgccatcgcactccagcctgggcaacaagagggaaactccacctcgaaaaaatatgtatatacagctgacccttgaacaacacgggggttaggggtactgacctctatgcagttgaaaatctatgtataggttctgactcccccaaaagttaaatactggtagtgtactcttgaccggaagctttattcataacatagagtcgattagtacatagtttgtatgttatgtatattataaagtcagctagaaaaaaaatgctaaggaagagaagagaaaatattttactacttactaaatggaagtagatcatcataaaggtcttcgttctcttttttttttttttttttgagatggagtctcactctgtcaccgaggctggagtgcagtggcacgatctcggctcactgcaacctccgtctcctgggttcaagcacttcttctgcctcagcctcccaagtaactgggattacaggcacacgccaccacacctggctaatttttgtatttttagtagagacggggtttcaccatattggccaggctggtcttcaactcctgacctcgtgatctacccgcctcggcctcccaaactgctgggattataggcgtgagtcactgcactctgcaggagtagggagaggagggggaggggaggaggagaagggagggggggaggaggggggacgaagagggaggaggagtcatctcgggtgaaagtccaaatgggtgaatctgctcagttcagatgtatgttgtccaacagtcaactgtgttatccttcttttgattttttttaacccactgtttaaaagatgtggaaatagttttttggtttacaaggtgcacaaaaataggcaaggggctggattttgctagagggctgcagttgaccaaccccgggttagaccattaccattgtcagtgggcacacaaagtaatgaaattattatagaaaacatgaggcgttgtttactggaaaggggtcttgatcctgaccccaagagagggttcttggatcttgtgcaagaaagaatttggggtgagtccatagagtaaagtgaaagcaagttgattaagaaagtaaaggaataaagagtggccactccattggcagagcagcaccgagggctgccagttggtgatttttatggttatttcttgattctgtgcgaaacaagggaaagattattcgtgagttttctgggaagccggtgggcggttctgggaactgagggttcctcccctttttagaccctatagggtaacttcctgacattgccatgacatctgtaaactgccatgaggctgatggaagtgtcttttagcagcgaatgcattagagttagcgtataatgaacagtgaggaagaccagaggtcagtctcgtcgccatcttggtttgcatggggtttggccagcttctttaccacaacctgttttatcaacaaggtccttaggacctgtatcttaatgccgacctcctctcatgccagtggtcatgtgcattcatctggctggaagggtatctttttttttttttgagattgggttgtcactgtgttgcccaggctggagtgcagtggcacagccttgaccttctcagctcaagtgatcctcccacctcagcctcccaagtagctgggactacaggcatgcaccaccatcaccacacccagctgcttttttttttttttttttctgtatttttggtagacacgaggtttcaccatgttgcccaggctggtctcgaactgctaggctcaagcaatcctcctgcctcagcctcccaaagctctggtattacaggcatgagccactgcacctggccttcaggactatcttcagacacttgttgtagcctcttcatttctgcacatccctccccagcggagatgctctcacaaattgctcataaggaaatttcttgtgggctccaaaatctttcccctaaaacagagttctgttgaatttctccctgacaatgtaaattaacaacttgtcttcacaagtgtgggacaaagataagactagaaatgatctctccgcccaccctgagacaaatgcatgtttgacatcttcctcttctgtatgttgactttgtcttatgcaaaagtggatttactgtgcatgaaatgaacgcgtgattgactgttcctctacccgcactttgccatgtaaaatgtgtattcagagagtgccaatcaaagactcacaagaatgtaatcatttgcctcttttatctactctccttcttttttttttctttcctctttccctcctgcctgcttttttccctttctataccaaagccctcaaaaccatccttggaaaaagcacagggccgcacgcagtggctcacgcctgtaatcccagcactttgggaggccgaggcaggtggatcacctgaggtcaggagttcaagaccagcctgccaacatggcaaaaccccgtctgtactgaaaaataaaaaaaatagcagggcgtggcgttgcatgcctgtaatcccagctacttgggacagtgaggcagaagaatcatctgagcccgggaggtggaggctgcagtgagctgagactgcgccactgcactctagcctgggccacacagcaagactctgtctcaaaaaaaaaaaaagccaggcgcggtggctcacgcctgtaatcccagcactttgggaagccgaggcgggtggatcacctgaggtcaggagtttgagaccagcctgacaaacgtggtgaaagcccatctctagtaaaaatacaaaaattagccgggcgtggtgacgtgcacttgtaatcccagctactcaggaagctgaggcaggagaatcacttgaacccgggaggcgaagggtgcagtgagccgagatggcgccattgcactccagcctgggcgacagagggagactccgtctcaaaaagaaaagaaaaagcacggagcacaggtcctatggtgactggcgtctgtttttcctggactggggcacattctcaaccgtggcaaaattaacctctaaactaatggaggcttgcctcactcatcttctttgattcaaaactttgagttaatccatttatgcctgaagttgcaagtttttgaatttttgccatcagatcttggcgatgaccttgagcagtaggatataaataactccacatgcttagcattccaataatggaacactaggcatacgtgggtttaatcaaaggagagatcatctgtgctggacctgcctcaaagagggtgagatgaatgagtaattcttcttcttcaaataaacttgagatggtctcagagatccttttcctggtttttgttgttattattgttgttgtttttgaggcagagtcttgctctatcacccaggctggagtgcagtggtgcaatctcggctcactgcaacctccacctcccaggttcaagcgattctcctgccccagcctcccaagtagctgggattacaggcgcccactaccatgcctggctaatttttgtatttttcgtagagacagggtttcacccttttggccaggctggtctcgaactcctgagctcaggtgatcttccccacctcagcctatcacagtgctggaattacaggcgtgagccaccgcagccggccctttttgctggttttgaagaagcagactcccatatgacaagttgctgagggtgtcacagcaagcagagagccaccattgtctgacagccaaaatgaaaatgagacttggccgggcgcggtggctcacgcctgttatcccagcacttttggaggccaaggccggtggatcacctgagatcaggagtttgagaccactctttccaacaaggagaaaacccgtctctactaaaaagacaaaaattagctgggtgtggtggcaggcacctgtaatcccagctactggggaggctgaggcaagagaatcacttgatcttgggaggcggaggttgcagtgagctgagatcgcgaaactgcactccagcctaggcaacagagtgagactctgtctcaaagaaaagagagaaaatgtgactcaatctcacaaccacaagaagctgaattttgcctcccaattcagcatgcctggaagagcatcctaagctacagatgtcatctcagctttgtctgacaccttaattccagccttgtgagactctaaatggagacatcctgttaatctaaacccaatcttctgacttacagaactgtgagatcataaaggggtgttgttttttaaactactacgtttggggcgttttgttacgcagcagagctagctaagatggatggctccttaagcagctcatttgagggcagagggaggcaacttctgcagacagatgggcatctatattcgctaggttcaagctgttaatgctgctatgtatacccaaatgacctcactaccttctcaccaggcagcaagaaacaggatcctcagacgaacagaagtccaacaccttagtctaagtctgtttatgttctcctgataggaaatcttttcatctcataaaaagctgctgatgtaggcctttctcaccctgtaccccacgttactgatgcctgttttgttgccaaactggactggtgtccacttgcctggtgcacttaggtcaaacctccacaatgaggctttgcagcaagagaaaggatagtgtttatttggacagcaccaagccaggagactcaggcagctcacgcttaagacctaacgttttttttttttttattgaaacggagtttcactcttgctgcccaggctggagtgctatggcgtgatctcagctcaccgcaacctccacctcccgggttcaggcaattctcctgcctcagcctgctgagtggctgggattacaggcatgcgccaccacgcctggctagttttgtacttttagtagagacagcatttctccatgttggtcaggctggtctcttaactcccgacctcaggtgattccctcgctttggcatcccaaggtgctgagattgcaggcgtgagccaccgcacctggcctaagacccaatcttttcaatgacttccgagccatagtgtttcaagtcgggtaaatttcaggacagaagctgctccaggcaaaatcatgaggacgaagttctgatttttttatcttgcccaaattcctatctaaagggtctagggagtcattctttacaaaccatgagttctcattagatgggttttatttaaccctatatatcgtaacttactttccaatgtgactctggcataacataatgagacaaggaaaaacaatgtatttaaccccaaaatatatttccttgccataccttgaaattgccctgagaagtctcttgtgggaaaaatccacattctatagagaatagcctttcctccctccctcccttacctcctttacctcccttccttccttccttccttctccccttccttcctcccttctccccttccttcctcccttctccccttccttccttccctcccttctttcccttccttccttccctccattcctttccctctctcccttctttccctccctccctcctttccctccctccctccttccctccctgcctccctccttccctccctcattccctccttccctccctcattccctccttcattccctccttccctcccttccttccctccctcccttccttccctccttccctccctctcttccttccctccttccctccttccttccgtccctccctttgttcctttgttccttcccagatctgggacataatcaactgagagccaggcccccttttaggtctgataagaaacattttacaacctgttctctctgaagtctgctatctgagagcttcctgtgcaaaataaaacttggttcccacaatcctttatctccacctggacatttcctttctgttgattccaggtcttcagataaactcaaccagttgtcaaccagaaaatatttaaacttacctatagcctggcagcccccaggttgagttgtcccacctttctgaaccaaaccaatgtatttctgaaatgtatttgattgatgtctcatgccttcctaaaatatataaaatcaagctgcaccccgaccacctggggtacatgttctcgggatctcctgagggctgtgtcacgggccgtggtcactcatatttcgctcagaataaatctcttcaaatattttacagagtttgactcttttcatcaacaattataaatcacggctgggcgtcgtggctcatgcctgtaattctagcactttgggaggccgaggtgggcagatcacgaggtcatgagatcgagaccatcctggccaacatggtgaaaccctgtctctactaaaaatacaaaaattagctgggcatggtggcgcttgcctgtagtcccagctatttgggaggctgaggcaggagaatcgcttgaacctgggaggcggaggttgcagtgagccgagatggcaccactgcactccagcctgggcgacagagcgagactacatctcaaaaataataagtaaaaaaaaaatcataaatcaatacatggaagctatacgttggtttggcctaaaaagggatatcttgggccaggtacggtggctcatgcctgtaatcccagcacatttgtaggctgaggcaggcagatcacctgaggtctactagtagttcaagaccagcctggccaacatggtgaaaccccgtcttgactaaaaatacaaaaaattacccaggtgtggtggcaagtgcctgtaattccagctacttgggaggctgaggcaagagaatcgcttgaacctgggaggcagaggttgcagcgagccaagatcatgccactgcactccagcctgggcaacaagagcgaaactccatctcaaaaaaaaaaaaatatatatcttgaagctgggcccgagggtggggttgcttacaggaacaaggtggattcaaagacttttggacttgcaattggttaaggaagtggagctttgtctaagacttgcggtcagcagtaaaagcacattggatctggcccatgggcaggacctcctccaggaccctcaggaagaaatttaaaacaaggaacagggatcagagttcagtccctagctctcccacgtctgaggtcttcatgccagaggattccatagggtagaggtgtgagtttcttttattttttttaattatactttaacttctggggtacatgtgcagaatatgcaggtttgttactaggtatacacgtgccatggtagtttgctgccatccatcatctacattaggtatttgtcctaatgctctccctcccctagtcccccagtccccgaaagacccctgtgtgtgatgttcccctccctgtgtccatgtgttctcattgttcaactcccccttatgagtgaaaacatgcagtgtttggttttctgttcctgtgatagtttcctgagaatgatggtttccagcttcatccatgtccctgcaaaggacatgaactcatccttttttatggctgcatagtattccatggtgtctacgtgccacattttctttattagttgctctagggaagcgaacatccctgactctaatttccttggttgttattttaagctactgtgactttcttcttcatcaagttgctcattaacttctcccagccagcgaagtgcctggagtttccttcctggaaggaactcaagatttctcttgatttccatgcttggtcgggggtggagagagtttcctggtttgcccctaagaggggtccctgccaggtctcagttcctcaagctttctctttagcacctttagcagacagatactatcacagcttacagtgcttgcagcatgggtggtggcgtggggattttgatgccgttggattttccccactttttccattttgtgcccagaagcattactcttgaagcatttaaatttgaacacagtgggaaacagcttcttaggaattaagttttaactggtttccagtgtatctaaacagcagacaggtagacccttggtaacttctttttgatgtataaacaactcagaccattaaatcgacgctcattagcaacctatgctgctcatccaagctaccctgaagtttacttttagcccagtcctgtgggtggataatggtttcaacgcattcccaggaggacgatttacctccttggagacagaattgttcttgaaagctcttcacaagtccgcgtttccacggcaacatcaagattgacttctcgcccttgggtagtgccttgtcttcgaaagcctttctttcctctttacttacacaagctctttggggcatctgctctttgcctcgcgggtgggtcaatggtgctttcattttaatcttcttttctagactagacctgggagtcagaggacaactttaattatctgaacactttaccattctgacaacaatatttacagagtttatcctgaaggtggtttctgaggacagctgtgtatccgaggagcattgttttaacttgagttctctcgtagtgatgtatctcaagtgctcaagagggagaggagggccatcgtagtaaacacaatgaaaacaaaggcgtcacccacttatttatcccaccatgccaggcagctctctccccatctctctctttctctctctgtatgtctctctctctttctctccctctctgtgtcacaacctctgtctctctcattctattcctctctgtccctctctgtcactttctctgtgtctctcctctttctctctctctgtctctcgcttattctctctgtctctcagtttctgtgtctctctccttctgtctctctttttttttttttttgacacagagtgttgttcttctcattcagtctggggtgcaatggagtgatctcggctcactacaacctccgcctcccggattcaagcgattctcctgcctcagcctcccgagtagctgggattacaggtgcccgccaccacgctcagctagtttttatatttttagtagagacggggtttcaccatgttggccaggctggtctcgaactcctgacatcaggcgatccacccgcctcggcctcccaaactattgggattacaggtgtgagcctgtatctgtctctctgtgtctctctggcacactctctgtctctttcaagctctctttctgtgcttctatttctgtgtcacaatctttctctctgtctctttcctccctctgtctctctctttctctcccattctcaccctctctttctccataactttctctgtgttttgttcttttttcttcctctctcttgcttattttctctctctctccctctctctctctctctcacacacacacacacacatatacacacacacacagaataatctcgctgcagcgtctttcacagtaggtcttaggggcagatggatagctgcctcatacaaagaaaataggatttcaggtctccagagaggcgctccatacctgcataacgactaagagatactggtatttcacctttatttttaaattgataaatatatagaaatgagagacgcagggggtgacaaccaatctgccctccttcttggcaaattccggcagttcgggcacctgggttccttccctcctgaatgaagagaggccagaagccatcatgagcttcgtccctgctcaagactttgcaggctgtggtcgcatcagctcttggctccaagaactgggctttttgggtagcaggacggctgttgctacccacaagtgcgggaagaactgtcctctggctgcctggatcccggaggttctggcttaccaagacactcgtgaatttattaggatgcgtagggacggggcaggtgcagacggattcaggggctgtgttggctgttggtagatgcttgaaagctgttgctgctctgagctgaacgccttctccacaagcgctgcctcctggtctaaatgatgggtttttattttatattattttgagacagggtcttgctctgttttctaagctggagtgcagaggtgcagaggcataatcatagctcactgcagcctcaacctcctatgctcaagcagtcctgccacctcagcctcccacgtagctgggattgcagacatgcaccaccacactcagataattttttatgacttccttttgtagaggtagggtcttgctatgttgcccaggctgctcttgaactggcctcaagcaatcctcccacctcggcctctcaaaatgctacagtgacagggtgagccaccacacctggccatgatgattttcaaattagcccagttgggttacaaggttgactaagatctgattttcaggtagtggttatggacacacttatcacatttattctaggagctctttaataatatttcagaatggacagcatttctggaaatttttttcttagtattaaatacatttgcttttgtatgtctcagtggaagacttctttaagtttacatttttatgatttttttcttctgtatatataaatgttactcatcaagcaattcctgccctcctagcaaatttcttctgctatgcttttttcagaatttctatcagaacagcataaatttcacaaaacaaaccacctcagactctttttgtccaaccagtcagtatcagggcacttatctgttctttgaaagtctagaagaattttctaaaataccctctgcactcatctaccctttcttcatgccattctttcattattcttctctatttttcttatagctattggtctgattagacctaatttccttgattgaattgggataattagtatctctgagaaaattatttcctcgagattttcacattttacttacaaatgtaacatattatcaggatactaagaaacagaaacctatcattttaaagcttttttcatacagtacagtgtttcctatttgtaagtttgcatttcctgcctcattaaatatattattgacagtattttctgggaccttgtttctccttcttccttccttccccgtttccacccatcctttcctccttccctttcttccctcctttctccctccctccctttctttcttccctccttccattcattcttgcttccctcccctcccctccccttccctctttccacccatcctttcctccttcccccacaatgttgattttgttcatttctccctgcctacctaggaattcttgaaaaatatacttggatattgtgttattctgaagaaaatgctgtgaaaatggcacattatagcttcatctcaattcagcatttggtttatgattttcaagttagccctgttgggttacaaggttggttacacagatccaaaccatgccttcataggcgatgatcctccttgttccattaacgttttagacttcaatcattgctgtcttgtgtgactagggccatttctacttggtttttgcttgtttggctgataaatgtgaacgttttaacaattgttgaacaattgttaaaacaattgtcgaacaattgtcgaacagttgttttaacaattgtaattcctcctttttaatactctgtatctttaccatcaagatacagacatcacctttttcacaggctctgagtgtaggaggccaccattttggctttatatcatgaccagtaactgggagcgccctcgttggctgaagctgtacttcctgcttcttttctgttcttgccacatggataactggtatactccatcttattccatgagctacgtggcagacactcattttgtagctcctaggagtgcgttaaatactcccaaacactctaactttcatttctctaaattatctaaatagaatgaaggtatcgttgaaggtactccaggtggaatgaaaaaacctatctcaagtcttccggagatcctcctgtgttcggttccctggtccctctcatggtgccctgggaaagggacgcagctcctacatgggttaggttccaggtgaacgcagccactgagctcctagcaagtacgatttcctgtgtcctatgcgcagatcaccctggtgtcttggtccagtgggcttgaagcctcatactcttttgtttttccttgttttttattttattttttttatttttattacttttttttttttttgagagggagtcttgctctgtcgcccaggctggagtgcagtggcacaatctcggctcactgcaagctccgcctcccaggttcatgccattctcctgcctcagcctcctgagtagctgggactacaggcgcccgccaccacgcctggctaattttttgtagttttagtagagacagggtttcaccatgttagccaggatggtctcgatctcctgacccctcgtgatccacccgcctcggcctcccaaagtgctgggattacaggcgtgagccacccaccccccggccttgtttgttttcttttaaaaaaaatttcatgaggtacacgtgcagctttgttgtaagatacattgtgtagtgctgcggttcacgcttcagttgaacctgtcactcaaacggtgaacaaaatacctcataggtagagttttagcctttacacccctctccctcccctgctcttggaatgcgcaggtgtgccagcttcccatttttatgcctgattattcaatgtttagctcctatgtataattgagaacaagtggtatttaattttccgtttctgtgttaattcacttaggataatggcctccagctgcatctgtgttgctgctaaaaacatgatttcattcttttttatggctctatactattctacggtatatatgcagcaactacattttcttcatccaacacataattgatggacacctgggctgattccctcatgcctcccaagattgaatcaggaagaaatcagatccagaacagactcatttcatgacaagttatgaaattgaatcagtaatttacaaaaacctatcaatcaaaaaaaaaaaaaaaagccccaagaccagacaaattcacagctgaattcgaccagatgtacaaagaagagctggttccaatctgactgaaacgattctaaaaaattgaggcggagggattcctccctaacttattctacaaaacctgtatcatcttgataccaaaatctgacaaggacacgacaaaaatagaaaactacaggccaatatcccagatgaagatagacgcacaaatgctcaaccacatactagcaaacagaatccagcagtgcgtcaaaaagatgactgatcatcgaaaccttgtctctactacaaatacaaaaattagccaggcgtggtggtgcgcgtctgtaatcccagctacttgggaggctgaatcgcttgaacctggcgggtggaggttgcagtgagccaagatcgcaccactgcgctccagcctgggcaacagagcaagactctgcctcaaaaaaaaaaaaaaaagataattgatcgcaatcttaattgtgggcttcattcctgctctgctctttgtccaaagagatttttctgaatgtcaggggtgaagttcaagttctagcacccagtgagcattctgccttcccctgctgcagggcttgatgtatcggctcatcttcccctagtgatgccagccataccctgttccccttacccttcctaccagtgtttctcttggtgcgaggtagctcctgaatggatgcaaaaaaaaaaagatgctgattgcaagaatgagcaaagcccgttggttgcctgtattactccgttctcacactgctctgaagaaatacctgagactgggtaatttttaaaaattttaagttccgggtacatatgcaggattgtacatagataaacatgtgccgtggtggtttgctgcacctatcaacccatcacttaagtattaaagcccagcatgagttagctattctttttattattgtactttaagttctggggtacatgtgcagaacatgcaggtttgttatataggtatagacgtgccatggtggtttgctgcacccatcaactcgttatctacattaggtatttcttttaaagctatctctccccttgccccccaccccccaacaggccccagtgtgtgatgttcccctccctgtgtccctgtgttctcattgctcaactcccacttaagagtgagaacatgtggtgtttagttttctgttcttgtgttagtttgctgagaatgatggtttccagattcatccgtgtccctgcaaagcacatgaactcatcctttttaatgtctgcatagtagtccatggtgtctatgtgccacattttctttattcagtctatcaatgacgggcatttgcgttggttccaagtctttaatattgtgaacagtgctgcagtaaacacacatgtgcatgtgtctttatagtaggatgatttataatcctttgggtatatacccagtcatgggattgctgggtcaaatggtatttctggttctagatccttgaggaatcgccacagtgtcttccacaatggttgaactaacttccactctcaccaacagtgtaaaagcattcctgtttctccacatcctctccagcatctgttgtttcctgattttttaatgatcgcccttctaactgatgtgaggtggtatctcattgtggttttgatttgtacttcactactgagcaggcattagctatttttcctgatgctctccccctccctgacccccacccacaacacgccccagtgtgtgttgttcccctccctgtatccatgtgttctcattgttaagcacccacttatgagtgagagtgtacagtgtttggttttctgttcctgcattagtttgccaagaataatggcttctagctccatccatgtccctgcaaaggacatgatctcgttcctttttatggctgcatagtattccacggtgtatatgtaccattttttttaatccagtctatcattcttgggcatttgagttgattccacatccttgctattgtgaatagtgctgcaatgaacatatgtgtgcctgtatctttataatagaatgatttctatttatttggatatatacctagtaatgggattgctgggtcaaatggtgtttctggttctaggtctttgaggaattgctacactgagactgggtaatttataaagaaaagaagtttaattggctcatggatctgcaggctgtacgggaagcagagcagcttctgcttctagggaggcatgaggaaatgcataatcatagtggaaagtgaaggaaagcaggtgtcttacatggccctagcaagagaaggagagacagaggtgcagttggggtgggctggggagatgctacacacttttcaacaaccagatgccacgagaactcattcactattgcaagcacagcacccaggggatggcactaaactattcctgagacatccacccccgtgacccaatctccccctacaagggtccacctccagcactggggattccaattcaacttgagatttgaatgaggacacagatccaaaccatatcactacccatctatcaattcatccatccatctatccatccatccatccatccatcagttcatccatccatccatccatccattcatccatccatccatccacccacccacccacccatccatccacccacccacccatccatccatccatttatccatccatccatccatccatccatccatccatccatttatccatccatccatccatccatccatccatcagttcatccatccatccatccatccatccattcatccatccatccatttatccatccatccatctatccatccatcaatccacccacccacccatccatccatccacccatccatccatccatccatccatccatccatccatccatcagttcatccatccgtccatccatcaattcatccatccatccactcacccatcctctcatgtatccatccatcaatccatcgatccacccacccacccatccatccatccatccatccatccatttatccatccatccatccatccacccatccacccatccacccatccacccatccatccatccatccatccacccacccatccacccacccatccacccacccacccacccatccatccatccatccatttatccatccatctatccaatccatccatccatccacctatccatccatctacccatccttccacccatccatcaattcatccgtccatccgtccatgcatgcatccatctgtattagtctgttcttgcattgctataaagaagtacctgagattggatgatttataaagaaaagaggtttaattggctcatggttctgcaagctgtacaggaagcagagcagcttctgcttctggggaggcctcaggcaacttacaatcatgatggaaggtgaagtggaagccagcacgtcttaatggctagagcaggagcaagagtggaggggaggtgctgtgcacttttaaacaaccagatcttgtgggaactcattcatggtcacaagaacatcaccaaggggatggcgctaacccattcgtgagaaatccacctccatgatcccatcacctctccccaggccactcctccaacactgcggattacaattcaacatgagatttgggtggggacacagatctaaactatatcaccacctcgcaagccagtgatctcaatagaatgctgatgttcatgttgctagtggctataagccttttttctcaaggagcaagaaaaatgcatcttctagtttttttaaaaaaaatccattcacactgctgtttttggaagctcagcttgtgcttttacccatcctttgatcactggttccaattattagcagtagtatgggttttcctctttcttacatccccacaagtgtttttgtggaaaattacagcagtacctcaggagtttctatccagatgacactgtgctcagaatcagcgcttttaaactctccatggcaaaactgcctctcccctaatctgcagcagattgataactgccgtagatacaataaaaatgaattactaaaaaaaatgcatttaagaaacatggaaactagaagctctcagtgtgttttttttaagtcattggattgaacaaagcttaaatgactgtcattattttttaagtttctaaacatttactttcaatttctgaacatgtctcaccacagacagcttgcagtaacagttcacagagtggcagccgtctgattcaggagtgtgtgtaccatcataccatccaatatattactttatttatttatttatttattttttgagacagtctggctctgtcacccaggctggagtgcagtggtgcgatctcagctcactgcaacctccacctcccgggtttaagcaattctcctgcctcagccatccaagtagctgggatttcaggtgcctgaccccatgcccggctagtttttgtatttttagtagagatgcagtttcaccgtgttggccaggctggtcttgagctcctgacctcaagcgatccgcccgctttggcctcccaaagtgctgggataacaggtgtgagccactgcacctgcccacccaactgtatttctctaaggaaaatattgaaagtacttatttccttttccttgatggcctggtgacttggtacagatgggcttcattctccatgatgaggaagctgttatattatcttaaaacatgccttccaagagaaggttaaagtatatatttcagatcacaaggtcaggagcacttttggctgccacgtttggctgactcttggatgttgtgttatttaaagtgtcctagatcagccacaataaaacaaaacctaatcactgtgtctcaacctcaggtgtgtgctgcaggaagcgccagttcttgtgatatcggagccatgtccacctctgttctggggacccgggaccccacgggttggtctgagtatgtcatcaagagctagatgaggccgggtgaggtgcttcacacctgtaatcccagcactttgggaggccgaggcgggcagatcacaaggtccggagttcaagaacagcctgggcaacatggtgaaaccctgtctctactaaaacacaaaaattagccaggcgtggtggcgggtgcctgtagtcccagctactcaggaggctgaggcaggagaattggttgaatccaggaggtggaggttgcagtgagccgagatcgcaccaccgcacttcagcctgagctacagggtgaaactccatctcaaacaacaacaacaaagaactaggtgaaaagacctggcgtgctcctgcagcgcaaccagccgtgatcatacaaagaccagaatgctgcaggatggcatgtcatggcccatccctctcatctctgctccacgcagcaataagaccaaagctaacctgcttccagagacacctcgtggaaatgtgcaaggctcagcaaagaaaggctaatatctaatgattcatgtatttacacagctttttttttgagatggagtctggcactgtcaccaggctggagtgcagtggcatggtctcggctcactgcaacctccgcctcccaggttcaagcgattcccctgcctcagtctcccaagtagctgggattacaggcaatgcaccaccatgcccagctaagttttatatttttagtagagacagggttttgccatgttggccaggctggtctcgaattcctgaactcaggtgatcgcccgcctcagcctcccaaagtcctgggattacaggcgtaagccactgcgcccggcctgcttttttatttcttactagcacgagaacttagagtgatacaaatcttctgaatattttggctgcattctgcagacggtgacaccttctgtttccgtggatattatttataaaacatttttgtcacctgctatgaattgttaccctgtccacatgctttaaaagggcagtttttgaaatcaacatgagtttgggcactgggaaattgcatacttaataaaattaaacattaaaaaggggctctttctgctttcctatcaactcaggcagcagggtgatagatatagggggtgagggatgcaccctgtgttggccagggttctctagagggatataactaacaggataaatagctatatataaaggggggtttattcagtattaactcacaggatcacaaggtcctacaataagctgtctgcgagctgaggagcaaggaagccagcccgagtgctaaagctgaagaacttggagtccaatttttgagggcaggaagcatccagcacgggagaaagctgtagcatgggaggctaggccagtctaaccttttcacattcttttgcctgctttttgaatgtgctgtgctggcagctgattagatggtgcccaccccgattaagggtgggtctgcctttcccaccccactaactcaaatgttaaacttgtttggccacaccctcacagacacacccaggatcaatactttgcatccttcaatccaatcaggttgacactcggcattaaccatcacacctggtgtgtgtttctctgattataaggacaccagtcctactggacgagggcctcacccttttgagctcctacaggccctgtctgcaaataaagtcacattggagtttaagggttctgatgatgagtgagggagggcacggctcagtctataacgatgtcctatatctattgcaaagaaaaaatgaaggcactattcaattcctccaaattaggaggtttgccagagcctcagacaaaaggattttttagggaggtacagttcattccataatgatgttctctatcgcaaagaagaaggggtaattcagttcctccaaaccaggcgatttgccagaactccaaacaaaaggaatttttttttcttcttgatccctatttatcaacacatgcctctgtgtctttccagttgacttcatctcttgggcagcattaatttcagaaatctgtatttctgacttgccctcaggaaacccctttagatgttagaaattcttctgtggatgaagttatctttttttttttttgagacatagtcttgctctgtcgcccaggctggagtgcagtggtgtgatctcggcttactgcaacctccacctcccaggttcaaacgattgtcctgcctcagcctcccgagtatctgggattacaggcgtgcaccaccacacctggctaatttttgtatttttagtagagaccggatttcaccatgttggccaggctggtctcgaactcctgacctcaggtgatccacccatctcagcctcccaaagtgctggggttataggcatgagccaccacacccggccagatgaggttatcttcttgagtctcagggtttactgtctgtcactgagttgcaaataaaagaaaagttggatgagttattggcagcctcaagagcaacagtgagaattgtagactcactttctgcattggagggtgtggtgtgtgggctacgggaagcgtggacatcattcaccatgctaggtgccgagaggggcatcagacacagcaggtgcgtgaatctcctgtcttcatatgatactgtctcactgtcagaatcacagtgacagaaggcatttgttactgtggattcacactccgttagggttaagatttttattctgtgtgagttccttagggttactgtgaaaagcacatcttatcttctctcgataatttttaagtgacatttaaaaatattcaagcatgtgacttgaccgaattgcttagcatttgagttgttgcattaaatggagcatctcgtcactttcaagtatttgatactggcagttgctaagagttaaaaggcagctggatttgtcgcagacaatgagttaaggaatccttccacatttttcccatttttttttttttttttttttttttttttgagacagagtttcactcttgttgcccaggctggagtgcaatggcacgagctcggctcaccgcaacctctgcctcccaggttcaagtgattctcctgccttagcctccctggtagctgggattacaggcatgtgccaccacacccggctaattttgtatttttagtagagacggggtttctccatgttggccaggctggtcttgaactcccgacctcaggtgatccgcccgcctcggcctcccaaagtgctgggaatacaggcgtgagctgccgcgcccggcccgtttttcccaactttaaaagtaagggttctcaggaccctgtgtagagcagtgaaaataagacctcgtgtgtgtgtgtgtgtgtgtgtgtgtgtgtgtgtgtacacacgcgcctgcaggagaactgctgttccacttaggtgagaggatgggctgtgtgcttcagaccaggaaatgtgtcatcttgccaagcaacctggctgagtgtgctggagtcaggatcttgaacagaaacttccttttctggtgttgttcactacagagctaaaatggccaaatatatactgtgaaaattgttttttttttttttaacaaaagaccagatccctccttcagctgtatacatttttgaataaaatcatattgaactaacaaaaaaaaaaaaaacaccaaaactggggaacttgcacaatagaaatatatcctctcccaggtctggaggacaagactttaaatccaaggtgtctcagggctgagctccatccagacgctctaggggaggatccttttggcctcccccagctcctgggggctccaggcatcccacggcttgtggctgtatcactccagtctctgcctctgtcttcacatcatcattttctctcatctgtctcaagcatgcctgttcctcctccttataaaaaccccaggctaggcgtggtagctcatgcctgtcatcccagcactttgggaggccgaggcgggcagatcacctgaggtcaggagtttgagaccagcccggccaacatggtgaaaccccatctttactaaaaatacaaaaataagccgggcgtggtggcgggtgcctgtaatcccagctacttgggagactgaggaagggaggatcacttgaactcgggaagtggaggttgcagtcagccaagatctgtccgctgtattccagcctgggtgacagagcaagactttgtcaaaaaaaaaaaactcaaaaagacaaaacaaaaaaaactccgcactcctgtcatcctagcattttgggcagcagtatgataacaaggccaggagtttgagacctaccttggcaacatagagagacccctgtctctataaaagctaacaaacaaaaaacaaaaatctttgtcattatatttaggctaatacaggataatttcctcatttgaaaacctttaatgtctaaacaccctattttcatacaaggtaatcttttcacaggttctagagattaggaccaggagatttttagggacggagtggaggataccgtcatttagcctaccacattcttactaccttaggaaaggatggccaggcaaggtggctcacgacggtaatcccagcactttgagaggccaaggcgggcggatcgcttgagcccaggagttcgagtccagcttgggcaatattgcaaaatccgatctctacaacaactacaaaaagtagccaggcgtggtgctgcgcacctgtggtcccagctactcaggaggctaaggagggagaatcgcttgaattcgggaggtggaggctgcagtgagcccagatcacacctttgcactccagcctgggtgacagaacgagaccctgtctcaataaatgcataaataattttaaaaaggaaagtaattcagcacaaacatttgcatattcccaagatgatgctcacagcttgcagtgcctgcctgggtcctattcctatctgcctgggtctatctgcctgggtcctattcctatctgcctgggtcctattcctgtctgcctggggtctatctgcctgggtcctattcctatctgcctgggtcctattcctatctgcctggggtctatctgcctgggtcctattcctatctgcctgggtcctattcctgtctgcctggggtctatctgcctgggtcctattcctatctgcctgggtcctattcctatctgcctgggtcctattcctatctgcctggggtctatctgcctgggtcctattcctatctgcctgggtcctattcctgtctgcctggggtctatctgcctgggtcctattcctatctgcctgggtcctattcctatctgcctggggtctatctgcctgggtcctattcctatctgcctgggtcctattcctatctgcctggggtctatctgcctgggtcctattcctatctgcctgggtcctattcctatctgcctggggtctatctgcctgggtcctattcctgtctgcctgggtctatctgcctgggtcctattcctatctgcctgggtcctattcctgtctgcctcgggtctatgcatttcctttttgtctgaggacacatttttgcttcatgctgatatttttcacttcacctttctccccttttcttcttttctctttttccctctccttccctcccctccctctggggcagaagctggcatgcggcagagcgccagcagaggacgtggcccaagctcccatacatcttccctttacctcttccgctgacttttttctgggtgtgcccagagagcctagctctggacactcaaagatgcatcatttcaatgtatgttccaaagttacgtagcatccaaggcatatgagacatgcttaaaaacatactggtcatgcaagtgaggaggtgcaatgatgggtactgtcgttgcgattgcggaagccagatctagagatgcccggcgtggcttggggttcaggaaaacttcctgaaggaggtgacacatttgcgtttacgatccccaagtgaggcacacaagcatctctcggcgagaaccccacagtccatcccagaaaaggaaagtcaagagaatgggctacgtatgggaggaagggaactatttatggtcttcgatgagaaaataaatgtgcgtatgcgccccagctttgtgcttcggtattgccacatgccggaaccgcgtgaaaatacaagccgtcaatacaagcaagtgctagccctcttttattattctactgcagaagaaggaagtccttgcttctgagtcattttgtgtattagttacacatgccgtgtaacaaaataacacagactcagcagcgtgtcctaacagcctggtaatattttatccagaatgacgtgttttagaaagttatgtcctgtcaaagtaatccagataccatttccttttcttcttgtttttttggtattattatactttaagttctggatacatgtacagaacgtgcaagtttgttacataggtatacacgtgccatggtggtttgctgcacccatcgacccgtcatctacattaggtatttgtcctaaagctatcccttccctaaccctccaccccccagcaagccctggtgtgtgatgttcccctccctgtgtccatgtgttctcattgttcaacttccactgatgagtgagaacatgcagtgtttggttttctgttcctgtgatagtttgctgagaatgatggtttccagcttcatccatgtccctgcaaaggacatgaactcatcctttttttatggctgcatagtattccatggtgtctatgtgccacattttctttatccagtctatcattgatgggcatttgggttggtttcaagtttttgctattgttaatagttccgcaataaacgtatgtgtgcatgtgtctttatagtagaatgatttataaacctttggtatatacccagtaacgggattgatgggtcaaatggtatttctggttctagatccttgaggaatcgccacactgtcttccacaatggttgaactaatttacactcctaccaacggtgtaaaaatgttcctatttctccaaatcctctccatttccttttcttctccttatacagtaaggaatatgaaactaacacacactttctctcatttcattctctttctttttctgtctgctctctttgtctttctccctctctctctccctctctttttcctctctctctctccctctctttttcctctctctctctctctttctctgtctctctctttgtcttcttttctctatttctctctgtctctcagtgtttgtcacgctctctctctttgcctctttctgtctctttttttttttttgagacagagtcttgctctgtcacccaggctggagtgcagtggcgcgacctcggcttactgcaacctccacctcccaggttcatgcgattctcctgccttagcctcccaagtagctgggattacaggcgtgcaccaccacagtcgcctaatttttgtatttttagtagagatggagtttgaccacaatggccaggctggtctcgaactcctgacctctgcccaccttccaaagtgctgagattacaggtgtgcaccaccacagctggctaatttttgtatttttagtagagacgaggtttcaacatgttagccaagctggtctcaaagtcctgacctcacgtgatctgcctgccttcgcctcctaaagtgctgggattacaggcatgagccatcgtgcccggcctctttctttgtatctctctgtctgcctttctctctttgtcccttttactgtctcccgtccctctctctctttctgtttctctctctcactgtgtctctttgtctttatctctgtgtgttttttctctcttccccttttcctccccctccttttttctctttctctcttagcctttctttctttctctctttctctctctctctgcttctatctttctatctctctctttctcattcttacactccatctctgtctcttctctctctctgatggtgagtggagagtcatttcgttttggaatgatgatgagcattccagtaatagttttggagagtaaggctcatagagcttattaagcaaggtgtgtctgtcataaaattgattgctggcattttacacatcagtgcagacatggggggcacaggcagacccctccccccaccacacacacacactgcttatcctctgaaagctatgtggccttcataaaaatattaacagttcttttacagtaatgattttcccctatgaggctccccagtgaggaggctgtaaatgacactgaccaccagcagccctgcagatcaaggctgttctcttctcggccagcccagaaccagcctctgctcgctccctccctgaggactcctgtctctgacctctgcacacatgctgtgatttgctcttccacctcacaccattccccatcctcacctttcagaactcactggcagtgtcccccaataccttccacctctctccagaaattaccttcccatctcaatgtaagggaacttgcttcttccctcagagatctgctgtctctgctgcaagtaatagctagttttcatgcattttgttctgtctgactttaggttgttgcattgttctcccaacctccttgaacccatggacctggaggcagaattatatacctgtgaatttgcttttctttctagttcctctccctccaaaacctcagtccttctgggaaaaaaaaaaaaaaaacagctttaacacaatcaaacacatcacttttagcgatggagacccactgggaatttagagagaaagagtgaagttgatatactgaatacaatagacataagtctacctctctacctatgtgatgttataaagctgtccctgagtcattcactctctaaaaatgtcatctttggctggacacagctgctcacgcctgtaatccaacactttgggaggctgatgtgggaggctcacttgagcttaggagttcgagaccagccatggggacatagtgagaccctgtctccaaaaacataaatgtaataaaaaataaaatgctttcttttattattcttctgcagaagaaggaagtccttgcttctgagtcattttgtgtattagttacatatactgtgtaacaaaataacagactgagcagcgtggaagagctcatacttactatctgtagcaagggatccataaatggcgtccttttttattattatataaaattctatattctcctgtggaagaaggaagtccttgcttctgagccattttgtgtattagttacatatgccctgtaacaaaataacacagattcagcaacgtggaagggctcgtacttcttactatctgtagcaggggatgcataaattgcttcctgtttgattattatataaaattctatattctatattcctctactgcagaagaaggaagtccttgcttctgagtcattttgtgtatcagttacatatgctgtgtaacaaaataacccacagactcagcagcgtggaagggctcatacttactatcccacagctgctgcgggtcaggaatctgggcaggtgtaactgcattctctcttcggggtctcactgggctataaccaaagtgtcatctggcctgaggtcctctctggagctcaggatcttcgaaattcacatggttatacgcagaatccaattcctggaagctgcagatctggggatctgagtatcttgctggcttttggccaggggctgctgtcagctcctagagaggccatgcccaggttctggccccaaggcgctctcacaaaacatcagctcacatcaaggtcaggaggagaatgacaggtcccacacagactcaaggaaaggggactatacaaggatgggactcattgatctccctagagtatgagctcctcattgtaccctactgacatgtccaattcagtgttacttcctggacaggcgtggtggctcacgcctgtaatcccagcactttgggaggctgaggcgggcggatcacctgaggtcaagagtttgagaccagcctggccaacatggtgaaacattgtctctactaaaaaaaaaaaaaaaaaaaaaaatacaaaaatacaaaaattagctgggcctggtggcatgtgcctgtaatcccagctacctgggaggctgaggcaggagaatcactggaacccaggaagcagaggctgcagtgagctgagatcctgccacagcactccagcccggtcaacagagcgagactccatctcaaaaagagcagaaaaaaaaaaagtgttacttcctagatgaaattgagtttgacctgtttagaaattttcttaatctctgaaataggttgggagataaccaggtattttttgttgttgtccttttccagtggaatttttatactgtgacttggcttccatgacttccatccggcagtttgtgcagaagttcaagatgaagaagattcctctccatgtcctgatcaacaat

SEQ ID NO: 2894 - DNA, 257911 bp, human
gagtcccgcgggcggcgcggaagcggcggcggcgcggccggggcagccatgtcgccattgtctgcggcgcgggcggccctgcgggtctacgcggtaggcgccgcggtgatcctggcgcagctgctgcggcgctgccgcgggggcttcctggagccaggtcagcggggcggggcaggggtcagggctccggggacccgggtgggcgcgggctggctcgggggcgggggcgcgggggctccgcgtgaccttggcgaggcggtggcgctcccggaagtggggctgggcgggggtcgaggtgtggccgggggtggggggggggcggcgtgcgcgctgggacctccccgccccgcgctttccgtccccgccggctcttctgcgcgcctggcccggcccgacccggcccgacccttccctccccgcgcgtgtggcctccccgcctgtcccgggtcgggctccaaccaagcagcccccgtgcagccgcccccccgcgcaccctgacacctccgggccatggccggggacccgggggctcgcacgccccgcgcccaagacatcaggcggctctgcctgccgcctgcggtcggccagtgaccgcgcgcccccgccaggccccggaggggaggagcgggcgtcccagggacctcgacccctacccaccccagggtaagtgaggatgggcccttctccggaggacgtctccagagggggcccagaggcggcttctcgggcactggggagccacggaggtctggtggggagggcaggcccgttaagtggcaactttgtttccttggcctttgtaaacatctctgagtcacagatctccaactttgcaggactcgttcactgtctgaactcatcagtgatgaccgccactgtgttttgtgtatgcagataacttctgttcctagatttgcaggttcagaatttattattattattattttttgtaataggaagtagagatgaagtcttgctctgttgccgaggctactctcgaactcctgggctcaagcagtcctcctgcctcagcctcccaaagtgctggcattacaggcaccagctactgcatccgactaatgttttaaagttttgtagacggggtcttgctatgttgctcaggctggtctcgaactcctgggctcaagcgatcttccttcctttgcctcccaaactgttgggattacaggtgtgagccaccacacctgtctaatgttttaatttttttgtgtagcaatagggtcttgctacgttgcccaggctggtctgaaactcatgggccgaagcaatcctcctacctgggtcccccaaagtgctgggtttacaggcgtgagccaccacgcctggctaatgttttaaattttttgtagagatggcatctcaccatgttgcccaggctggtcttgaacccctggcctgcagcaatcctccagtctgggcctcccaaactgctgggattacagacagagcgccactgtgcccagcccatattctcaatttaaacctagaaacctgtaaacaattatttgtgaactggaataaagggaatgttaattccatgttaggttaaatgatactttgtttcaaaaataacagttttccaaaacagagcgttcagagggtcagtgtggtgggggtgggggtgtacgttgccctgaatgtcttaaatgtccagcctaagaagagagctgttatttctgcctctgtagacagtttcatggcatgtcaggaggcctctggaagacactactgcacgcctctgggagactgggagtcagccaggcgaagcgcttgggtgccttattgtgaaatgacttttgacttccactctgcacccactgaaggaatcccaggggtcccagcgccaccctttgagaagcgtgcctggagtggatgttttaaaatgagcctctctctcccgcctctagccagagaaaaagagctttgagttttctgtgagctaagcttttctttttctgccaaactggccttcagtatttttttttaaacccacttagcataattacaaatgcatagaagaaggagagtaaagggaactgtagtcaggctttcggagggcaggagagcatgtttgtttgaagtaagtaatcagttgcaaggtgaacggtttacagctgctgaacaattgtgtggagtctcgcagaagattatgtttatccgggcagttttgcttacagaaaggtccccttaaacctccttaagggcctgtgtgggccctggcagaagaggccggggttcctgcagcagctcaccaaaatgctggcctttgaaaaacttgctctttgtgcattagaaaaagggctggaatcttttttttttttttttttcccatttactgattaaacaacaacagaaggttgttaaagaggacgagcttctggtgaagtcacgtgtctgccaagggaatctgtacccgggtgtgtatcgaaacagaatggccttctctaaagattaacttaagtggcttgccctcatcgagccccttcctatgtatggattaaaaataattttcgataccagtggaggaatgctgttgtccttggtctgctggtggccagcttcctaaacggcattttttatttgcttctctctggtaggccttcgctgttggtgaggaaacattgaactttgtccagggcatttgagctaagctgtttgaataaccaagagggccaatttccccactgcagattggaagcaagggcagttttttcttagaacttccaaatggagcgtgttcttcttaggtatcgtacaaaggaaatgcctgggttacaccttccacatgagttgacttacatggtatgagaaggaagaaattgtggctggaatccactcctaaatggtgtcttcttacagttcatcatggaaaaacaagataattacaaattaatcatagatgttggtcatgcctttacagagggggtttagaagcaaattgagaattcccataagagggtctgtctctgtgttcttaagactatatccatgcggcccattcagtaagttgtatctgttggttggattttaaaatagatgatttaatcagtgcatttaatatcctaatatggcatcaaaacttgaacattgatatggcctgaaatctgttgaaaatgatcatattgagtaaagaaagtctctacccaccggtattaataacagggtgatctgtttagaaattacattttctctgatacatcaatgagttttgcaaaggagagaaaattgatggtacctgtagtcaagtccagttccaatactgccacagaatttttcttaaaagttctattgtaaataataggccacagaatattccttcactttctgggatgcaaaatggattcgtaaatgctgtaccacaggagtgagtatttacaaaaaatatgccaactggcccacttacaaagctatttatagaagtcctacttttcaaactattttttttttaacctgtaaagggaaagttaattcttgttggttttatgagtagtgaacagtggctattagaaatcaggtagaagtaaaaacagcagttttccaacttcttcttctttttcttgagaccaagtttcgcttttgtttcccaggctggagtgcaatggcgtgatctcagctcaccacaacctctgcctcccgggttcaagcgattctcctgcctcagcctcccgagtagctgggattacaggcatgtgccaccatgcctggctcattttgtatttttagtgagatggggtttctccatgttggtcaggctggtctcaaactcctgacctcaggtgatagtccaccttggcatcccaaattgctgggattacaggggtgagcccctgcccccggcctccaattccttgatcatagaatctctttcaaaaaaaatgaggaccccagacagtttttgtttttgtggattataacagtcaataagtcatcctgttagacattaaaacagaaatttaaaacatatttaacaatctatttaaaagtaatggtaacaggccaattacatgttacatacaaaaatgtatgtaatatatttattgtttttatattttatttttattaaatatatatatttttagaataatttatacttttctataaatataaaatacaaataagttatatttatataatttagatgtaaataaaaacaattgatatttttatataaatatataaatgtgtacacttatggggcacagtgtgatgctttgctgtatgtttgcattgtggaataattaaactaatatctatcacccgctatttttcctttgcggtgggaacatttaaaatctcttttagctatttttgttttttatttccataggttattggggaacaggtggtgtttgattccatgagtaagttttttagtggtgatttgtgagattctggtgcacccatcacccaagcagtatacactgcacgcaagacatttaaaatctctattggcgggccgggtgcggtggctcatgcctataatcccagcactttgggaggctgaggcgggtggattgcctgagctcaggagtttgagaccagtctgggcaatacagtggaaccccatctctactaaaatacaaaaaattagctgggtgtggcagtgtgcgcctgtagtcccagctacttgggaggctgaggcaggagaatggtgtgaacctgggaggtggaggttgcagtcagccaagattgcgccactgcactcaagcctgggcaacagggcgagactccgtctcaaaaaaaccaaaaaaacaaaaaaacaaaaacaaaaataaaaacctcttttagctattttgaaatatgtaatacactattaactatcgccaccacgctgtgcagtaggtcactgaaacggattcctcctgtcgaacagaaacttggtaccctttggccatgtgctgtatgttttttaaaagaaaaatgattgtcatttccaaaataacaaaaacctagggagaagagtggctgagttttagggttttgtcagtctcatccataaagggacggatggcggctggctccttcctctgcttcttcacactggtctcttgcgacgtgtcgttctggtaagagtcatgtgaggcacatccactggcctctcatggatgtgcaattggaaacgtgaaatcgccggccccctgagagcgttttggggagtgtcccccccaaacccccctccccccgcactggggatgctgcaccagtcttgaagaatgaggcagtgagaggctggtttacagcaacctttattcgtggccttgtgtgctcggaagcgctgcaagggaggaggaaggaggaaggagggtactcactgcagaaggtcagctctgctgtggctgttacgtgggttcaggtggaacccacctactgtgtggacggttctttacctgggaatcccatggaattctgacagcaggagacgtgggagggagcttcttgtttctccttccaggagtcacttggttaggggtttgggaattttggctcttagtacaaaacttcactccaggtactagacctgtttcagccaaatgatgatcatcataatagaatagaaacctttgttcacctaaataataacaataatattaataataatagaatataaacctttgttcatggtactggggcgtctttcagcccaataataataacaacaataggaataatgataataatgataaaatataaacctttgcttcacgtcctggaacgtctttcagccaaataataataataatattaatgataatagaatataaacctttgttcagggtactgtgacttctttcagcccagtaataataataataatagtaataatgataataatgatagaatataaacctttgcttcatctcctggaacgtctttcagccaaataataacaataataataataatgacaatagaatataaacctttgttcagggtactgtgacctctttcagcccagtaataataataacagtagtaataatgataataatgatagaatataaacctttgctccaggtcctgggagctctttcagccaaataagaataataatagaatataaacctttgttcacagtaccaggacctctttcagaccaacaataatgacagtaataataattataatgataatagaatataaacttttcttctaggtactgggacctctttcaaccaaataataatagtggaatataaaacttggctctaggtaccagaaccttttttcagccaaatagtaataataagaatagtattaatagaaaacagacctttggtccaggtactgggacacctgtgagccaaataataataataatgataataatagaacataaacctttgactgaagtgccagaacctttttcagctaaataataataataaaatataaacttttgttccaggtacccggacttctttcagcctaataataatcatagaatataaacctttactacaggtcctggcacctttctcagccaaatagtaataaaatagaatataaacttttgttctgttactgggacctctttcagcctaataacaaaagtaataataatagaataaaaacctttgctccaggttctagaacctctttcagcctaataataataataatgatagaatgaaaatttttgttccaggtgtcgagacctcttccagcctaataataataataatgtaataatataagcctttgctacaggtaccaggacctgtttcagccaaataataataacagcaatgataatagaatataaaccttggccccaggcactgggacttctttcagtcaaacaatcacaataataataataataatagaatatggatgtttgctccagctttcaggacctctttcagacagataataataaccgagtacaaacttttcttccaggtatcgggacctcttccagcctaaaaacaatagtaataatagcatatatatctttttttttgttttcttctttctttgagacggagttttgcgcttgttgcccaggctacagtgcaatggcgccatctcggctcactgcaacctctgcttcccgggttcaaacgattctcgtgcctcagcctcccgagtagctgggactacaggcatgtgccactaccacgcccggctaattttgtatttttagtagaggaggggtttcaccatgttgtccagggtggtctcaaactcctgacctcagatgatccacccaccttggcctcccaaagtgctgagagtacaggcgtgagccgctgtgcctggtgccagcataaaaatctttgctacaggtactgagacctttttcagcctaataataataacaaccgtaacaataataattagaatataaacctttgttactggtactgggacctcttccagcctaatcttcataataataaaaataataataataatggaattgaaacctttccttcaggttccagaaccgctttcagccacataataataataataatgataataataataataaatagaatttaaacttttgtttgaggactgggacctctttcagcccaatagcacaaataataataatggaatgtaaaccttttcctcccaattaccaaaacctgtttcagccaaataataatatgatgatgatgatgatggaggatctgatacagctgtgtcctgtcactcaggtcggacttaggaggcctcttgagattcttttccccctccgttgactgtgtaatccaggggccccaccctaactcggctgcagaagatgcagtttgggggttcctcgttttgtggaagtcccggtcatgttattcattctctcagcaccttagaacaaaccagggtgctggcattggccacaggacccccctccttgcaccccagtcttgggaagtggcactgctgggctctggcaatgcccagctcacctggcacgtggcggcgtctccctaaaaagcactgggcgggcaccgttgacggaaagccagcaacgcaggccgcgactgcccgtgaagacggggggcctttctaagacctccactcattatttcgggcaaaattaaccttcagaataccttgctttaataaagtaccagaaaccggagggcttaaaaccatagcttattctctcccagttctggaggccagaagtctgtaatcaaagtgtctcagggctgcgctccctccggaggcttacgcggagggtgcttcctgcctctcccagctcctgggggctcctggcgtccctgggcttcaggccagccacatcatcactctagtctctgcctctgtctccatgtggccttctctgtgtctgtgtctcctcttctgtcttttataaggacatctgtcactgcatttagggctcactcaaatcccggatgatctcatctccagatccttaactcatgagatctacaaaatttctaataaccaagtaagatctcattccacatcctgggctttaggctgtggacagatctttctgcgggccactgttcaatccaccatgattttatccagttcattgtggaggctctagaggaggatccttcctgcctctcccagctcctgggggctccaggcgttctgggtttgtggccgcatcactccagtctcggcctctgtctccatgtggtcttctcctgtgtgtccgtgtctcctcatctgtcttctattaaggacactggtcactgcatttaggaccacctcaattgagaataatctcatctaaagatccttaccttcattattaatacatctgcaaagaccctttttccaaacaaggtcccatacacaagtaccaggtggatacagattttctttggtaggggaggacgcttttcaacccactatagtcatcattgaaatatgcctccttgcactgactgtatcccaacactctgaacgtgcctgggtggtgcattttgatatttaccctcctgagcactgtactggacacttggagacacaattacaccttttaacaaagcccagctgtcattttgggcaacccagtcacagaggtggcctcctgagtggcagctggaagggcctgtatgtgtgagcattcaacctcaacaggaaccctggggactggcttctgggtcatctaagcctccacaccgactgcctgatgtttgcacaggtgtgtgatatttgcccagttgggcctttctgcccacaggtgtgactggacacaatgggcattttgagaagttccagggattgagaaatccatgcttcttcagacgtgcttacagatcacggatgcacctgtgacgttccacatggcttcattttaaaccataaagtttgagaagagtgtgcagtgcctcttagccataggaaagctggctttagtcagatggaggtcctgtttggcttctttaatgcagtgaatgaagctcaggtggcattcagagagtcctgctgtgatggttggcagtggggggtctgcctggccacttgtggattcttctatgtaggcttcatccccagaaaagatctacgcagctttcccacgtggcaggtgcttgggaaactcttaggacaggaacaacaagcccctgcgatgacagaggcattgtcaggctgggcgcggtgactcacgcctgtcatcccagcactttgggaggccaaggcgggtggatcacctgaagtcaggagttcgagaccagcctgaccaacatggtgaaaccctgtctctactaaaaatacaaaaattagccaggcgtgatggcaggtgcctgtgatcccagctactgaggaagctgaggcaggaagatcgcttgaacccgggaggcggaggttgcagtgagctgagatcacgccattgcactgcagcctgggtgacagagcgaaactctgtctcaaaaaaaaaaaaaaaaaaaaactaaaggcacttgtcaggtacagccctgcaaaaatgccgtgctcactcgcaaacctgtatgttgacacgtgcggcatcgctgcagtcggattaacgtggaagaaagagcgtattcctgcgctaggttccctcctccactctgcaaaagtgacccgcaaggaaggtccagccgtccggccccagtgccctttggttgaaagcggagctgccccggcaccctgtctgtctccccggcagggctcccgtgcgtgcctgggtcccttctcatgctgtgtttgtcttggcccttctcagcaggtccccacgcatgagcagccgtccagcaggcaggctccggtggagaagcaatggagaataaaagcctggagagctcccagacagacctgaagctggtggcccacccccgcgccaagagcaaggtgtggaagtatttcggcttcgacaccaacgccgagggatgcatcctgcagtggaagaaaatctactgccgcatctgcatggcccagatcgcctactccggaaacacctccaacctgtcctaccacctggagaagaaccaccccgaggaattctgcgagttcgtcaagagcaacacggagcagatgcgtgaagccttcgccaccgccttctccaagctgaagcccgagtcgtcccagcagcccgggcaggacgcgctggccgtcaaggccggccacggctacgacagcaagaagcagcaggagctgacggccgccgtgctgggcctcatctgcgaggggctgtacccagcctccatcgtggacgagcccaccttcaaggtgctgctgaagacggccgacccccggtatgagctgcccagccggaagtacatctctaccaaggccatccctgagaagtacggggccgtccgggaggtgatcctgaaggagctggccgaggccacctggtgtggcatctccaccgacatgtggaggagtgagaatcagaaccgcgcctacgtcacgctggccgcccacttcctgggcctgggcgcccccaactgcctgtccatgggctcccgctgcctgaagaccttcgaggtgcccgaagagaacacggcggagaccatcacgcgagtgctctatgaggtcttcatcgagtggggcatcagcgccaaggtcttcggggccaccaccaactatggcaaggacatcgtgaaggcgtgctccctgctggacgtcgcagtgcacatgccctgcctgggccacaccttcaatgccggcatccagcaggccttccagctcccgaagctgggggcgctgctgtcgcgctgccgcaaactggtggagtacttccagcagtctgccgtggccatgtacatgctctatgagaagcagaagcagcagaacgtggcccactgcatgctggtgagcaaccgcgtctcctggtgggggagcacgctggccatgctgcagcgcctcaaggagcagcagttcgtcatcgccggggtcttggtggaggacagcaacaaccaccacctcatgctggaggccagcgagtgggccaccatcgaggggctggtggagctcctgcagcccttcaagcaggtggccgagatgctgtcggcctccaggtaccccaccatcagcatggtgaagccgctgctgcacatgctcctgaacaccacgctcaacatcaaggagaccgactccaaggagctcagcatggccaaggaggtcatcgccaaggagctttccaagacctaccaggagacgcccgagatcgacatgtttctcaacgtggccaccttcctggacccccgctacaagaggctgcccttcctctccgccttcgagcggcagcaggtggagaatcgcgtggtggaagaggccaagggcctgctggacaaggtcaaagacggcggctaccggccggctgaggacaagatcttcccggtgcccgaggagcctcccgtcaagaagctcatgcggacatccacgccgccgcccgccagcgtcatcaacaacatgctggccgagatcttctgccagacaggcggcgtggaggaccaggaagagtggcatgcccaggtggtggaggagctgagcaacttcaagtcccagaaggtgcttggcctcaacgaagaccccctcaagtggtggtcagaccgcctggccctcttccccctgctgcccaaggtgctgcagaagtactggtgcgtgacggccacgcgcgtcgcccctgagcgtctcttcggatccgccgccaacgtggtcagcgccaagaggaaccggctggctcccgcgcacgtggacgagcaggtgtttctgtatgagaacgcccggagtggggcagaggcggaacccgaggaccaggacgagggggagtggggcctggaccaggagcaggtgttctccttgggggatggcgtcagcggcggtttctttggcattagggacagcagcttcctgtagcgaggaagcgtgttgtcttacaagtcatccccgcagcagcccattggatgctttgctgtaaatacttacccggtcagcttggttttgaacctcagagaccatccactgtctttgacacctagaaggtggaaaaaggaaagagatttgagaagtgagagagggtcgggggcggtggctcctgtctataatcgcagcactttgggaggccgaggtgggcagatcagctgaggtcaggagatcgagaccagcctggccaacatggcgaaaccccgtctctactaaaaatacaaaaattagccaggactgatggcatgtgcctgtaatcccagcttctggaggctgaggccagagaatcgcttgaacctgggaggtggaggttgcagtaagctgagatcgctgcactccagcctgggcgacaagagcgagactctctcaaaaagaaaaaagaagacacaagagaggtggctttgagtgggtttcctttcctcccctattcccggggcccggacgacttctgcttgggaactgccaacgcttctgcttgggaattgcgtgcagcagagcctagaggagctgttccttccttcacagatacttaagacctccaccatgtctgattcgagttctccctgggagggtttagaagaaacgcaggaacattctgggtggcgtcgaaggagcctttcccgatcatcatgtgtgacttctgcgaggtccagatcactgaattcatgtttacattctcgtgcaagcagggacctcttgcttctgagaaatggggaagagaccttttagccaaaatgcccttcttaaaaagagagacctttttttttaatgttcggttaaaaatgtgacagatgagtacaaaaatgcagacacttaacaaaaagcaaacagaaaaaaaagtgtggaatgtgttgtattttcgacaggttgctgccagagagcctgcttcctgctgcctgccgaaatttcactttgcggagttggtccttaaaactgggcggtggccgggcgtggtggctcacgctgaggtcaggagttcgagaccagcctggccaaccaacatggtgaaacctcgtgtctactaaaaatacaagaaactagccagatgcggtggcacccgcctgtaatcccagctactcgggaggctgaggcggaagattcgcttgagcccaggaggtggaggttgcagtgagccaagactacgccactgcactccagcctggaggccagagtgagactccgtctcaaaacaaaacaaaagtgggtggctcacgggtccggaggttatgtcttcggtgtctcagccctaaaagtccagttcccccgtgcggccagcttttccacataaggtgtttttgatttgattaccggaaaggactcttgattcttctcttttaaactgaataccataggggaaatgaattttaaaatattgcccccggaggggttttccgtggctggattcctgcgagttgctttcagtcattcagggaaacagaaagacgttttccaacatgtagaactgctttttaactggaggaaaaatacttcaggaggcttagcatattgcttggattctacgtgcagcgggttctctgcctccgtgaagacaagctgggctggggagaacggtgtctaggagggatgaccccactcagctccaggcagtgttctgccgagaccccaagaactcggggtgtcagagggcaaaggaactacctgcctttcacggctgctgacttctcagggctgcaagcagcacagaatgttatccttacgtcctgagccggtttaagtctgtggaaaaggaagcacgggagaaatccacgtaacctttgctttctttttaagggaagcggttccgccgtgaacttggaaccctcagctccgggtgttctcggcagaagggcagctggaagggacacagtggggcaggctttggggttgctccctgttctgccccgaggccggggacgcagggcagcccacgcctccgtgggctccattctgtagcattgccagcgttctcttcacgtctctaacaatccttcgcttttcctcactcacgtggaaatgtgaactgtcccggctctgtcttcatttttatttttaagccatcgttcccctcctgaacggttgccccttatttaatgctgtaaagttggactgttgttcaataaaccagagcaatgcattagctcctcattcatttgtctgccgcgtgtccgtctggactgcagtttgtctgaaccccttgatcctgggagtggagggaggtttatcattattattatttttatttttgttgtggtccttgttgaaagcaactttttccagggcacccacggtcagttctgtgctcctctttcttgtctgtaaatcctcaagttatgatgtactttcgggtgttttggcatcaaaatttctgagtgaataaagccggcagctggtgaaagtgttccccgggagcagagatttttgccggttccttcacttagtggatagttgtataaacggaggccccatggacgaggcagcctggatggatccggatggcatcagcgccttccctctccccccagcctccttatcacccctctcttcctgtcttcctcacctcctctcacatggtctcttccttccctcctccttccgtccaaccctccctctcttcttcagccaacaaatccttcctttcttccttctttccttccttccttccctcccatccttgtctcttcttctctcccttccttccctcccttcccttctttctttctctcccttccttccttctctcccttccttccttctctcccttccttccttctctcccttctctcccttttctcccttccttccttctctcccttccttccctcccttctctcccttttctcccttccttctctccgttccctccctcccctccctctctgcctccctttcctcccctccctccttcccccatccctccctccctccttccctctcctccctccctccttccttccctctgtccctccctgtctccctcccttcctccttccttcctttcctccctccctctgtccctccctcccttttctccctccctcccttcctctttcgttttccttccatccctttttccttcctccctccctcttttcctccctcctgagaaaacaatggcccccaagaaacacaggaaggccgggatgtgcacctctgcccagacttgccctttccaagtgctgttggttgactgcctgtccttgggcatcattaaaatgccgaaatttctctttcttgcacgttttgggttgaaaggggttcattttcagtcctcataactaagcatttgcatcgtgatgttcatttaagtgggacatgtttacacgtttttcccattaggagtaattctagtccttgagggtttcttacagagacatttccctaaccccgacggttctcatcccagcctgtgtggcactccttccgcacagtggtgggatttttcggttcggttttgttttcacgcttgcatctggctgcacagccctaactctgagctggttgtttttgtttcccccccactttgcagaattgcctgcttcgaactgttttcccagcaggcctctgaagggtgaggaaaacagcttggggaaagtgagaaaaaggtttcggatgttttagtaaagaggcagctggtgggaaggagccggttgggctgtttctggggtgccgaaatctcggtggtgacgttcatttgctcgtgagtgcagaggaggcccagagaccgggttcctggcgcagccagctcctgcttttgttccgaccatcttcctgcgccttctgcgagtctcagatgtgcttgggcagcagttctactgttttcccctctgtgatctcaggcccgccgccccgtcctttcccagtgatttctgctccgtcaaatcgtggggctcacctgagagttttataaaatgaactcgccatgcccctgcctggtgaacagagaatgcaaactctcacaggaccgtctgcagcaaaacggcagtgttttgctcatttcttcagacgacgaaaacagcagggtttggctcgtttcttccagattttctcaaactgcatgagttcctttctgagcaacttctgggaagctttcgggtttcagggctttgcagccaggctccttcctagctgcggctgcctgtccttttgtgttgcagtcagatgcgggaggtccttggcatgagtaccctgatggtgtcaactttaaggggtcagagaggaaatatttttggctccgcggaccatgcattctctgtctctcaacaacttagttttgccgttgtgtctaaaagcatccattgctgggtgtggtggctcacatctgtcatcccagcactttgggaggccgaggcgggtggatcgcctgaggtcaggagttcaagaccagcctggccaacatggtgaaaccccatctctactaaaaatacaaacattagctgggcatggtggtgggcacctgtaatcccaggtactgaggctgaggcaggagaatcgcgtgaaccagggaggcggaggttgtagtgagctaagatcgtgccactgcgctccatcctgggcgacaagagcgagactccgtgtattccactcccacttcgtgggcactaaattttatataaatgttgtgtcaagaaatattattgctctgttgacttctttttttcccccaaccattaagaaattcagaaaaaaaatgtacgaatgtaaacactgttcttggtgagtgggccttccaaaaataaccgctggactttgttgaaactacttttttttttttttttttttgccactttttcccttttttttctcgaggcaccaattggaatccacttatttgtcctggtttgagaaacagctcagatcgcacactctgggctctgtgtttctttaggtaacacacgtgaggtttttgtcactggaattcagtaatctgtgttaatattatcacaaaagaaccggggggcatttgtgtcttctcagaattgctgattaaaacagctgcatggccaggtgcagtggctctcatgcctgtgatcccagcactttgggaggccgaggcaggcggatcgcttgagcccaggagtttgagaccagcctgggcaacatggccaaacctcatccctactaaaaatacaaaaaattagccaggcatggaggcgcatgtctgtagtcagtcccagctactcaggaggcgaaggtgggaggatcacttgagcttgggagttggaggctgcagtgagctgtgaacataccactgcactccagcctggaaaataaagcaagagatgctgcctctaaaaataataataataataataaaaattagccaaacatggtggcacgcatgtgtgatcacagctacttgggagactgaggtgggaggatcgctggagcccggaaagtcgaggctgcagtgagctgagattgcatcactgtcgtgcagcctgggcaaaagagtgagaccctgtctctaaataaataaataaatgagttcacgattaagcagaagttgtgcttgttctgccaggatttcagttgggttctttgtgccctaatttacgtgagctagtaggttgtgcgttatcttagagggcttgcatgaaagaaagagggtagcctttcttttccctgttttggtagcattgctgaggtggcttttggctgacgggtggacccgtgggtgcagatgttttgatgcagaaggaatgattgccttttcacattcaggctccaactggcttttagcttgtgcgttcttaccctggggtgttcgaggtcaccggactcctattttatttgtgtttaactggaaaggcaggaactctgagaacgtatcaaataggcagttactgcaggatttctagaatttaaattgcttccaaaactgtatccacaagctaagaattatgtttaggttttaaaaggtgttggtttgcttcttacatgtttaaattcttgagggaaagaaatgcaaagaataataaagtttcatgatacaaaaatggtatgagaccgggcacaatggctcacacctgtcatcccagcactttgggaggctgaggcaggaggatgatttttgagcctgagtttgagatcagcctgggcaaacagcgagatcctgtgcctacaaaaataaaataaaaataggctgggtgtggtggctcatgcttgtaatacctgcactttgggaggctaagtcagtaggatcacttgaactcaggggtttgagaccagcctggtcaacatactgagaccttgtctctagtaacaataaaaaaattagctggacataaggtgtgcatttgtagtcccagttacacaggaggctgaggtgggaggatcacttgagccagggagttggaggctgcagtgaaatgtgatcgcaccactgcactccagcctgtgcaacaaggagagagatgctgtctctaaaaaaaaaaaaaaagccagacgtggtggcacacgtgtgtggtcacagctacttgggaggctgaggctgaaggatcgcttgagcccaaggaggctgaggctgccataaactacgatcatgccactgcactccaggctgggcaatagcctgggcgactgtctcaaccaaaataaatttaaaaagataggaaatttcaatgtgaaaatcagtgtcccccagaacgttccatttcttcccagctgggctatttttggagttccatggggagccggctcagtgcagtttgcatgtactcgggaggatgagccctgccatggtgtgtgttaggggacagcctgatctcaccaaccctcctgagcaggcccagccctccgagtaataactgggaacactcgccgctttgtgagacgacctcgtgtgctcactggaaggtcatctcttctggtccatgctgcagtgtggataccattttttttttttaagacagtttcactcttgttgcccaggctggagtgcaatggcacgatctcggctcacagaaacctccgcctcctgggttcaagccattctcctgtctcagcctcctgagtagctgggattacaggtgtctgccaccacagccagctaatttttatatttttcgtagagacggggtttcagtacattggtaaagctggtctggaactcctgacctcaggtgatccacccgcctcagcctcccaaagtgctgggatgacaggcgtgagccaccgcgaccagcccagtgtggatacaccttgagcacataactggaatcctttccttggaaacttggagccccttgtgtcatggtcatataaactgttgaattaagaggagacaccattaaatatgtcacagctgtcctcgaaactgggacttgttttgctttctgcctggaaatgcgagctatctttatagaattattttatagaaaataattgtatacatatataggaggtacgacgtgatgttttaatccgagtacacattgtgcaatgattaaatcaagctggttaccatattattaacctaattaacatatcaataatcaagctaattaacacattaacattcaagctaattaacatattaacaagctaattaacatattcacataatcctaactctgacctatatcacctcacctacttttttttgtggtgagaatgtgtaaaatctacttttagtcattttgaaaaacgcaatgtattattattaatgataatcactgtgtggtgtggtagaactttgaatttatttcttctatctaactggaaaaatttaattttaatgtaatttattttttttgagacagtctcaccctatcacccaggctggagtgcagcatcatgttcatagctcatggcagcctccaactcctggctcaggtgaccctcccaccacagcctcccaggtagctgggactacaggtgcacaccaccacacctggttaattttttaagttttttgcagagatggggtcttgctatgttgctcaggctggtcttgaattcctgggctgaagcgatcctcctgcctcagcctcccaagtagctgggactgcaggtgcatgctaccatacccagctaatttttttttttttttttaaagatgcggtttcattatgttgcccaggcttgtctcaaactcttggcctccagtgatcctccttcctcagccttccatagcattgtgattccagacatgagccaccgctcctggcctccaactgaaattttatgttctttgacaaacacttcatgaagcattcttccctggcaaccaccattgcactctctgcgtttatgcgttcagcttttttagattctacatacgagatgatacagtatttgtctctctgtgcctggttcatttcacttcacattgtatcttccagtcccatccatgttgctgcaaatggcaggatttcctttttcatggctgcatactattccattgtgtgtctatgccacatttgcttgatacgctcatctgttgattgacacatgggttgattctatatcttggaaactgttagtagtgttggcagtgcacagggggtgcaggtatcccattgatgggctgatttcctttcctttgggcacacaccaagcggtgggatgactggatcctgcacaacattctttcctttggtgtttcgcaggcccgtttctggactttagtgaacgtcttcccagtgtccatggcgtccgtcccttggccacatgcttagggaacatcttcagtgtgtacatggcgacagtcccatagccacattcttagggaatgtcttcagtgtgtacacggtggcagtccctttgctgcatgcttagggaacgtctacagtgtggtccattggccacattcttagagaacgtcttcagtgtgtacactgtggcggtcccttggccacattcttagggaatgtcttcagtgtgtacatggcggcagtcccttagccacatgcttagcgaacatcttcagtgtgcacagggcagtggtcccttgggccacatgcttagggaacgtcttaagtgccgtcccttggccgttttcttagggaatgtcttcagtgtgcacatgtggcggtcccctggtcgcattcttacggaatgtcttcagtgcgtacacggtggtcccgtagccacatgcttagggaatgtcttcagtgtgcacagggccatattcttacggaatgtcgtcagtgtgcacatggtggtggtcccttggccacattcttagggaatgtcttcagtgtgtacgtggcggaggtcccttagccacaagcttagggatcatcttcagtgtgcacagtgcgggagtcccttgggccacatgcttagggaatgtcttcagtgtgtacatggtggtggtcccttagccacatgcttagggatcatcttcagtgtgcacagggtgggagtcccttgggccacatgcttagggaacgtcttcagtgtgtacagggcagcagtcctttggctgcattgttagcgaacatcttcagtatgtacatggctgtggtcccttagccacaagcttagggaacatcttcagtgtgcacacggtggtggtcccttgggctacatgcttagggaatgacttcagtgtgtacatggtggccatcccttggccccatgcctagggaatgtcttcagtgccttgccttggctgcattcttagggaacgtcttcagtgcgtacatggcggtggtcccttagccacatacttagggaacgtcttcagtgtgtacaccgtggtggtcccttggccacattcttagggagcgtcttcacttcttacatggtggtggtccccgggccacattctaagggaacgtcgtcagtgcctacacaatggtggtcccttggccgcacgcttggggaacgtcttcagtcacagccctggttggtcccttggccacattcttagggaatatcttcagtgcatacacggtggcagtcccctggtgtcattcttagggaacgtcttcagtgcggtccctcaaccacatgcttagggaatgtcttcagtgctgtttcttagccatattcttagggaacctcttcaatgtgtacacactggtggtcccttggccgcatgcttagagaacatctttagtgcagtcccttggccacattcttagggaacgtcttcagtgtgatcccttggccacattcttagaaaacgtcttcagtttgtacaaggtgacagtccattggccagaatgtgtccctgccacattcttctgagtgtctgtgtctgtgttctttccaccctgtaagctgcttttgcttcttcactgggtgtctgtgactctcatgtggaatccctttcctctgtcaccgcccatcccaggcacagtgagagacgcagccagcctgctcctctctgcacctcgccatcccagacatcctccagccaccgtgctgaccgcattcattccttctcctgccctgtccgcatccttcttcccctacacgtttgataccaagaaatggtctgaatcacagccaaggcttcatttgctttctggaactgcagctccccagccccacccagatcagagattcagaacctgaatcttcggatttctggagatgcccccatcctatcagagacttctagtgtgtttctttatatccgtgtagacttgggaggatgacaggagagaaaccttagaaggtggtctgtgcatttcccgggcccggggtggaaggggcttgtgtcctggctgcctctgtgcacctttcattcttttttttttttttgagacggagtcttgctctgtcaccctgtcacccaggctggagtgcagtggagggatctcggctcactgtaacccctgcctcccaggttcgagcaattctcctgcctcagtctcctgagtagctgggaatacaggcatgtgccaccacgctcggctaattttatatttttagtagagatgggtgttcttcatgttggtcatgttggtctcgaactcctgacctcaggtgatccatccgcctcggcctcccaaagtgttgagatgacaggtgtgagcccccgcgcctggccgcacctttctttcttgatccacctggttttaaactcacagataaactgtttccacctgtgacaaatgagtcatccaccttccatgtggtctggactttgtccctgttacaatattcctgtctcttgtttctggttttttgcatcccacatgttgtccctgtaacagtcctgtctgttgtttctggggtcacccgtgtggcgagctgactgtgccacgttcctgaggctggtgaggatgctgtgggcaccttaatcacggctgtgaacaaactggctagagctaggtgccatggagctttgcagtggacactaagtcgtggtacccattctttgatcagtgacggagccaggtgtcttattaggtcttggggatttgtggaagcccagagcagggaaacagcttctacattgaaaggaatccttctcacactcatgttggcatcgtgaagtccctgatttcctaagacactaccctaatattttaaaagacttacaaaaaatttagtaaaatattcctaatagcagcacatgtggtgtttttttgtttgtttgtttgttttcgagatggagttttgctactgttgccaaggctggagtgcagtggtatgatctcggctcactgcagcctccgtctcccaggttcaagggattctcctgcctcagcctctcaagtagctgggattacaggcatgcactaccacacccggctaattttgtatttttagtagagacgggtttttccatgttggccaggctggtcttgaactcccgacctcaggtaatccgcctgctttggcctcccaaaatgctgggattacaggtgtgagtctccacacctggtcaatcccattctttttcaagaatgcatagtattctgtggtgtatgtacaccaccttttctttatccagtctacgtggcgttgttttgaggaatggatgaaatgatttgcataaaaacagtgaatgctttctattggaatggtgtttgcctcctgggaaactgtggagtcattgcaattgcaatttcctagtagatttgattaattaagagcattgggaatttttggggtgcctgatgcactattacagatatttttttcacagtgtagatatctcagcatgaatatgtctgttttcttttcttttctttcttttttttttttttgagatggagtttctctcttgttgccaaggctggagtgcaatggctcaatcttggctcactgcagccaacatctcctgggcttaagcagttctcctgcgttagcctctggagtagctgggattacaggcatctgccaccatgcctggctaatttttttttgtgtgtgtgtttttagtagagacagggtttcaccatgttggcctggccggtctcaaactcctggcctcaagtgatccacctgccttggactccgaaagtgctgggatgacaggcctgagccatggcggccagctgtctgttttctttccataagaggtgctggtctcaccgtggctctgtgctgtgatgaaatggcattgtccaagttttactcctcacagcctgattttgtatgttaaagacgtcttccttggtgtgaatcaagtgggctgggcagagttaagggagccatttatttagaaggcgattagatcgaattatgtcttggtaattactgcagttacaccaccccattctttccgtggctctcctagctgggtttgtggctagtcatggaggtgccctgaagagcctcattttcccacagctgtaggaagtgtgtggtacacccacaatgtcttagcttttgtattagggaaggtcttcagtgcattcccttggccacattcttagggaacatcttcagtgtgtacatggcggcggtcccttaaccacattcttagggaacgtgttcagtgtgtacacggtggcagtcccttggctgtatgcttagggaacgtcttcagtgagtgtgatcccttggccacatgcctagggaacatcttcattgtgtacctggcggcggtcccttagccacatgcttagggaatgtcttcagtgtgtacacggtggcagtctgttggccccatggttagggaacatcttcagtgtgcacagggcggcggtcccttgtgccacatgcttagggactgtcttcagtgtgtacatggtggcggtcccttggtcgcattcttagggaacctcttcagtgtgtacatgtcggcattcccttagccgcatgcttagggaacgtcttcattgtgttcttggtggcagtcccttagccacatgcttagggaacgtcttcagttgtatacagtggggtcccttggtcattatgcctaggggaacgtcttcagtgccagctgcattcttagggaatgtcttcagtgtgcacatggcggaggtcccttagccacatacttagggagtgtcttcactgcacacagcagtggtcccttggttgcattcttagggaacatcttcagtgtgcacatggtagcagtccctcacccacattcctagggaatgtcttcagtgtatacatggtggcagttctttggctgcatgcttagggaacatcttcagtgcattcccttggccacatgcctagggaacatctttagtgctgtcccttccctgcatttttagggaacgtcttcagtgtgtacatggtggcggtcccttggccgcattcttagggaacgtcttaagtgtgtacatggcggcggtcccttagccacaagcttagggaacgtcttcagtgtgtatatggtggcagtctcttggccacatgcttagggaacgtcttcagtgccatcttttagctgcattcttagggaacgtcttcagtgtgtacatggcagaggtcccttagccacacacttagggaacatcttcagtgtgtgcacagcagtggtcccttggcctcattgttagggaacgtctttggtgtgtagatggccgccgtcccttagccacaagcttagggatcgtcttcagtatgcacagcgtggcagtcccttgggccacatgcttaaggaatggcttcagtgtgtacaccgttgtggtcccttggccacattcttagggagcgtcttcagtgccgtcttttggctgcattcttagggaatgtcttcagtgcgtacatgggggcggtcccttagccacatacttagggaacgtcttcagtgtgtacatggcagtggtcccttggccccattcttagggaacatcttcagtgtgtacatggtggcagtcccttaatcacatgcttagggattgtcttgattgtgtacatggcgatggtcccttggccacatgctttgggaacctcttcagtgcatacggagtggcagtcccttgtccacattcttagaaaacgtcttcagttcgtacacggtggcgatcccttggccacattcttctgagtgtctgtgtctgtgtcctttccaccctgtaagctgcttttgtttcttcattgggtgtctctgactctcatgtggaatccctttcctctgtcaccgcccatcccaggcacagtgagagacgcagccagcctgctcctctctgcacctcgccatcccagacatcctccagccaccgtgctgaccgcattcattccttctcctgccctgtccgcatccttcttcccctacacgcttgataccaagaaatggtctgaatcacagccaaggcttcattatctttctggcactgcagctccccagccccacccagatcagagattcagaacctgaatctttggatttctggagatgcccccatcctatcagagacttctagtgtgtttctctatattcgtgtagacttgggaggatgacaggagagaaaccttagaaggtggtctgtgcatttccggggcccggggtggaaggggcttgtgtcctggctgcctctgtgcacctttcattcttttttttttttttgagacggagtcttgctctgtcaccctgtcacccaggctggagtgcagtggagggatctcggctcactgtaacccctgcctcccaggttcgagcaattctcctgcctcagtctcctgagtagctgggaatacaggcatgtgccaccacgcccggctaattttatatttttagtagagatgggttttcttcatgttggtcatgctggtctcgaactcctgacttcaggtgatccatccgcctcggcctcccaaaatgttaggatgacaggcgtgagcccccgcgcctggcggcgcctttcattcttgatccacctggtttcaaactcgcagataaactgtttccacctgtgacaaatgagtcatccaccttccgtgtggtctggactttgtccctgttacaatattcctgtctcttgtttctggtttttggcgtcccacgtgttgtccctgtaacagtcctgtctcttgtttctggggtcacccctgtggcgagctgactgtgccacgttcctgaggctggtgaggatgctgtgggcaccttaatcacggctgtgaacaaactggctagagctaggtgccatggagctttgcagtggacagtaagttgtggtacccattctttgatcagtgacggagccaggtgccttattaagtctcggggatttctggaagcacagagcaggcaagcaccttctacactgaaaggaatccttctcacactcatgttggcaacgtgaagtcctgcctttggaaatccctgatttcctaagacactaccctaacattttaaaggacttaaaaaaaattcagtaaaatattcccaatagcagcacatgtagtgttttatttatttatttatttttgagatgatttgcactcttgtcgcccaggctggagtgcaatggtatgatctgggttcactgcaacctccgtctcccgggttccaaggattctcccatctcagcctgtaaggtagctgagattataggcatgcgccaccatgctcggctgattttgtatttttagtagtgacagggtttcaccatattggtcagggtggtctcgaactcctggcctcaagtgatccacccatcttggcctcccaaagtgctgggattatgaatcactgctcctggcctactttttaaactttcaggttcaggggcacgtgtgcaggttcattacacgggtaaattgcatgtcctgggggtttagtgtacagattaattcatcaaccaggtagtaagcctactaccatctgataggtagttttttgatcctctcatttgtcccaccctccaccctccagcaggcccctgcagctgttcccttctttatatccaccagtgcccaatgtttagctgtcacttatcagtgggaacaggtggtatttggttttctgttcctgtgtaagtttgctaaggataatggcctccacctccgtgcatgttcctgcaaaggacatcatcccattttttttttttttttgagacagtttcctttttgttgcccaggctggagtgcaatggtgtgatctcggctcaccgctaccaccagctcccgggttcaagcagttgtcctgcctcagccttctgagtaactgagattacagacacatgccaccacgcccggctaattttgtatttttagtagagacggggtttctccatgttgcccaggctggttttgaactcctgacctcagttaatctgccctccacggcctcccaaagtgctgagattataggtgtgagccaccacacccaaccaatcccattctttttcatgggtatgtagtattccatagtgtatatgcaccaccctttgtttatccagtttacatggcgttgttttgagaaatggatgaagcgatgtgcatgaaaacactgaatgcttcctactggaggggtgttcacctttccgggaaactgtggagtgattgcaattgcaatttcctagtagatttgattggttaatagcattgggaatctttggggtgcctgatgccctattgcagatcttttttcacagtgtagaaatctcaacgtaaatgtctttttttttttttgagatggagttttgctcttgttgcccaggctgcagtgcaatggctcaatctcggctcactgcagccaacatctcccgggtttgagcaattctgcctcagtctcctgagtagctgggattgcaggtgcctgccaccacacccggctaatttttgaatttttagtagagaaggggtttcagcctattgttcaggctgctctcgaactcgtgacctcaggtgatccacccacctcggcctcccaaagcgctgggatgacaggcgtgaccgcgcccagcccagtgtggatacaccttgagcacataactggaatcctttccttggcaacttggagccccttgggtcatggtcatataaagggtgttgaattaagaggaaacactgttaaatatgtcacagctgtccttgaaactgggacttgttttgttttctgcctggaaatgcgagtcatttttctggaaaattcatttttcgttaaaaaaagtaattgtatacacgtatatgaggtacaacgtgatgttttaatccacgtacacatcatgcaatgattaaatcaagctagttaccatattaacaatcacattaactaacatattaataatcaggctaattaacatattaacattgaagctaattaacatattaacaatcaagctaatttacatattcacataattctaactctaacctatatcacctcacctacttttttttgtagtgagaatatgtaaaatctacttttagtcattttgaaagacgtgatgtattattaactatcatcactgtgtggtgtgatagaacttggaattcatttgttttatctaactgaaaaaaattaattttaatgtaatttatatgttttttgagacagtctcatcctatagccaggctggagtacagcatcatgttcatagctctcagcagcctccaactcatggctcaggtgaccctcccacctcagcctcccaggtagctgggactacaggtgcacaccaccacacctggttaatttttaaattttttgtagagatggggtcttgctatgttgctcaggctggtcttgaattcctgggctaaagcgatcctcctgcctcagcctcccaagtagctgggactacaggtgcatgccaccatatccagttaattttttcagttttttttttatttgtttagagatagggtttcattacgttacccaggcttgtctcaaactcctggcctccagtgatcctccttcctcagccttccatagcacagtgattccagacatgagccacagcgctcctggcctccaactgaaatgttatgttctttgacaaacacttcagcattcttccctggcaaccaccattgcactctctgcgtttatgcgttcagcttttttagattctacatacgagatgatacagtatttgtctctctgtgcctggttcatttcacttcacattgtatcttccagtcccatccatgttgcgcaaatggcaggatttcctttttcatggctgcatactattccactgtgtgtctatgccacatttgcttgatgtactcatctgttgattgacacatgggttgattgtatatcttggaacctgagtagtgctgcagggcacaggggatgcaggtatcccattgatgggctgatttcctttcctttgggtacacacccagtggtgggatgtctggatcctgcacaccattctttcctctgatgttttgcaggcctatggctggacctttggaacgtcttcactatgtacaaggtggcggtcccttggccacattcttagggaacgttttcagtgtgtacatggtgtcggtcccttggctatatgcttagggaacatcttcagtgggtacatggtggcggtcccttagtcatattcttagtgaatgtcttccgtgtgtacacggtggcagtcccttggctgcatccttaggcaacgtcatcagtgcagtcccttggccacatgcttagggaacgtcttcagtgcatacacggtggcggtcccttggccacattcttagggaatgtcttcagtgtgtacatggtcgcagtctgttagccacatgcttagggagcgtcttcagtgtgtatagggtggcggtcccttggccacatgcctagggagtgtcttcagtgccgtcgcttggctgcattctttgggaacgtcttcaatgtatacatggcggcggtcccttggctgcatttttagggaacgtcttcagtgtgtacatggcggcggtcccttatccacattcttagggaatgtcttcagcgtgtacacggtggcagtcccttggccgcatgcttaggggacttcttcagtgcggtcccttggccacatgcctagggaacgagtcttcagtgccgtcccttggctgcattcttagggaacgtcttcggtgtgtacatggtggtggtcccttgggcgcattgttagggaacgtcttcagtgtgtacatggcagtggtcccttagccacatgcttcggaatgccttcagtgtgtacatggcggaggcccctcagccacgtgcctagggaatgtcttcagtgctgtcttttagcggcattcttagggaacgtcttcagtgtgtacatggtggtggtccctgagccacatacttagggaacgtcttcagtgtgcaacggcagcggtcacttggccttattgctagggaacttcttcagtgtgtacatggcggtggtcccttagccacaagcttagggaacgtcttcagtgtgtacatggcagcagtcctttggaccacatgcttagggaatgtcttcagtgtgtacacggtggtggtcccttggccccatccctagggaaagtcttcagtgccgtcctttggctgcattctttgggagcgtcttcagtgtgtacatggtggaggtcccttggccacattcttagggaatgtcttcagtgtgtacatggcggcggtcccttggccgcatacttagggaacgtcttcagtgtgtacatggcagtagtcccgtggccgcattcttagggaacctcttcagtgcatacacagtggcggtcccttggccacattcttctgagtgtccgtgtctgtgtacttttcatcctgtaaactgcttttgtttcttcattgggtgtctctgactcttatgtggtatccgtttcctctgtcagcgaccatcccaggcacagtgagagacgcagccagcctgctcctctctgcaagtggccatctcagacattctccagccagcgtcctgaccgcattcattccttcccctgcccggtccacatccttcttcccctacacccttgctaccaagaaatggtctgaatcacatcacaggcttcctttgctttctggaactgcagctccccagcccacccagatcagaggttcagaacctgaatcttcggatttctggagatgcccccatcgcatcagagacttctagtgtgattctttatattcgtgtagacttgggaggatgacaggagagaaaccttagaaggtggcctgtgcagttccagggcccagggtggaaggggcttccatccctggctgcatttgtgcacctttcattcttggtccaacattttttttttttttttttgagacggagttttactgtgtcgcccaggctggagtgcagtggtgtgatctcagctccctgcaacctccccgcctcctgggttcaagcgattctcctgagtggctgggagtacgggcatgcaccaccatgcctggctaattttatatttttagtagagatgaggtttctccatgttggtcaggctggtctcaaacccctgacctcaggtgatccatccaccttggcctcccaaagtgctgggattacaggtgtgagccaccacgtccggctgcactttttattcttgatccacctggtttgcaactcacagataaactgtttccacctatgacacatgagtcttccaccttccatgtcctctggactttgtccctgttataatattcctgtctcttgttctggtttttggcatctcacacattgtccctgtttcagtccggtctcctgtttctggtgtttggtgtgccgcacgttgtccctgttacagtcctgtctcttgtttctggggtcacccgtgtggagagctgactgtgccgcgttcctgaggctggtgaggatgctgtgggcaccttaatcacggctgtgaacaaactgactagagctaactgccacggagctttgcagtggacgctaagctgttgtactcattgtttgatcagtgacggagccagatgtcttattaggtctcggggatttgtggaagcctagagcaggcatgcaccttctacgtagaaaggaatccttctcacactcaagttggcgtcgtgaagtcctgcctttggaaatccctgatttcctaagacactaccctaacattttaaagggcttaaaaaatttcaataaaatgttcccagtagctgttacatgtagtcatgtagcgtttttttttttttttttgagatggacttttgctcttgtctcccaggctggagtgcaatggcgcgatctcggctcactgcaatctctgtctcccgcattcaagggattctcccacctcagcctgtcaggtagctaggattataggtgtgcgctaccatgccctgctacttttgtatttttagtagtgacagggtttcagcatgttgatcagggtagtctggaactccttgcctcaggtgatccacccgccttggcctcccaaagggctgggattatgaatcaccgcccccagcctacttttttcactttgatttcaggttgagggggacgtgcgcaggtaaattgcatgtcttgggggcttagtgaacagattatttcatcatgcaggtaataagtccagtaccacctgataggtagtttttcgatcctctcatttctcccaccctccaccctccagcatgcccctgcagctgttcccttctttgtatccatgagtacccaatgtttagctgccgtttatgagtgagaacaggtgatatttggttttcttttcctacgtgagtttgctaaggataatggcctccacctccatgcatgttcctgcaaagggcatcatcccatgttttctttttttctttttcttttgagactgggtttccttcttgttgcccaggctggagtgcagtggtgtgatctcagctcaccacaacctcctgttcctgggttcaagtgattctcctgcctcaggctactgagtcgttgagattacaggcgcataccaccacgctgggctaattttgtatttttagtagagacggggcttctccatgttggccagtctggtcttgagctaccgacctcaggtaatctgcctgcctcggcctcccaaagtgctgggattacaggcatgcgccgccacgcccaaccaatcccattctttttcatgggtccatagtattccatagtgtatatgctccaccctttctttatccagtctacatggcgtcctgttgaggaatggatgtaacaggcgtcgtgttcaggaatggatgtaacaatgtgcataaaagcagtgaatgttttctattggaatggcgtttgcctttctgggaaactgtggagtcattcgaattgcaatttcctggtagatttgattagctaagagcattgggaatttttggggtgcgtgatgccctgttgcagatattttttcacagtgtagaaatctcagcatgaatatgtctgttttcttttctctttttttttttttttttgcgatggagttttgctcttgttgcccaggctagagtgcaatggctgaatctgggctcactgcagccatcatctcctgggttcaagcaattctcctgcctcagcctctggagtagctgggattgtaagtgcctgcccctacaccctgatttttctttttttttgtatttttagtagagacggggtttcacctgttgggcaggctggtttcgaactcctggcctcaagtgatccacctgcctcagcctcccaaagtgctcggatgacaggtgtcagccacggtgcctggccgtctgttttcttttcataagaggtgctggactcacagtggctctgtgctgtgatgaaatgacattgccaaagttttactcctcacagcttgattttgtatgctaaacaggtcttctttggcgtgattgaggagggatggggagacttaagggagccatgtatttagaaagcgattagatcctgttatgtcttggtaattactgcagttacaacacgccattctttccgtggctcacctagctgggttcgtggctagtcatggaggcgccctgaagagcctcattttcccacagctgtaggaagtgtgtggtacacccacaatgtcttagcttttgtattagggaacgtcttcagtttgttcccttggccacatgctttgggaatgtcttcagtgtgtacacggtggctgtccctgggccgcatgcttagggaacgtcttcagtgaggtcccttggccatatgcctagggaacgtcttcggtgccatcctgtgactgcattcttagggaacgtcttcagtgtgtacatggcgggggtcccttagccccattcttagggaatgtcttaagtatttacacagtggcagtctgttggcctatggttagggaacatcttcattgtgcacatggtatcagtcccttgcgccacatgcttagggaattcttcagtgtgtacatggtggccgttccttggctgcattgttacagaacgtcttcagtgtgtacatgtcagcggtcccttagccgtaagcttagggaacgtcttcagtgtgtataaggtggcggtcccttggccacatgcctagggaacgtcttcagtgccctcccttggctgcattcttagggaacgtcttcagtgtgtacatggctgccttcccttagccacatacttagggaacatcttcagtgtgcacacggcagctgtcccctggacgcattcttagggagcgtcttcagtgcgaacatggcgggggtcccttacccacattcttagggaacatcttcagtgtgcacacggcagcagtcccctggacgcattcttagggagcgtcttcagtgcgaacatggcggcggtcccttacccacattcttagggaacatcttcagtgtgtatatggtagcagtcccttagccacacacttagggaacgtcttcagtgtgtgcacatcagcggcccttggccggattgctagggaacctcttcagtgtgtacatggcagcggtcccttaacccaagcttagggatcgtcttcaatgtgcaaagggcaatggtcccttgggccacgtgcttagggaatgtcttaagtgtgtacacggcggtcccttagccacatgcctaggaaacgtctgccatctcttcgctgcattcttagggagcgtcttcagtgcgtacatggcggccgtcccttagccacgtacttagggaacatcttcagtgtgtacatggcggtggtcccttagccacatacttagggaacgtctccagtgtgtacaggtggccgtctcttagccatattcttagcgaatgtcttcagtgtgtacacagcagtggtcctttggccacatgctttccgaacgtcttcagtgcatacagtggcagtcccttggacccattcttagaaaacgtcttcagttcgtactcggtggcgatcccttggccacattcttctgcgtgtctgtgtctgtgtccttttcaccctgtaagctgcttttttttcttcattgggtgtctctgactctcatgtggaatccctttcctctgtcaccgcctgtcccaggcacagtgagagacgcagccagcctgctcctctctgcacgtcaccatcccagacattctccagccagcgtcctgaccgcattcattccttctctttcccttgtccacatccttcttcccctacacgcttgataccaagaaatggtctgaatcacagccaaggcttcctttgctttctggaattgcagctccccacccccacccagatcagaggttgagaacctgaatcttcggatttctggagatgcccccatcgcatcagagacctctagtgtgtttctttatatccgtgtagacttgggaggatgacaggagagcaaccttagaaggtggcctgtgcagttccagagcccagggtggaaggggcttccattcatcactgccttcgtgcacctttcattcttgatccaaccgttgttgttgttgttttgagacggagtcttgctgtgtcgcccaggccggagtgcagtggtgtgatctcaggtcactgcaacctccgcctcccatgttcaagcgattctcctgccacagcctctctgagtagggagctgctaaaataaaataccttcagttgggtaatttataaactagagacatttatcactcacagttctgaaggctggaggttcaagatcatggcagattcagtgtgtggtggggatgcactccctggttcatagacgacgcattttctctgcctgctcacatggtggaaagggcgagggagctctctggggctccttttataaggacagtgatcctattcatgaggcttgatccccatgaagtcatcacctcccaagtctcccacctcctgacaccattgtcttaggggtgaggatttcaatgcaggaatttgggggaggaacacaaactttcagattgtagcaaataccattctttaaaaaaatgcagtaatagttaagctttttttttttaatttgataaattttccaagaaggaggagacacagaaaccctccgtgttttgaaggttaatattagtgctgtaaaatacacgtgggacttgggcttataaaaaattcctggtcatggcaaaatataggtggtttgcagtacctggggaagcccacctttcctgtttctgacatgtaacttttgtggaaattgcctgaaagttgtttctagttacccttcagtcctgtgtccaacccagcatgtccgatactatctaacattgttttttttttgagatggagttttgctcttgttgcccaggctgcagtacagtggcacgatcttggctcgctgcaacctccacctcccaggttcaagcgattctcctgtctcagcctcctgagtagctgggattactaaattttatataaatgttgtgtcaagaaatattattgctcttttgcctttttttcccttaaccgttgagaaattcagaaaaaaacatttatgaacgtcaacactgtttttgacaagtaaacattgttcttggcaagtgggccttccaaaaataagggctggcgtttgtggaaactgctctactgttctttttttttcttgctacttttttctttttttttttttttgaggcactaattggaatccacttattcgtcctgggtggagaaagagttcagatctaacactgggggctctgtgtttccttaggtaatacatatgaagtttttgtcactgtaattcagtaatctgtgttaatattatcacaaaagagcagagtggcatttgtgtcttctcagaattgcttattaaaacagctgcatggccagccgcggtggctctcatgcctgtgatcccagcactttgggaggccgaggccggtggatcgcttgagcccaggagtttgagaccagcctgggtaacatggccaaacctcatctctactaaaaatacaaaaagtgagagcgtgcctgtagtcccagctactgaggaggcagaggtgggaggatcacttgagcgtgggagttggaggctgcagtgagctgtgatcacagcctgggaaaccaagcgagagatgctgtgtctaaaattataaaaataaaaattagccaaacatggtgccacgcgtgtgtggtcacagctacctgggtggctgaggtgggaggatcactggagcccacaaagtcgaggctgcagtgagctgagattgcatcactgtcgtgcagcctgggcaccagagtgagagacaccctgtctctaaataaataaataagttcatgattaagcagaagttgtgcttgttctgccgggatttcagttgggttctttgtgccctaatttacgtgagctagtaggttgtgcgttatcttagagggcttgcatgaaagaaagagggtagcctttcttttccctgttttggtagcattgctgaggtggcttttggctgacgggtggacccgtgggtgcagatgttttgatgcagaaggaacgattgccttttcacattcaggctccaactggcttttagcttgtgcgttcttaccctggggtgttcgaggtcaccggactcctattttatttgtgtttaactggaaaggcaggaactctgagaacgtatcaaatagccagtttactgcaggctttctagaatttaaatcgcttccaaaactggatccacaagctaggaattatgtttaagttttaaaaggtgttggtttgcttcttacatgtctaaattcttgggggaaaaactgcaaagaataataaagtttcatgattcaaaaatggtatgaggccgggcacaatggctcacacctgtcatcccagcactttgggaggctgaggcaggaggatgatttttgagaccaggagtttgagatcagcctgggcaaacagcgagatcctgtgcctacaaaaataaaataaaaataggctgggtgtggtggctcatgcttgtaatacctgcactttgggaggctaagtcagtaggatcacttgaactcaggggtttgagaccagcctggtcaacataatgagaccttgtctctagtaacaataaaaaaattagctggacataaggtgtgcatttgtagtcccagttacacaggaggctgaggtgggaggatcacttgagcctgggagttggaggctgctgtgaaacgtgatcgcaccactgcactccagcctgtgcaacaaggagagagatgctgtctctaaaaaaaaaaaaaaaagccagacgtggtggcacacgtgtgtggtcacagctacttgggaggctgaggctgaaggatcgcttgagcccaaggaggctgaggctgccataagctacgatcatgccactgcactccaggctgggcaatagcctgggcgactgtctcaaccaaaataaatttaaaaagataggaaatttcaatgtgaaaatcagtgtcccccagaacgttccatttcttcccagctgggctatttttggagttccatggggagccggctcagtgcaccttgcatgtactcaggaggatgagccctgccatggtgtgtgttaggggacagcctgatctcaccaaccctcctgagcaggcccggccctccgagtaataactgggaacactcgccgctttgtgagaggacctcgtgtgctcactggaaggtcatctcttctggtccacgctgcagtgtggatactttttttgtttgtttgtttgtttgagaaggattattgctctttttgcccaggctggagtgcaatggcatgatctcggctcactgcaacctccacctcctgggttcaagccattcttctgtctcaacctcctgagtagctgggattacagtcgcccgccaccacacccggctaatttttgtatttttagtagagacagggtttcagcatattggccttgctgttctcaaactcctgacctcaggtgatccacctgcctcagcctcccaaagtgctgggatgacaggcgtgagccaccgcgcccggcccagtgtagatacaccttgagcacataactggaatcctttccttgacaacttggagccccttggaacatagtcatataaactgtattgaattaagaggagacaccgttaaatatgtcatagctgtcctcaaaactgggtcttgttttgctttctgcctggaaatgggagtcacttttatagaaaatttattgttcgttaacaaaaaataattgtgtgtgtgtgtatatatatattgtatgtgtgtgtatatatatatatatatatatatatatatacacacagacacacattctctctctctctctctctatggtacaatatgatgttttaatccaagtacacattgtgcagtgattaaaccaagctagttaccatattagcaatgaagctaattaacattaataattaagtgaattaacatattaaccattgacctaattaacatattaacaatcaagctaattaacatattaacaagctaatttacatattcagataaccctaactctaacctatatcacctcacttcgtttttttggtgatgagaatatgtaaaatctagttttagtcattttgaaagatgcaatgtattattattaactataatcactgtgtggtatgatagaactttgaatttatttcttttatgtaactgaaaaaatttaattttaatgtaatttatgtttttgagacagtctcaccctctatcacccaggctggagtgcagcgtcatgttcatagctcatggcagcctccaactcctggcacaggtgaccctcccacctgagcctcccaggtagctgggactacaggtgcacaccaccacacctggttaatttttaaagttttgtagagatggggtcttgctatgttgctcaggctggtcttgaattcctgggcagaagtgatccttctgcctcagcctcccaagtagctgggactgcaggtgcatgccaccatatctagctaattttttcatttttttttatttttagagatggggtttcattatgttgcccaggcttctctcaaactcctggccttctgtgatcctccttcctcagccttccatagcattgtgattccagacatgagccaccgctcctggcctccaactgaaatgttatgttctttgccaaacacttcatgaagcattcttccctggcaaccaccattgcactctctgcgtttatgcgttcagcttttttagattctacctatgagatgatacgatatttgtctctctgtgcctggttcatttcacttcacattgtatctttcagtcccacccatgttgctgcaaatggtaggatttcctttttcatggctgcataccattccattgtgtgtctatgccacattcgcttgatgcacttatctgttgattgaacatgggttgattctatatcttggaaactattagtagtgctgcagtgcacagggggtgcaggtatgccattgatgggcagatttcctttcctttgggtacacaccgagcggtgggatgactggatcctgcacaacattctttgctctgatgttttgcaggccaatggctggaccttagggaacgtcttcactttgtacaaggtgggggtcccttggccacattcttagggaacgtctgcagtgtgtacacgatgttggtctcttgaccacatgcttaggaaacatcttcagtgtgtagctggcagcagtcccttagccacattcttcccgaatgtcttcagtgtgtacacggtggcagtccctagtcctaattcttcgggaatgtctttagtgtgtacatggcggcagtcccttggccgcattcttagggaacgtcttcagtgtgcacactgcggtggtcccttagccacaagcttagggaatgtcttcagtttgtacttggtggcggtcccttggctacatgcttacggaacatattccctgccgtctcttggctgctttcttagggaacgtcttcagtgtgtacatggtggtggtcccttagccacaagcttagggaacgtcttcagtgtgcacaccgtggctgtcccttgggccacatgcttagggaacgtcttcagtgtgtacatggtggcagtcccttggccacattcttagggaacgtcttcagtgtgtacagggcggcagtcctttaaccacatgcttaggggaaccatcttcagcatgtccacggtggcggttcttttgcggcattcttaggggatgtcttcagtgtgtacatggcggctgtcccttagccacaggcttagggaacgtcttcagtgtttacatggtggcggtcccttggccacatgcctagggaatgtcttgagtgctgtcccttggctgcatcttagggaatgtcttcagtgtgtaaatggtagcagtcccttagccacatgcttagggaacgtcttcagtgtgcacacagcagaggtcccttgcgccacatacttagggaacgtcttcagtgtgtacatggtggtggtcccttggccacatccttagggaacatcttcagtttctacacagtggccatcccgctgccacattcttagggaacgtcttcagtgcctacatggtggtggtcccttggccacattcttagggatcatcttcagtgtggacccttggccacattcttagaaaacgtcttcagttcatacatggggacgatcccttggccactttcttctgagtgtctgtgtcatttgctccctgtaagctgcttttatttcttcattgggtgtctctatcatgtggaatcccactcatctgtcaccacccatcccaggcacagtgagagacacagccagcctgctcctctctgcacgtggccatctcagacattctccagccactgtcctgaccccattcattccttctcctgcacggtccacatccttctttccctacacccttgctaccaagaaatggtctgaatcacagccaaagtttcatttgctttctggaacagcagctccccagccgcactcagatcagagattcagaacctgaatcttcggatttctggagatgcccccatcccatcagagacttctagtgtgtttctttatattcgtgtagacttgggaggatgacaggagagaaaccttagaaggtggcctgtgcagttccagggcccagggtggaaggggcttgcatccctggctgcctttgtgcacctttcattcttcatccagctgttttttttttttttttttgaagaggagtcttgctgtgtcccccaggctggagtgcagtgctgtgatgtcagctcactgcaacctccgcctcctgtgttcaagccattctcctgccacagcctcccgagtagctgggattacaggcacctgccaccacacatggctaatctttgtatttttagtagagatggggtttcatcatgttggccaggctggtcttgaactcctgacctcaggtgatccacctgcctcagcctcccaaagttctgggataacaggcatgagccactgcgcccggccgcacccttcattcttgattcacctggttacaaactcgcagataaactgtttctacctgtgacaaatgagtcatccatcttccatgtggtgtcgactttgtccctgttataatattcctgtctcttgttctggtttttggcgtcccgcacattgtccctgttacagtcgtgtctcttgtttctggggtcacccctgtggtgagttgactgtgccctgttcctgaggctggtgaggatgctgtggacaccttaatcacggctgtgaacaaactggctaaagctaggcaccatggagctttgcagtggatgctaagtcgtggtacccattctttgatcagtgacggagccaggtgtcttattaagtctcggggatttgtggaagcccagagcaggcatgcaccttctacattgaaaggaatccttttgacactcaacgttggtgtcgtgaagtcctgcctctggaaatccctgatttcctaagacactaatctaacattttaaaagagttaaaaaaaaatcagtaaaatgttccccatagaagcatgcagtgttttgtgtgtgctttttattgttttttttttttttttttttgagacgaagttttgttcttgtcgccaaggctggagtgcagtagcacaatctcggctcactgcaacctccgtctccagggttcacgggattctcccgcatcagcctgtcacgtagctgggattataggtgtgtgccaccatgcccgactaattttgtatttttagtagtgacagggtttcatcatgttggtcagggtggtctcgaactcctggcctcaagtgatccacccgccttgccctcccaaagtgctgggattaggaatcactgctcccggcctacttgtttttacttttatttcaggttgaggggcacatgcgcaggttcgttacacgggtaaattgcatgtcctgggggtttagtgtagagattatttcatcaaccaggtaataagcctactaccacctgataggtaatttttcaatcctctcgtttgtcccaccctccaccttccagcaggccccggagtctgatcccttctttatatccacgggtacccaatgcttacctaccacttatcagtgagaacaggaggtattttgtcttctgttgctgtgtaagtttgctaaggataatggcctccacctccatgcaggttcctgcaaaggacatcatcccgtttttttttttttgagatggggtttccctcttgttgcccaggctggagttcaattgtgtgatcttgactcaccgcaacctctggctcccgggttccagtgattctcctgccttagccttctgagtagctgagattacaggtgcatgccaccacgcccagctaattttgtgtttttagtagagacagggtttctccatgttggacaggctggtcttgaactccggacctcaggtaatccacccgcctcggcctcccaaatttctgagattacaggcgtgagccaccacgcccaaccaatcccattctttttcatgggtgcatagtattccatagtgtatatgctcccacctttctttatccagtctacatgacgtcgttttgaggtatggatgaaatgatttgcataaaaacagtgaatgctttctattagaatggtgttggcctttctgggaaaccgtggagtcattccaattgcaatttcctagtagatttgattggttaatagaattgggaatttttggggtgcctgatgcacactattggagatcttttttcacagtgtagaaatctcaacatgaatatgtctttttttttttttgagacggagtttctctcttgttgcccaggccggagtgcaatagctcaatctcggctcactgcagccaacatctcccgggttgaagcaattctcctgcctcagcctcctgagtagctgggattacaggtgcctgccaccacacctggctaatttttgtatttttagtagacacagcgtttcagcatattggtcaggctggtctggaactcctgacctcaggtgatccacccgcctcagcctcccaaagtgctgggatgacaggcgtgagtcacagcgcccggcccagtgtggatacaccttgagcacataactggaatcctttccttggaaacttggaaccccttgtgtcatggtcatataaactgtgttgaattaagaggagacactgttaaatatatcacagctgtcctcgaaactgggacttgttttgctttctgcctggaaatgcaagtcatttttatagaaaatttatttttcgttaacaaaaaataattgtatacatatatatggtacaatgtaatgttttaatccaagtacacattgtgcaatgattaaatcaagctagttaccatattaacaataaagttaattaacatattaaaataaagctaataacgtattaaccaagctaattaacatattaacaatcaagctaattaacatattcacataatcctaactctgacctatatcacctcacctagttttttttgtggggagaatatgtcaaatctacttttagtcattgtgaaagacgcgatgtattattaactatcatcactgtggtgtgatagatcttggaatttatttgttttatctaactgaaaaaaattaattttaatgtaatttatgtattttttgagacagtctcaccctatagccaggctggagtacagcatcatgttcatagctctcggcagcctccaagtcatggctcaggtgaccctcccacctcagcctcccaggtagctgggagtacaggtgcacaccaccacacctggttaatttttaaattttttgtagagatggtgtcttgctatgttgctcaggctggtcttgaattcctgggctgaagcgatcctcctgcctcagcctcccatgtagctgggagtacaggtgcatgccaccatacccagctaattttttgttttttttttttagagatggggtttcattctgttgcccaggcttatctcaaactcctggcctcaagtgatcctccttcctcagccttccatagcattgtgattccagacatgagccaccgcttttggccagcaactgaaattttgtgttctttgacaaacacttcagcattctttgctggcaacaaccattgtaccctctgcatttatgtgttcagcttttttatattctacatatgcgatgatatggtatttgtctctctgtgcctgtttcatttcacttcaccttgtatcttccagtcccatccatgttgctgcaaatgacaggatttcctttttcatggctccatactattccagtgtgtgtctatgccacatttgtttgatgcactcatctgttgattgacacatgggtttattccgtctcttggaaactgagtagtgctgcagtgcacagtggggcaggtatcccattgatgggtacacacccagtggtgggatgactagatcctgtacaccattctttcctctgatgtttcgcaggcccatgactggacctttggaacgtcttcactgtgtacaaggtggtggtcccttggccacattcttagggaacgtcttcaatgtgtacatgacggccgtcccttggccacatgctcagggaacatattcagtgtgtacttggcagtggtcccttagccacattattagggaatgtcttccgcgcgtacacagtggcagtccgttggccgcatgcgtagggaacgtcatcagtgcggtccattggccacatgcttagggaacatcttcagtgtgtacatggtggtctcttggccacattcttcgggaacgtcttcactgtgtacatggcggaggtcccttgggcgcatggttagggaacgtcttcagtgtgtacatggcggaggtcccttatccacattcgtagggaatgtcttcaatgtgtacacggtggcagtcccttggctacatgcttagggaacatcttcagtgcggtcccttgaccacatgcctagggaacgtcttcagtgccgtcccttggctgcattcttagggaacgtcttcagtgtgtacatggtggtggtcccttagccacctgcttagggaacgtcttcaatgtgcacatggcagcagtcccttggccacattttttgggaacatcttcagtgtgtacatggcggcggtcccttagccacattcttagggaatgtcttcagtgtgtacacggcggcagtcccttggccgtatgcttagtgaacgtcttcagtgagtacatggcggcgatcccttagtcacctgcttagtgaacatcttcagtgtgtatatggcggcagtcccttaaccacatacttagggaacgtcttcagtgtgtacatggcagtggtgccttagccacatacttagggaatgtcttcaatgtgtacatggcagtggtttcttagccacatgcctagggaacgtcttcagtgttgtcttttagttgcattcttagggagcgtcttcagtgtgtacacggcagcagtcccttggccgcattcttagggaaccttttcagttcatacacagtggcggtcccttggcaacattcttctgagtgtcagtgtctgtctgtgtccttttcaccctgtaagctgcttttgtttcttcactgggtgtctctgactctcatgtggaatcccatttctctgtcaccgcctgtcccaggcacagtgagagacgcagccagcctgctcctctctgcacgtggccgtctcagacattctccagccaccgtcctgaccgaattcattccttcccctgccccgtccacattcttcttcccctacacgcttgctaccaagaaatggtctgaatcacagccaaggcttcatttgctttctggaactgcagctcccagccccacccagatcagaggttcagaacctgaatcttcggatttctggagatgcccccatcctatcagaggcttctagtgtgtttctttatattcgtgtagacttgggaggatgacaggaaagaaacctttgaaggtggcctgtgcagttccagggcccagggtggaaggggcttgcatccctggctgcctttgtgcacctttcattcttgatgcaacttttttttttttttttttaaagatggagtcttgctgtattgcccaggctggagtgcagtgctgtgatctcagctcactgcaccctccgcctcccgggttcaagcgattctcctgccacagcctcctgagtagggagctgctaaaataaaataccttcagttgggtaatttataaactacagacatttgtcactcacagttctaaaggttggaggtttaagatcgtggcggattcagtgtctggtggggacccacttcctggttcatagatgatgcattttctctgcgtggaaggggcgagggagctctctggggtcccttttataaggacactgatcccattcatgaggctcgatccccatgatctcatcacctcccaagtctcccacctcctgactccattgtcttaggggtgaggatttcaatgcaggaatttgggggaggaatacaaactttcagactatatatagcaaataccattctttaaaaacatacagtaatagttaagctttttttttttttaatttgataaattttccaagaaggaggagacacagaaaccctccttgctttgaaggtgaatgttagtgctgtaaaatatacgtgggacttgggcttataaaatcttggtcacggtaaaatataggtggtacgcagaacctgggaaagcccacctttcctttttctgacatgtaacttttgtggaaattgcctaaaattgtttatagttagctcttcagtcctgtgtccaacccagcatgtccgatactatctaacattctttttttttgagacagagttttgctcttgttgccaagcctggagtacagtgacgcgatcttggctcgctgcaaccttcacctcccgggttcgagcgattctcctgtctcagcctcctgagtagtttggattactaaattttatataaatgttgtgtcaagaaataatattgctcttttgactttttttccctaagcattgagaaattcagaaaaaacatttataaacataaacactgttcttgacaagtgggccttccaaaaataagggctggagtttgttgaaactgctctactgtgttttatttatttatttatttattggtacttttttccttttttttttgaggcactaattggaatgcacttatttgtcctgggtggagaaacaattcagatctaacactgggggctctgtgtttccttaggtaacgcatgtgaggttttcgtcagtgtaattcggtaatctgtgttagtattattacaaaagagcaggggggcatttgtgtcttctcagaattgcttattaaaacagctgcatggccaggcgtggtggctcacgcccgtaatcccagcactttaggccggtggatcgcttgagtacaggagattgagaccagcctgggcaacatggccaaactccatctctactaaaaatagaaaaaattagtatgtgcttatattcccagctactcaggaggcagaggtgggaggatcacttgagtgtgggagttggaggctgcagtgagctgtgaccacagcctgggcaaccaagcgagaggtgctgtgtctaaaaatacaaacataaaaattagccaaatgtggtggcacgcgtgtgtggtcacagctacttgggaggctgaggctgaaggatcgcctgagcccaaggaggttgaggctgcagtgagctagcatcatgccactgcactccaggttgggcaatcgcctgggtgtgaccctgtctcaaccacaataaatttaaaaagataggaaatttcaatatgaaaatcagtgtcccccagaatgttccatttcttcccagctgggctatttttggagttctatggggagctgtctcagtgcaccttgcatgtactcaggaggatgagccctgccatggtgtgtgttaggggacagcctgatctcaccaaccctcctgagcaggcccggccctccgagtaataactgggaacactcgccgctttgtgagatgacctcgtgtgatcatttgaaggtcgtctcttctggtcagggtgcagagtggacacatttttttttttttttgagacagagttttactcttgttgcccaggctggagtgcagtggtgcgatcttagctcactgcaacctccacctcctgggttcaagccattctcctgtctcagcctcctgagtagctggcattacaggcgcccgccaccacacccagctaatttttgtatttttagtagagatggggtttcagcatattggtcaggccagtctggaactcctgacctcaggtgatccacccgcctcagcctcccaaagtgctgggatgacaggcgtgagccaccgcgcccggcccagtgtggatacaccttgagcacataactggaatcctttccttggaaacttggaaccccttgtgtcatggtcgtgtaaactgtgttgaattaagaagagacaccattaaatatgtcacagctgtcctcaaaactgggacttgttttgctttctgcctggaaatgcgagtcatttttatagaaaatgtattgttcattaacaaaaaataatcgtatacatatatatgaggtacgtgatgttttaatccaagtacacattgtgcggtgattaaatcaagctagatactatattaacaatcaagtcaattaacatattaataatcaagctaataaacacattaacaatcaagctaattaacatattaacaagctaattaacatattcacataaccttaactctaacctatatcacctcacctacttttttttgtggtcagaatatgtaaaatctacttttagtcattttgaaagatgcgatgtattattaactatgatcactgtggtgtgatagatctttgaatttatttcttttatgtaactgaaaaaatttaattttaatgtaatttatatttttttgagacagtctcaccctatcacccacggtggagtgcagcgtcatgttcatagctcactgcagcctccaactcctggctcaggtgaccctcctgagcctcccaggtagctgggactacaggtgcacaccaccacacctggttaatttttaaattttttatgtagatgggatcttgctatgttgctcaggctggtcttgaattcctgggctgaagtgatcctcctgcctcagcctcccaagtagctgggactacaggtgcatgccaccatacccagctaatttttttgtttttgttttttttttagagatggggtttcattacgttgcccaggcttgtctcaaacttctggccttcagtggtcctccttcctcagccttccatagcattgtgattccggacataagccaccgctcctggcctccaactgaaatgttatgttctttgacaaacacttcatgaagcattcttccctggcaaccaccattgcactctctgcttttatgcattcagcttttttagattctacatacgagatgatatggtattctctctgtgcctggtttatttcacttcacattgtattttccagtcccatccatgttgttgcaaatggcaggatttcctttttcatggctgcatactattccactgtgtgtctatgccacatttgcttgaggcactcatgtgttgattgacacatgggttgattctatatcttggaaactgtgagtagtgctgcagtgcacagggggtgcaggtatcccgttgatgggctgatttcctttcctttgggtacacaccttatggtggaataactggatcctgcacatcattctttcctgtgatgtttcacaggcccatgactgaaccttggggaatgtctttactgtgtacaaggtggcggtcccttggtcatattctttggaaacatcttcagtgtgtatacggcgttggtcccttggtcacatgcttgggaacatcttcagtgtgtacatggcagcagtcccttagccacattcttagtgaatgtcttcagtgtgtacacggtggcagtcccttggctgcatgcttagggaacgtcttcagtggtgttccttggccacattcttagggaatatcttcagtgtgtacacggtttgtgtacagggcggtggtcccttagccacaagcttagggaacgtcttcagtgctgttccttggccacattcttagggaatatcttcagtgtgtacacggtttgtgtacagggcggtggtcccttagccacatgcttagggaatgtcttcagtgtgtacccgtggcggtcccttggcctcatgcctagggaatgtcttcagtgccgtcccttggctgcattcttagggaatgtctttagtgcgtacatggcttcagtgcgtacatggcggcggcccctcagccacatacatagctaacatgttcagtgtgtacactgcaacggtcccttggccccattctttgggaacatcttccttgcggtcccttggctgctttcttagggaatgtcttcagtgcctacacagtggcagtcccttgtccacattcttagggaacgtcttcttctgtacatggtgtcgatcccttggccacattcttagggaacatcttcagtgagtacatggcggtggtcccttggccacatttttagggaacttcttcagtgtgtacatggctaccgtcccttagcccatgcttagggaatgtcttcagtgtgtacatggaggtggtcccttggccgcattcttagggaccgtcttcagtgtgtacatggcggtggtctcttggccgcattgttagggaccatcttcagtgtgtacatggcggtggtcccttagccacaagcctcgagaccgtcttcagtgtgtacacagctgtcgtcccttgggccacatgcttagggaacgtctgcagtgtgtacacggtggcggtcccttggccacattcttagggaacgtcttcagtgaggtcccttggccacatgcttagggaatgtcttcagtgcctacacagcggcagtcccctgtccacattcttagggaacgtcttcagtttgtacatggtgtgggtcccttggccacattcttagggaacatttttagtgtgtacatggcggcagtcccttagccacattcttagggaatgtctttagtgtgtacatggtggtagtcccttggccgcacacttctggaacgtcttcagtgcggtccctttgccacgttcttcgggaacatcttcagtgtgtacatgatggcggtcccttagccacaaacttagggaatgtctttagtgaatacacagcagcggtcccttggctgcattcttagggaacgtcttcagtgcggtcccttgaccacattcttaggaaatgtgttcagtgtgtacatggcgtcggtcccttggccacattcttagggaacatcttcagtgtgtacatggcggagtcccttagccacatgcttagggaacgtcctcagtgtgtacacggtggcagtcccttggccacatgcctagagaacatcttcagtgctgttcctttgctgcattcttagggaatgttttcagtgtgtacacggtggcagtcccttggctgcatgcttagggaacgtcttcagggtggtcccttggccacattgttagggaacatcttcagtgtgtacatggcggtggtcccttggccgcattcttagggaacctcttccttgtgtacagggcagcggtcccttggccgcattcttagggaaagtcttcagtgtgcccacggcagcggtcccttgggggtgaggatttcaacgcaggaatttgggggaggaacacaaactttcagatagtagcaaataccattctttaaaaaaatacagtaatggttaagcttttttttttcttgattgataaattttccaagaaggaggagtcaaagaaacgctccttgttttgaaggtgaaggttagtgctgtgaaatacacataggacgtgggcttatataaaaatcctggtcacggcaaaatataggtggtacgcagttcctgggaaagcccacctttcctttttctgacatgcaactttttcggaaattgcctaaaagttgtttatagttagcccttttcggccctgtgtccaacccagcgtgtccggtactatctaatgttctttgtttttgagacggaattccactcttgttgcccaggctggagtgcagtggtgcgatcttggctcactgtaacctctacctcctgggttcaagcaattcccccgcctcagcctcctgagtagctgggattaccggtgtccgccaccaggcccagctaatttttgtatttttagtagagacggggtttctccatgttggccaggctggtctcgaactcctgacctcaggtgatctgcccgcctcggcctcccaaagtgctgggattacaggtgtgagctactccgcccagcctaattttttattatttttaatttttaacattttttttttggagactgggtcttgctgtgtcccacaggctagagtgcagtggcatgatcatggctcactgcagctttgacctcctggactcaagccatgctcccacctcagcctcatgatagctgggactccaggtgtgtgccatcatgcccaggcaagtttttaaaaaaattatttgtagagatggcgtctcactatgtttcccaggttcgtctggaactctgggcctcaatggatcttcccacctgggcctcccagagtgctgggattacaggcatggggcacagtgcccagtccctcatgtgtgtaattgttcaacagctagagaaacccaaacacataccctcagacactgtcccgtctgccgcccaggtctcctcacctgcatggtttgctgttgccacttgatttaatggagggcataatgaatgacccttaaacacggcctctaagagtcctcgtaagtgccttcctcattaaaattcaagaggaatcaaatacctgttactgaatataaatgtttagaggagaaagcctgtgagctgagagtcatatcttaaggggtgtgtgcttgcagaattatcacattttcaatttcatgtgtgaataaattgttgtatttgggatcaccaagaaggcagaaacatgtatcaatgaaatttagtagacggctaaaaacaaacagtagcagcctactgaggggctgtggaataagcagattttagatttttagagggaaaacggtgatggtaggttatttccccaatggcttccaggcctccaactcaggcttggaattggccatggtcattggccctttttttttttttttttctttttgagacggagtctcgctctgtcgcccaggctggagtgcagggtgtgatctcagctcactgcaagctccacctcccgggttcacgccattctcctgcctcagcctcccgagtagctgggactacaggcttccgccaccacacccggctaattttttgtatttttagtagagatggggtttcactgtgttggccaggatggtctcgatatcctgacctcgtgatctgcccgcctcggcctcccaaagtgctgggattacaggcgtgagctaccgtgcccggcccattggctcttttttttaccatctcatcttctctcacacgagttattctcactgttggaaagaacttgtccttaaagcattgcttccaggtgagtgtaacggtgcccagcatgtgatacaagttaaaaataagagcagagcccaaatgctgtcattgcttgatccatcatttcccctgtcatgcagctcatttgagtaacagggtctcgtttcggggtgctgtgtccggagaggcagaactccccttggagaatgggtagagaatgtacatcacttgccaagtatggtggttttgcatgctgccttgactggacttgtttgcctttggttttctgtaagaatcttaggatatctgcccaggagttagacccctgggctaaagtaaggttgagggccagccacggtggctggtgcctgtaatccctggactttcggaggctgatgtgggaaaatcacttgagtccaggagtttaagaggagcatgggcaacgcagtgagacccccgtctatataaaatttaaaaaaaattagctggacatggtggtgtgcatctgctcccagctactttggaggctgaggtgggaggatcactggagcccaggaggtggaggctgcagtgagccatgatcacaccactgcactacagcttgggtgacagagccagaccctgtctctacgaaacacaaataaaaagtaaaatgaggttgagaaactccgcctccctcttgatttcaaggtaatactcagcttctagattgacacacacacaagtcattgtcttatcatagtgacatgtgacggaacacgcacgtgtctggtgacagatggtgcattgaggggaacattccttaagctgtgtttccttggggaaagaggcaatagcattctctgttagtacagaacccttcagtttgtacaaatgtcttcggaaagggaatattcctgagagcttctacgtggcagttaacaagtcacacttttcatctcagatgtctcaatttccagaagatggtacttgattacatttcctggggttcttgtttctaggaaatcgcggctgggtttttctagaaataatgcagtgatttggggacctgtggcactgggaagggtatgatctcaggcacaggactgcaaagacacgttgtttaccggccagcatgataactaggcgtgacgctgatggccagtgtgttgcatacgtactgggctttattatccatacctggatggaactgaatatatatatatacacacacacatagacacccataatatattatacaatgtaattatatatcatcatatatcatatatattataatatatacagttgacctttgaacaacacaggtgtaaactccataggtccatttatatgtggattttctgccacctctgccacccccgagacagcaagaacaaccctttttgttcctcctcctcctcctcagcttcttcagcatggagacgatgaggatggagacctttaggatgatccacttccactcgatgagtagtacatatgttttctcttccttaagattttcttaatagcattttcttttctctagcttactttactgtaagaatgcagtatataatacatagaaacacaaaataaatacaaacatgtgttgagaatgtagtatataatatatataaatacaaaatacatgttgattgacagtggcatgatctcagctcactgcaacctctgccttctgggttcaagcaattcttctgcctcagcctcccaaatagctgggcctacaggcgcacgccaccacacccagctaattttttttgtatttttagtaaagacggagtttcaccatgttggccaggctggtcttgaactcctgacctcgtgatccacctgcctcagcctcccaaagtgctgagattacaggcgtcaaccactgtgcccagccgtgtgagtctttatggtagaacaatttatattcctctgggtgtgtacccaataatgagattttcagtagactttgagtgaagccgatagctgttcataatgtgggtgggccttgcctaatcagtggaaggtcttaagaggtaaaaagagtccctcctccaaggaagagggaattctatctggaatccaccttcagacttgagctgcgacatcatgtctccatgggcatctggcctgctggtctaccctgcacattttggttttgcccctcccccacatcttgggagccagttctttaaaatctctttctctctatatatatatcctactggttgtttctctgcagaactgtcactcatgcagatctgtgtccacagatgacatcattgcaaagccactaagagagacatagcatccagggaatggaaggaccaggttcctttcagacttgaagacacgtcaaaacacattccaccgcgttgccttggagaacccagggaccaggcctcttcccctcctgtcaaatagtccttagcctttgttcttcttgctccttgtgaatttcacaggcttccttgactttgaattctgctccttggatgtctttgttggtgaacgtgatgagatagaattttggaaagctccgaggtgtgatcattgcaccctgggactgacacgtgctccgtcttcactgaagacagccggaagccgtggtgttccagaacttgaatgtggctgtggaaactagagtgtccatgcatcctgggcggtagctactggtgccgtctgcgtcgtctgtagctcctcattgctgattctcattcggctgcctcagtcaggacagggctggttacagcgttgctcttcatgctgttcaagtcagggtgatctacagggacagaacgaataggactgatgtgtatatgaaggggagtttactaggataattgactcacacgatcacaaggtgaagtcccacaataggccgtctgcaagctgaggagccaggaagccagtccaaggcccaaaacctcaaaagtaggcaagctgagagtgcggccttcagtctgtggtcgaaggtccaggagcccctggcaaatcactggtgtaggtccaacggtccaaaacccaaagaccctggggtcttgatgttcgagggcaggaagcatccagcatgggagaaagatgaaggctagagatcccgccactgcactccagcctgggtgacagagcgagactccgtttcaaaaaaaaaaagaaagaaagaaaaacatttaaaaagcagaaatgagctggatgcggcatcttctgcttgtaatcccagcattttgggaggccaaggtgggtggattgcttgagcctaggagctcgaaaccagcctgggcaacatacggagaccctgtctctacaaaaaaacacaaaaattatctggccatgctggtgcacacctgtagtcccagctactcaggaggctgagatgggaggtttggttgagcctgggaagttgaggctgcagtgagccatgattgccccactgcactccagcctgggtgaaagagtgagaccttgtctcaaaaaaaagaaaaagaaaaaagaacaaataagaagacagacacacctctcttctttgtgtgggtacagccgttggcaaactttgctgacagatgctactgaccttgttttcctttctgcattctgttcatttcaaaagtgggtaaatcagaagtgggactcactgtgaccttcagtgactcaatgctgaattcacaagattaattggagagtgtgaagaatgcagggcatccgtggacccattttaatgaattttagcatctcttgcatccttgtatccttgcatccagtaccggtccccagccttttagtaactgggctgtgcagcaggaggtgagtagcgtgtgagtgagcaaagcttcatctgtattgacagctgctccccatagctcatattacctcctgagctctgcctcctatgagatcagtggtggcattagagtctcataggagcatgaaccctactgtgaactgaacatgtgagggacctaggtggcgtgctccgtatgaaaatctaatgcctgatgatctgtcactggctctcatcacccgcacgcagatgggaccgtctagttgcaggaaaacaagctcagggcttccactgattctacacgatggtgagtttcataattacttcattctctattacagtgtaataataatagaaataaagtgcatgataaatagaatgcacttcaatcatccccaaaccatcccccaccccacatcagtggaaaaatggtcttccatgaaactggttcctggtgccaaaaagcttgaggaccactggacaaaggaacttgtcagagtatggattgaaggtctttattgatgctttgctgtcactcttactttaagatgaatgcgtatatatatgtatatacattctgtaatgtgtgaatatatgaagctccagctgctctctccctctctttcctctgcagtccaattctcgtagatcagtcttttcctgaaatgaatgacctcttaaattttattttatattttaagcttttatgttattttactttatttttaagctgtttttattttttaagcttttttttttttgagacaaaaaagtctcgctcttgtcacccaggctggagtgcaatggcatgatctgagctcactgcaacctccacctcctgggttcaaaaaattctcctgccccagcctcctgagtagctgggactacaggcgccagccaccacgctgggctaatttttgtgtttttagtagagacagggttttaccatgttggccaggctggtcttgaactcctgacctcatgatccacccacctcggcctctcaaagtgttgggattacaggtgtgagccaccacaactggccagtttgcaggtctttgttgatgctttgctgtcaatcttactttaagacgaatgcatatatatgtatgtgtatacattctgtaatgtgtgaatatatgaagctccacctgctctctccttccctctcctctgcagtccagtactctcctagatcattctgttcctgaaatgaacgaccattttttttttttttattttgagatggagtcttgctctgtcccccaggctggagtgcagtggcgtgatctcggctcaccgcaatgtccgcctcctgggttcaagcgattctcctgcctcaccctcctgaggcaggattacaggcgccagccatctcgcccggctaattttttaatttttagtagagatggggtttcaccatgttagtcaggctggtctcaaacttctgacctcaggtgatcagcccaccttagcctcccaaagtgctgggattacaggcgtgaagccactgcacgtggccggtttgcagtctttattgatgctttgctgtcaatcttactttaagatgaatgcatatatatgtgtgtgtgtgtgtgtgtgtatgcattctgtaatgtgtaactatatgaagctccagctgctctctccctccctctcctctgcagtccaatactcctagatcattctgttcctaaaatgaatgaccattcaggttttttttttttttttctgagatggagtctcgctctgtcacccaggctagagtgcagtggcatgatctcggctcactgcaatgcccacctcccgggttcaagcgattctcctgcctcggcctcccaaagtgctgggattacaggcatgagccaccgcgcccggccagaattcagttttttttttttccccatggttatccaatagcacacaggctcgtgaagccttcaaggtgcttcatctgaggttcgcttagaatggttgccacatattgttctgccggtgagttttcatgaattggactctgaaggttcttaattatggtggttgagtgacacggtctttcttctataagaacctaagttacactgcatatcaggaaaatgtgttcctgggaccagctttgttgggtttttggctgctggtcatcttcactttactctcccaaatttgaggactgtgacacacacacacacacacacacacacacacacacactctctctctctctctctctctctctctgtctctcttaggaaacaatggtatatcaacaatgaaatgatgcttttttttcttcttcttttttttttgagacagggtcttgctctgtcacctaggctggagtgcactgatatgaacatggctcactgcagccttgctctcccaggctcaagcaatcctcccacctcagcctcctgagtagctgggaccacatgggcacaccatcacacctggataatttttgtatttttagtagagacggggtttcactatgttggtcaggctggtcttgaacttctgacctagtgatttttctacctcggcctcccaaagtgctgggattacagacatgagccaccagactcggctgagcatcttttcaatatgaccttgtgtccgggcatggtggctcacacctgtaatcccagcactttgggaggctgaggtgggcggatcacgaggtcaggagatcgagaccatcctggctaacacggtgaaactccatctctactaaagatgcaaaaaaaattagtcaggtgtggtggcgggcacctgtaatcccagctactcgggaggctgaggcaagagaatggcatgaacccaggaggcagagcttgcagtgagccgagattgcaccactgcactccagcctgggcaacagagcgagactcggtctcaaaaaaagagaaaggattcaaggcagtgtataccaaacatgaaagtaaagttcaggaacctctttgatggaggagatgacggtggggtctgtagcctgttcatgcctataattgcaacacgtcgggaggccaaggtgggaggatcacttgaggccaggagtttgagatcagctcggccaacatagtgagaccccatctctacaaaaataaaaataaattagtggggcatggtggcacacacctgtagttccagctacttgggggactgaggcaggaggatcacttgaaaacaggagtttgagatcagcctgaacaatggagcaagaccctgtctctacaaaagattaaaaaaaaaactggcagatgtgctggcacgtgcctgtagtcccagctgcctaggaggctgaggcaggaggattgcttaagtctgggagtttgaggctgcagtgagctgtgttttcaccactgcactccagccggggtgacagagcaagaccctatcagtagtagtagtagtaataataataataataataataataataataataatatgttgctgcaaaagtaattgctgcttttgccattaacttttgcaccaacctcatgataaaacaacaaaaactcaacacctgtacctgccatgccctgaagctcatgacagtagacaaaactcactgtgtctccagccctcagtgttagatgaagggaccagggtgtgggaagatcagcagttcaaacgggaatcataaaacacatagtttttatttttttagttttgttttattatttatttatttatttttgttgttattatttttctgagatggagtctccctctgtcacccaggctggagtgcagtggtgtgatctcggctcactgctacctctgcctcccgggttcaagtgattctcctgcctcagcttcccgagtagctgggattacaggtgcgtgctaccatgcccggctaatttttgtacttttagtacagacggggtttcaccatgttgattgggctggtctcaaactcctgacctcgtgatccgcctgcctcggcctcccaaagtgctgggattacaggcgtgagccactgcgcccagcccccatgaaacatatagatattttcaaaacaactgtactaggatcaagaaggataggacttttgtttttcctgttttttaagaatgaaatatcatatggcgtaagcatagatttatttatttacttacttatctattcatttatttttagagacaggatcttgctctgttgcccaggctggagtgcagtaatgcaatcatagctcactgcagccttcaagtcctgggctcaaacaatcctcccatctcagcctcccacgtacctgggactacacatgcaagccaccatgcctggctaagttttaaatttctttgtagagatggggtcttgctatgttgcccaagctgatctcaaactcctggcctcaagtgattgtctcaccctgacctcctaaagtgttgggattacaggtgtgacccactgcttcctgcctagactttttttttttttttccaattaaggtttttactttgagatcattgtagatttataagcagttgtaagaaataataggaaagaatcttgtgtctacttcccccagtggtaacatcttggaaagcaataataccatgtcacaaggaggatattcacattcaggcaataatgcattgatcttatgttttactcgtatccgtgtgggtttttgtaccgagttctgtgcaatttcatagtgcgtgcaggtttgtgaagccagcattgtccgcaacacacagagcatttctttcaccaacaacccctcctgtttctctctctgcatcctacctcaacctcctctcccgtcctgaacccctgagaattactagtctgttctctatttctgtaccaacctgcatcctacctcaacctcctctcctgtcctgaacccctgagaattactagtctgttctctatttctgtaccttttctcatgtcaagaatgtcatataaatggagtcatacagagtgtaacccctttcaaatcacgtgtgtctttttttccttcactcaatagaattccctggagagccatccaagttgttgctaagaacaataagatgtttctttttaagtaacacctgcaaaaagtcttttataaaatggcgatgaaactaaatggtttttgattctaaacaaggcagccatgaatggttttctcgtatatcttagcatatgtgtgggagtgtatctgtgcaagtaattcttggaagtggaatagctgagccaaaaagaaaatgcatgtaaattttcttttctttattttaaagagacagcgtcttgctctgtcacccaggctggagtgcagtggtgcaatcatagcttgccgcagcctcgacctcctgggctccagtgatcctcccatttcagcctccagggtagctgggactacaggcgagcatcaccacgtctggctaatttatttttatttttgtagaggtagggtcttgctatgttgcccaggctgggcctcgtgctcctagcctccgctgatcctcccaccttggcctctcaaagtgttgggattacaggcataagctaccaggcctggctgcctgtcacctttcaggagtcattgtcaacttatctcctaagaaaatgcagtcttggtgggtacatttgaactgagtatgtaaacttctaacttctccaaggcatacgcattctggataacaaccctactttttaacctattccatgtgattgatgaaagctcacaattgctttattcattatttcattgtcagcgagactgaactttgtttcatatgcttatgttttatttcatatctccaaattgcatattcatttcctttacccatttgtggagggactggggtttggttagaagagctctttatagaccgggcgcggtggctcacgcctgtaatcccagcactttgggaggccgaggcgggcggatcacgagatcaggagatcgagaccatcctggctaacacagtgaaaccctgtctctactaaaaatacaaaaacaaaattagccgggcgtggtggcgggcgcctgtagtcccagctactcgggaggctgaggtgagagaacggcgtgaacccgggaggtggagcttgcattgagctgatattgcgccactgcattccagcctgggcgacagagcgagactccatctcaaaaaagaaaaggttagaaaaatacaccatggaatactacgcagccataaaaaggatgagttcatgtcctttgcagggacatggatgaagctggaaggcatcattctcagcctaataacgcaggaacagaaaaccaaacaccacatgttctcacttacaagtaggagctgaacagtgagaacacagggacgcagggagggggacatcacacaccagaacctgctgggggctggggaacaaggagagggagcgcattaggacaaatacctaatgcatgcagggcttaaaagctagatgatgggttgatgggtgcagcaaaccaccgtggcacatgtatacctatgtaacaaacctgcgcgttctacacatgtatcccagaactttaaaaaaaaaagaaatagtatttcaatatggtctgaattaggatgtctgttattagatataaaggagaacatatgtgttgagggccatttgagcctgttctgtatataaactcttatttttgcccttttctttgtagcatgtttggggtttttctggagttgaactttttagatatctgaaaaatagctgttaatatttctgatggaagttgcaaattttcttccagctcattatttattttttactttgcttatggagatttgttttgttttttaccatgtgattttttttttgagatagtgtcttgttcctcctggagtgcagtggcacgatcttggctcactgcaacctccatcccttgggctcaagtgatcctcccatctcagcctcccagcttgctggaactacaggcacgcaccgccacacccggttaattttttaaattttttgtagagatgaggcctctctctgtttcccaggctggtcctgagcttttggcctcaagcgatacccccacctcagccctcaaagtgctgggattacaggcatgagccactgcccggcctgttttttaaacaagtagttttttaaatagtgaaatctatctaaccatctttctgaattttcgtttaggaagcattttctttctgtggaggttaaactaatgattcctgctttcttgcaatcttctcatggtttaactttgtttttgccttggagttcactcatgcatgctatgaggtctggcactaattttatctgtttcctaatgtggcttcacgtgccccaacacggtttattaaaacgcccatcttttgccccttttgtcgtgtactcaatttccacatgcagttggcctatttttggaaattgtaccctgttccttcctccattaatgcctgtagtacctcccgtttaattatagaagcttctcaaatgttttaatctcctacagggccattgtgttctcaatctttgtacatatcagaattttcctctttgccgcctcatttggaattcttttccccacagcaattttcgaatcgattcgtccagtttgcctaaaagaaattctgtgaactatctttattggatcacatcaaatttgcatattgacttgggtcattctgacacctttaggattgtatcagtttagattttttttccccctccaacttctattttattttttaaattaaaaaaaattttttttttgagacggagtctggctctgtcgccctggctggagtgcactggcgtgatctcagctcactgcaagctccacctcccgggttcaagcgatcctcctgcctcagcctcccgagtcgctgggattacaggtggcacacaccaccacgcccagctaaattttgtatttttagtagagatgcggtttcaccatgttggccaggctggtcttgaactcctgacctcgtgatccacccgtctcggcctcccaaagtgctgggatgacaggtgtgagccaccgcatctggcctcaacttctattttaggttcgggggtacatgtgcaggtttgttccctgggtatattgtgtgatgttgaggtttggagcacaaggatcccgtcacccaggtagtcagcacagcactcaatagttttccaacccttgccccatcccttccttgccccattgaattgctcagtgtttattgttcccatctttatgtccatctgtacttgatgtttacctcccagtaagaagtgagaacgtctgatatttagtttcctggttctgtgttaattcacataggagaatggcctcctcttgcatctatattgctgcaaaggacatgatttcattctttttaatgggtgcatagtattccatggtatagatgcaccatgtcttcctaagaattgaattaacatttgagccagcaatcccattactgggtatctacccaagggaaagtaagtcattctaccaaaaagacacacgtactgtgtgttcatcgcagcactattcataaaagcaaagacatggaatcaaacttaggtgtctgtcaactccggattggacaaagtttgggggttttttttgtctttttttttttttttgtgagatggagtctagctctgtcgcccaggctggagtgcagtggcacaatctcggctcactgcaagctctacctcccaggttcacgccattctcctgcctcagccttccgagtagctgggactacaggcgcccgccaccacgccaggctaattttttgtatttttagtagagaccgggtttcaccgtgttagccaggatggtgtcgatctcctgacctcgtgatccacccgcctcggcctcccaaagtgctgggattacaggcatgagccaccgtgcccggccgtcttttttttgttttgttttgagacagtcttgctctgtcacccaggctggagtgcagtggtatgatcggagctcactacagcctcaacctcccagtcttgcgtgatcctctgaactcagcctcccgggtagctgagatgacagccgtgtgccaccatgcctggctaatttttttgtacctttttttttgttttgtagcaatggggcttcactatgttgcccaggctggtcttgaactcctgggctcaagcgatctgcctgccttggcttcccaaagtgctgggattacaggcatgagccactgcgcctgacccatttgggtctttggagaagcacacaccaagaaggaacatgatgggccagagatttactaggggaactgtgtgtgaagggtcaaacaggcgctggcagaagagtggaggaaggcttgcaggtgatggtgtaggtgcctcacacctgtgaagaaagagacggcgaggaattgggtagaaggagcgtccagccagttctctggtcatgccgagtcattggctgtgaaaacccaaaaccctgaggaagcccgatcttgcgaaacatgttccccatctgcagaggcaccgggtggctggtgtcaggcgattgttgcaacctgttgtgtgcgggggtgtctgtgtgggtacatacatacttctcagccccaatgccagcttcctggtccgtaaggaaaacactaaactcttctagctaaagttacaaatgcagcaagggtccattctgcaatctgtgatgcttttttttttttttttgagctggggtctcgctaccttgcccaggctgcggtgcagtggcacaatcacggctcactgtgcgttttcagggaagaccccacgggcacctccaaaaccatgtggcatgacatcctcaccgagacccgagggcatctttccatggcctcaactctacttttatgtctttaggtttcctgatataggttttgcacactctcgatgaccaagtctcatttcagtgttgctgttgtttctatattataagcaggactgtctcttcccctacctttttaacctgccaattgtttgtgtatgtatggaagctattgatatttgcttctgagttttctatctgactaccttcctgaattctcttcttggatttatttaatgttgattttgttagttttttcctggcataccatcatatcatctgcaaagtatattttgactctccctctgccgttcttgtgtctgttgtaattatttgtctgaccatgttggataagatctccagtagcatgttaaatgacagggtgcactcctggaatccagctctttgggaggccggggtgggaggatgacttgagccccggagatcaagaccggtctgggcaacacagcaagaccccatctttacaaaaaaaaaatagtaaaaaaaattagccaagtgtggtggctcacacctgtagtcccagctacttgggaggctgaggcaggaggatcatttgagtccaggaggtcgaggcttcagcgagccatgattgcaccactgcactgcagcctgggcaatgtagtaagaccccagctcaaaaaaaaaaaaaagcatcacagagaacaggatggatacttgctgcttttccaagtttagctggaagattttagagatttctttattgactaggaagttggcattggggctgagaaatatgtatgtacacacacagacacacccacacacagacacacatgtatacatacacagtatatatgcatactgtgtgtctgtaattacaatttaataatacattcctatttttaaaataaacttagtaaattaagaacatcaatacatctactgatactacatatagtatttgcaagtccctcagcttgggtcaggaacacgggaatgtcattgtacaggttctatcttcaggttacgagggatacaccagaaaacctaagcatatggaaaacttattcggcaattttctaagtgaacataccttttcatcgattcatgcgtgtatcaagaaaaacaaaatgaaagtcttacacaccaagaggattgttcgcacaatactgacaacgaaatgtacgggctgacaaataacagattatatgttgaagcctcctccacaggccccacctcctgataccatcaccctggcgattgtatgttctcaacataggaattattttggggggagaggagacacaacattttatacttggaaaggtgaaatggaaaagcagcataggctttattgttttattttattttattatactttaagttctggggtacatgtgcagaacgtgcaggtttgttacataggtatacacgtgccatggtggtttgctgcacccatcaacccatcatctacattaggtgtttgtcctaatgctctccctcccctagtccctcacctcctgacaggccctggtgtgtgatgttcccctccctgtttccatgtgttctcattgttcaactcccacttgtgagtgagaacatgtggtgtttggttttctgttcttgtgttagttcgctgagaaggatggtttccagcttcatccatgtccctgcaaaggacatgaacccatccttttttatggctgcatagtattccatggtgtccatgtgccacattttctttattcagtctatcgttgatgggcatttgggttggttccaagtctttactattgtgaacagtgctgcaataaacatacgtgtgtgtgtcgttatagtggaatgatttataaacctatttctatttaaattacctttgtatttttatagattttgtgggtatgagtacacttgtgttacatgaatatattgcatagtggtaatgtttgggctgttagtgaggccatcactcaaataacgtacatggtagccaataggtaatttctcatccctcatcccatcccaccctgtgagacttctgagtcctcgatgtctattttttatgctctatgtcgacgtgtacacattatttaattcccgcttataagggataacatgtggtacttgactttctgtttctgagccatttcacttaggataatggcctccagttcccttcgtgttgctgcaaaagacacaacatcattccttttcatggctgtgtagtattccatggtatatatgtgccatattttaaaaaatcaaattgtctgatggtggacacttaggctttatattttaataaagaacattccaaatatgttgaacaaaataatctcctaacttgaaaaagatcatatgtgcctataataattcacagaaagggactttcctgactacctgcctgcaaaatccacttttccctcagtctttctttctcaagggaattcatggaaattccctccttgaattttctcagcccccagtacaaggagtcattcttgcctcatcatgtccccctctctgtccttgtcttgtgatttctttttattttgaacgcgagaagtctgactcccaccagcacccctgtggccagtacctgtgagacatattctgaatccagcacctctcataccacctgtgctgaactgtggcggagctcccccgtcagtccctgcagctgcttcaggagacccttgatagccttgtcttcctccagctcaagtggattctccatgaatctattccttcctgtgaaacatatcacagattggctcagagccccgtgatgacgccctgtctgccagagagaagctcacgaactctggggtgcccctactccttcttccctcctctcttccctccttccatgtgcttggctccagctagccagccagccgccttcctcttcctggaatatcccaggcctgctagacttttgctctcaccgtcacaacatcagctcaggagcccctccttggaagattgttctctaaccctccgtccagaatcactgcttctccctttcctcttcttcctttgaagttcattcataactggaagatgtgagatctggaaagttctgcattattgccagacacatctgtgtatttagagtggttggtatctttcccaggggaaccaaatgtccttgaggcagacaacatgtttatctttgtctaattcatttccctgtatgctgggcacagagtgtgggctctacacatattttataaaagaaggagggaagggttagaagatggacagaaggaaggaggaagaaaggaaggaaagagggaggaaagaaaggaaagagggagggaaggaaagagggaaagaaggaaggaaagagtgagagaaggaagtaaagaggaaaggaagggaagggaaggaaggaaggaaaaagtgagagaaagaagtgaagaggaaaggatggaaggagaaaggaaggaaagggagggaaggaaaaaggaaaagaagaaagaaggagtgagacaaggaagtaaagaagaaaggagggaaagaggaaaggaaagaaggaaagagggagggaaggaaggaatgaagaaaagaaagagggaaggaaggaaggaaagaaggaaggaggaaggaaggaaaaagggagggaaggaaggaatgaagaaaggaaagagggagggaaggaaggaaggagggagggaaggaaagagggagggaaggaaagaatgaaggaaggaaggaatgaaggaagaaaggaaaaagagaaggaaggaggaaggaaggaaagagggaaggaaggaaggaaagatggagagaaggaagggaggacaagtggaaggaagaaaaagaaatacaaatctccctcaaaatgtggatcactcgtcttaaccagaaattcaagtgagatgctatctgcacgtgtgataccagcagctatgaagcaaactgtattaaccaagtcttttattttctgtgttctgatgcatgactttcatggccttgtcaaccctagagaccctgcccctcccatagctagcgaatccccagaggtggtgaagagcccacctatgaacctgtctttcatatgcaaacccatcaatccagaatccaccccccagccatctcctttattggggttgcatattccacgtcactctccacctgccctaaccaccccaaagccaggtaccagagagtcagggacagcccctatgccccagagcctgctgaaatcattcacactagccaactgtaagcctactcgcctgttccttcccttggaaaccacagtgagagctctggtctcctttgtcttcccacctgaccaaacttggtgcgcccctgtgtggtcctgagtggtgtcaacacgcccctcctcttgggacctgtgagtaacaaaccacttgcttaacggcagtctcctgatctgttggccccaccatacctacatcataataaagtctacattttacaacgcaaacgaacaaaaatgtcctgctcagtgctgccctgagagcagaggttattccaggattcttgctcgcctctgtaaagggtatccgttctgcagacctttctgccggtcacactgacggcatattgcagagcctgccagggactcacaggggatgacaggggatttatcaggtggttttttactgcactgtcattactgggggcgaatccactttaatacattcatgcctcctgagcctgtgggaattcaagaggaacagaaccagaaataaatgaaccataactccctttggcatcttgcctctctggaggcttaattcttacaaatatgtgctctgctttcaaatcttagtttgatgattttctcttcttctttttcagttttccccccacgacctgaccgtgtcgctatagtgacgggagggacagatggcattggctattctacagcgaagcatctggcgagacttggcatgcatgttatcataggtgatgacttttacagttacttgtgttttttgttttttcggtttttttttttttctgagacaggatcgcagtccgtcaacccgtgctggactgcagtggtgcaatcttggctcactgcagcctccacctcctgggttaaagtgattctcctacctcagcctcccgagtagctgggtttacagacatgcaccaccacgcctggataatttttgtatttttagtagagacagagtttccatatgctggccaggctggtcttgaactcctgagctcaagccatccgcctgccgtggcctcccaaagtgctaggattacaggtgtgagccactgcgcctggcagagttagttgtgtcttatacctaatgtgagctacttaggtgtcgattcagacatgtatgcaaatgttgatgtgcatatagaaaattcagtcagatccagaaagctcatgaaggtgatattcacaacctagaaaacacagaaaattgttgtacccttttggaagtagatatatattctgcttaaatattgatcctgtgtttctttcacatggtttactggaaaaaaataaccatatatctttatgactttactagggctgttataacaaagtatctcaaggagactggaggttgcttaaaaagccaaaatttatttttcacaattccagaggctggaagttcaatatcacagtgtaagtagggctggttcctcccaattccagaggctggaggttcaatatcacagtgtgagtaaggctggttcctcccgacacctcactccttggcttgtagacaccatcttctccctgtgtcctcacagggtcgtccctctgtgtgttttcatctcctcttctcctgagatgtcttagtccatttcaggcgctataacagaattaccatagaatgggcagcttatatacaacagacattgagtttcccacagtcctggaggctggatgtctgagatccaggtgtgggcagggctggttcctcctgaggcctctctccttggtttctctctgtgtcctcacagggtcatccctctgtgtgtgtccgtgtcctcatatgctctccttataaggacaccagttcaattagatcggggcccactctggtgacctcattttaccttaatcaccactttaaagaccttatttccaaacacagtcacattctgaggccctgggctttaggacttcaatttatgaattttgttcaaacacaagctcctaacagaatctgaacaatgttgcgggatacttgtttcttctgcaaccatgacctatagacactcacggtttgatttctgctcttctttttgaaaatttctctaaaagcttatcgtgatctctgactcctcttcctctgtgacctcttcaggtctcccttcaactgggaatatgaggacagttcaaattaacccattccactactgccaatggagacggagtggggggcggggaggaggggagagagtctattgcatacctggggaagtctaaatcagctagcttaaatgatgtgtggagacgagcttggaaaaataaaagccttaatgtgtattatgcccactcttgacactatctgcatttaattaattattttcagacaggatcctactctgtcagcccagactgcagtgcagtgacataatcatagctcactgcaacctcaaactcctgggctccagcaatcctcctgactcagcctcatgagtcgctgatatgacaggcgtgcaccaccatgccaagctcattttatttatttatttattattgttttttttgagacagaatcttgctctgtcacccaggtggaatgcagtgacacgacctcggctcacggcatcccctgcctcctgggttcaagcgactctcctgcctcagcctccagagtagctgggattacaggcgcccgccaccatgccctgctaatttttgtatttttagtagagatggggttttgctttgttggccaggctggtcttgaactcctgacctcacgtgatctgcccacctccgcctcccaaagcgctgggattacagtcatgaaccaccgtgcctggccctggctcatttaaaaaagttattttggcggctgggcgtggtggcttatgcctgtaatcccagcactttgggaggtcaaggtgggcagatcacttgaggttaagagttcaagaccagcctggccaacatggtgaagccctgactgtcctaaaaacacaaaaattagctgggcttgggggtgagtgcctgcgtggtggtgggcgcctgtagtcccagctactcgggaggctgaggcaggtgaattgcttgaacctgagaggcggaggttgcagtgagctgagatcacgccactgcactccagcctgggtgacagagcgagactcagtctcaaaaaaataaacaaaatgttttggagatactgggtcttgctatgttgcccaggctggtcttgaactcctgggttgaagtgatcctcccaccttggcctcccaaagtgctgggattacaagtgtgagccactaggcctgggcaccctttgcttttaataacttttatggtgtctgcttttataaacatcatactgtaggtctggtttgagatatgcaggatcgtattgacttaacactttccaggacgggagcagtggctcatgcctgtaatcccagcactttaggaagccgaggcgggcagatcacgaggtcaggagatcgagaccatcctggctaacatggtgaaaccccgtctctactaaaaatacaaaaagtagctcggcatggtggcgtatgcctgtaatcccagctgctcgggaggctgaggcgggagcatcgcttgagccagggagccggaggttgcagtgaaccgagatcgcgccactgcactccagcctgggtgacagagtgagactctgtctcaaaaaaagactttccaaaaccaatgcccattattgattgacttcttcctctccgccattctctgtccttctttcccttgttgtcattatggaaagatgatcatggatcataaacaatgcttagggctggagatttcaacatgaatttgtctcagttcttccttatctttgaggagctctgtccaggacagacacttttctgggccttgaatgcctttgcgatagcccaaaaggctcaagcataagagcatgagtctgatctggtgaccagggctcagcaaagagtctttccaggccttgaacctctggacatctgttggtgctcattggacaggctaaaagtcatcatgttacgaatcgatgaagttgacatgcagataaaaggtataaggaaaaaatgaactctccacatcattgtatgcattacatctatacgataaaaactgtgatatactcatgcgtttaaatagctgctctggtcctgggcctcatgcgtttcaatagctgctagcgttctgagcctcgatggccatccacttggctttgagttagctctctccaaaaatctccatggcagtttctgctggggcaaatgcacggctgctgcccacacctctgtgttttctcatcttcatttacaaaagaagaaaatgctaaccttgctgatgctaacctcctgaatttcatgcaggaatccccaggagtctttgactcagatggggaaaccccatgttcagcccatgtggccttctggtctccctggagatgcgtggtccatgtcagcgcacatggctccttgctccgtccttcacttaagtttgagcctttttggcttttgcaaaacatgaatgcaaaacttgaaatttttctatgtcatggctcttcccaactttcacatttttgagacagcgtctcactctgtcacccaggctggagtgcaatggcgtgatctcagcccactacaacctctgcctcctgggctcaagcgatcctcccacctcagcctcccaagtagctgggaccacaggcgtgcaccaccaggcttggataattttttgtagttttagtagagatggggcctcaccatgttgcttggacttgtctcaaacacctgagttcaagcgatctgcctgcctcggcttcccaaagtgctgggattacaggtgtgagccactgtgcccagagtcttttaaaataataattttgtacacgcagttccattcctcatataaccatctttctctgatgcacttcagggtttgtaaaatagtatacagagatgtgtactgtttcacatgatgaagcttagttgtattagataatgataacatcgtgtttggctatgtcataatgaggcaattgagtagaatataatgaaatcttgttggattagttaatgacttgttgagcttcggaagcaggtgagcactttttggtctatatcagtctctttctttccatcaagcagttattttcctcaaagttgtgcctaactcccacttgagcattttttttatccattctttttttttttactttgacatgaagtctcactctgttgcccaggctggagtgcagtggcgcgatctcagctcacttcaacctccgcctcccgggttcaagcgattctgctgcctcagcctcctgagtagctgggactacaggagcacaccaccacacccagctaatttttgtatttttagtagagacggggtttcaccatgttggccaagatggtctcgatctcttgaccttgtgatccacctgcctcagcctcccaaaatgctggtattacaggcgtgagccactgtgcccggccccattctctttattttattttattattttattattattattattattattttttgagatggagtttcgctgttattgcccaggctggagtgcagtggcgcgatctcagctcaccgcaaactctgcctcccgggttgaagcgattctcctgcctcagcctcccaagtagctgggattacaggcgcgtgccagcacaccaagctaattttttgtatttttagtagagggggggtttcaccatgtaggtcaggatggtcttgatctcttgacctcgtaatttgcctgcctcggcctcccaaagtgctgggattacaggcgtgagccactgcgcccggcctcattctcttaatagactgggacaagttaaaactttatgacaatttcttgaaattgtcaagttcatccatgtccctaactctcctgtcttggtgtgtttgggctgctgtagcctgagtgccttgcaaaccatagaaactttttttttaaaattttattattatactttaagttttagggtacatgtgcacaacgtgcaggtttgttacatatgtatacatgtgccatgctggtgtgctgcacctattaactcgtcatttagcattaggtatatctcctaatgctatccctcccccctccccccaccccacaacagtccccggtgtgtgatgttccccttcctgtgtccatgtgttctcattgttcagttcccacctatgagtgagaacatgcggtgtttggttttttgtccttgcgatagtttgctgagaatgatggtttccagcttcatccatgtccctacgaaggacatgaactcatcatttttgatggctgcatagtattctgtggtgtatatgtgccacattttcttaatccagtctatcgttgttggacatttaggttggttccaagtctttgctattgtgaatagtgctgctataaacatacgtgtgcgtgtgtctttatagcagcatgatttataatcctttgggtatatacccagtaatgggatggctgggtcaaatggtatttctagttctagatccctgaggaatcgccacactgacttccacaataaaccatagaaacttattgtcctacagttctcaaggctggaagtcccaagaccagggggtcagtgtggtcagattctggtgtagtctgtcttctaggttgtggatggccactttctcctgtgtcctcacatggtggaacctggatggggtctcttttataagggtactaattccattcattgtgctccaccctcgtgacctaatcatcccgcaaagcctccgcctcccaacagaatcactggggatgttagaatttcaacataggaactttggagggatacaaacattcagtttattgcgccccctctagatgcaaaaggattgggtttagatgaggagaccccaggggagagggtgcccatctgagagtgtatttctagaacttcttatgaacttgagcacctccatgatctgtttacatctccctgggacctgagtaaattagagacaagatgtagggcagggggggttctgagatttagcttggagactgtgaggtggtgatggatggcaacccttggttttgaccatccatgctaggtggatatctgctgtatcattaacaacatgacaaactttccaggactttctatatctcagacttctgccaatatttgagatgactgggtcaaaatgatgctgattttttgaacagggagagcaataggtattctctgaaggttggctggatgtgagcctagtggcttcaatgatggtggagtaggatgaagagagaccctcaaggttgaacaaagatgggagggctcacatccattactggttatatttgatcttttgtctcctccagtgcaatgatctttttcatcttcttaattcttaatttagctaggcaatgtttaattattagtttaattcttaatcaaactaggaaaggaagaaaacaccccatttctttgtgcttttttgcctcattgtggtggtttaggtcatgatgaggtctagttgggcaggtcatgatgaagtctagttgtattaggttctgatgatgtctggttgagttagatcatgctgaggtacagtttggtttggtcatgatgaagtctagttgtattagatcatgataacgtctcctttggttatgtcatgatgaagtagttgagtagaatgtaatgaagtcttgttcgattagatcatgatgactggttgagttaggtcattatgaggtatggtttgattaggtcttaatgaagtctagttcagtaacagcatgatgagatctagttggattagacttgatgatgtgtgacttatttaggtgatgatgaaatcttgttgggctaggtcactttgagatctaattgggtaggtcatgatgaggtcttgttgagttaggtcctgatgaaatgtagttgagttaggtcacattgaggtctagttgggtaggccatgatgaggtctatttgtattaagtcatgatgaggtttggttgtattagatcatggtaaggtacagtttggttaggtcatgatgaagtctagttgtattagttcatcataatgtttagtttggctatgtcatgatgaggtagttgagtagaatgtgatgaaatcttgttggattagattaggatgactggttgagttagatcattatgaggtgtgatttaattaggtcttaatgaagtctacttcagtaatagcatgatgagatctagctggatcagatcatggtgatgtgtggtttggctaggtcatgatgaagtctagttgggttaagactcaatgagttctagttgggtcaggtcacattgacgtctagttgggtaggtcatgatgacgtctaattgggttagatcatgaggagatctagttaggaaggtcatgatgaggcctagtggatagatcatgatgaggtctagttgggttaggtcatgataaggtctagttggattaggtcatgataaggtccagctgggttatgtcatcatgaggtagttgaatagaacacaataaagtcctcttggattagatcatgatgacaggttgagttagatcatgatgatgtgtggtttggttaggtcacagtgaggtctagttgactgaggactttgtaggcacaaagcaatgaagacatgtgagcaagcttcttgttcatgtgcatgggaatctcaagtgttaccacttcatttagatgatgtttactgagcatcaggagcagtatatgtcagcaccaatgtgccttttttcttgagataaacagaaagtaaacaccacatctgcaccccacctgtgtctcctatcccacagagctcctgatgtcagtgtttaattttcactgtgagttacagttttgacccttcaggtcaatccaatcaattatgcagtcttatttcccctgtgtgactttgaggataattggatatattctgagagaggcattttttcattttgtatggcagtttgattcaaagtcaattaatgaaaaaatatcattgaacacaatgaattttatattaaatacaaaataagagatgggaaatttaacttcaaaattttaattaaaaatttattaatatttaaagaataatcaattacttgtaaaataattcagattataacctgggtccaactgaagcacattaatattactagacacatatatcagttgttcaaattcccatctgtccacaagatcttagttctcattgtttcaaaatattattttggtgggggatcattttttttcataatgctcaatggactgtcatctaagatgaaagtggggtgggtaaactttttctgtaaagagacagataataaatgtgttcatatgtttctctcataactatgagctctgccctagtagtgagtaaccacccataggtaatacttaaaacaacaggaaagtctatgttgctgtaaaactttttgtacaatatccagctgcaggccaggtttagccgcagattggtgactctggtttgggctcaaaatctttttatttagtaagaggaaattatactgcttttttccaatataagaaatctcttgtacagtcctcaggaagggtagataatgatgaggtctagttgggttataatgaagtttagttgggttatgatgaagtctacttgggttggtcatgatgagatctagttgtattagatcctgatgagatccagttgggtaaggttctgatgaggtctagttgattggtcatgatgagacttagttaggctataatgaggactagttgtgttggtcaggatgagatcaagttgtattaggtcatgacgagatctagttgggtcaggttgtgatgagatctggttggttggtcatgacgagatctagttaggttatgaggaggtccggttgggttggtcatgaggagaactaattgtattaggtcttgatgagatctagttgggttaggttatgatgaggtctagttgggttggtcatgatgagaactagttgtattaggtcatgatgagatctagttaggttctgatgaggtctagttagattggtcatgaggagatctagttgtattaggttatgatgtgatctaattgggtgaagttattatgaggtctagttgggttggtcatgatgagatctggttgggttaggttatgatgcgatctagttggttggtcatgatgagatctaattaggttatgatgaggtctatttgggttggttgtgatgagatctagtcatattcagtcatgatgaggtctagttgggttagattatgatgaggtttagttgggttaggtcatgatgaggtctagttgggttagggtatgaggagatttaattgagttaggttatgatgaggtctagttgggctggtctttatgagatctagttgtattaggtcatgatgagatctaattgaattatattacgatgatatctagttggttggtcatgatgagatctagttgtattaggtcatgatgtgatgtagttggggtaagttatgatgaggtctcattgagtttgtcatgatgagagctagttgtactagatcatgatgagttatagttgggttaggttatgatgagatctagttggttggtcatgttgagatccagttaggttatgatgaggtccagatgcggtggtcataatgaaatctagttgtattaggtcatgatgagatctagttgtggtaggatatgatgaggtctagtgcattggtcatgatgagatctagttgtattaggttatgatgagatctagttggattaggtcatgatgagatctagttgtggtaggatatgatgaggtctagtgcattggtcatgatgagatctagttgtattaggttatgatgagatctagttggattaagttataatgggatctgtttggttggtcacgatgtgatctagttaggtcgtgatgagttctagttgggtaggtcgtgatgagatctagttgtctcatgtcatgatgaggtctagttgggttaggttatgatgaagtccagtttggttaggtcatgatgaggtctagtgggattggtcattatgagaattagttgtattaggtcataatgaaatctagttggcctaggctatgatgagctctggtaggttgttcatgatgagatctacttgtattgggtcatgatgagacccaggtgtgttaggttatgataagatctagttcgttgtcataatgagatgtaatttgtttatgatgcagtctagttgtgttgctcatgatgggatctagttgtattaggtcatgatgagacctagttgggttaggttatgatgaggtctagttggtttggttatgatgaaatcttgttggattatgtcatgaggagatctagttggatggtcatgatgagatataattaggtcatgataaggtctagttgggttggtcttgatgagatatagttgtattaggtcgtgatgaggtctagtttggttaggttatgatgaagtctagtttggttaggtcatgatgagttctagttgggttagggtatgaggagatttacttggataaggttgtgatgaggtctatttgggttggtcatgatgagattttgttaggtcatgatgaggactagttttgttggccttgatgagatgtagttgtattaggtcataatgaagtcttgttgagttaggttatgatgtagttaagttgggttaagttatgatgaggtatagttgggttggtcatgatgagagttagttaggtcacgatgaggtagttgggttggtcatgatgaaatctagtcatagtcagtcatgattagttcttgttgggcttgtttataatgagatttagctgtgtcaggtcatgatgaggtctagttgagttggtcatgatgtgatctagttgtattaggtcatgatgaggtctagtttggttaggttatgaggtctagtgtcgttggttgtgatgagattcagttaagttatgatgaggtgtatttgggttggtcataaagatacctgtttgtattaggtcatgttgaggtttatttgggctaggttataatgagatttagttgggttaggtcatgatgaggtctagttgggttagggtataatcagatctatttgggttaagttatgatgaggtgtattttggttagtcctaatgagatttagttgggttagagtatgatgaggtgtagttgcgttggtcatcataaaatctagttttgtaggtcacaggaagtctagttggttaggttatctaaattgcaactgtcttttaaaaatgacttgtgccacatatactttgtattgtccatgaatagtacatgtgaaacgtgtaaaatatttaaacttgtatttaattatctatttacttattttaatagacaaaaacaagttacatatttttatggtgtacaaaatgtggttttgatatatgtttccatctggaatggccaattcaagctaattcacatatccattaccttacatgtttctttttgtgtgtgtttttggaaacacttaaaatctactctctttgcaattttcaaatattaattatagtcactgtgactaattatagtcaggttcaagattatagtcactaatttagtcaccttaagtacaatagatctcttgaacttataccttctgtcaaactgacatttggtgtcatttgaacaaaatctcagcaacccacccccctagcacctggtaatcaccataattctttttcttttctttctttcttttttttgagatggagtctcactctgtcaccaggctggagtgcagtggcgcaatctcggctcactgcaacctccacctcctgggttcaagcgattctcctgcctcagcctcctgagtagctgggactacaggtgcatgccaccgtacccggctaatttttgtatttttagtagagacaggcttttgccaggttggccaggatggtctcgatctcttgaccttgtgatccacctgccttggcctcccaaagtgctgggattacaggcatgagataccacgcctggccaataatcatcataatactttttcttgtgagttcaacttctggagactctacatatgggtgagatcatgtgggatttggttttatgtggcttattttacttaacatgatgtactcctggttgatccatgttgtatcacaggatagggtcctctggttttcaaagactgaatggtattccatggtgtagctatcccacattttatttatctacccatccttagatggacacttaggttggtttcatatcttggctcttgtgaatcatgctgcaacgaacatgggggtgtagatatctctataaggggctgatttcatttcctttggatctatacagaggagtgagattgctagatcctatggtaggcataatgatcattttttgaggaactcttaaaaaaaaaaaggccacccctttagacacaccttaaaatccaacctttctggtcaaagacatttgaaaaaaatgacgacaacatcaaactatagtctcctgtccaagcacgttcacttcctaagatgtgaaaaaaaccaggccgggtgcagtggctcatgtctgtcatcccagcactttgggaggcaaaggcaaacgggtcacccgaggtcaggcgttcaagaccagcctggccaacatagtgaaaccccatctccactgttttccataatggctataccaatttccattgcacatataacatgtaacgccctcccctgcccccccaaatacaaaggatgaagcagaaggcagatgcactgtgtttgggacgtgtgcggtgtttctgcatatgcagtacttgctcagcaaatgtaggaaccactccagcaaatgcatatgaggccaaatgtcccacgtccagttccttaaagcagctccctccaggtctgaggagacaattgctgaaggtgacattggccaaagaagataccgcacgtgccacctcaccttctccattcctccagtgtggtgcttctgtcctatgccagcgttgacggtgccaccatggaaaatggcctgcccatgaaggtggtcttcccaaataatcacttcacctggctttttttgatgctcccagctttttctggtcacttttgtctttcttgagaaggtggaggctcccatcttacttcgtcccagcttccggcatgtttccctttgtttttttttgttttgttttgttttgttttctttttgagatggagtctcgctgtgttgcccaggctggagtgcagtggcgcaatctcatctcactgcaacctctgcctactgggttcaagcaattcttctgccttagcctccagagtagctgggattacaggtgcctgctaccatgtctggctaacttttttttttttttttttttttgggacagagttgggctctgtcgcccaggctggagtgcagtggtgtgatctcagttcatggcaacctctgcttcccgggtcctggttcaagcaattctcctgcctccgcttccctagtagctgggattacaggcacacatcaccatgcccatctaatttttgtgtttttagtagagatggggtttcctcatgttggccaggctggtcttgaactcctgacctcgtgatccgcttgcctcggcttcccaaatcccaaagggctgagattacaggcatgagccaccgcacccggccgcaccctttgatcttgagatggctgatacggcagagcagcccagcagtggatgagtgcttacatttaaaaagttcatgggatttcataaataagctcatgaatgtacaagtccccagtgtaaaggttaccttgactttgaatttttttatcctttctttttttgttttgtgtttgatgcataggacatttatagatggaatatacctttcaggctatttcttcctctccctcccgtcgaaacccacctccctgaaatgcctgctgcctcctcagtgccaaaggactgtcaaagcaaaaatgtaataatggtatcatgttctgtttctttaaggaagtcaaaggtgcaaattacctttgcagcttcagtcttctgatgtctgcaactttgaattccttcaaggaagtgacaatttagatattccatttactctgccccaaaggatggactttgcactatttatcttagccgtctcccactggagccaaaaacatttccaacttcataagtttcactgcttctcctcttttatatattttttcactctttgctgaaaacattttcattgttttttgaaaagtgcattctaatagttaatttgggagcccatggccttaacacagaagaaagaataccgaatacaatgataggatatcaaacagcatggtctcttccttgtgttagagtgtgtaaattcaatacgccgtgttgactcagtattcaggaatgccaaagagagggattatttggtaatgtattttcatggagacccggggacggtgctgtactacagaacacctcactggcccgggctgggtgcaggtaggatggagatagaccggccccacccccttggtaactgctccttgcagatcagctgtttgaagctctccgggcacccaagacgttcttgttcaagcctgtgcgcttcccctgctagttctcatctcccttctctcaacactttttccgtgaccctccctgaaagggagttttgggcttggctcaccctggaaagcagctaatcccacatgttgccaacaggttaatgaaggatgaggctgaaggaggaaaaatttgccaaactcctttcccctaaagagccgccccttcagaaacaccttaaaatccaacctcccgggtcaaagacatttgaaaaaatgacgaagacaacatcaaactatagtctcctgttcaacgcatgttcacttcctaagacattaaagaaaccaggccgggtgtggtggctcatacctgtcatcccagcactgtggaggccgaggcgggaggatcacctgagatcaggagttcaagaccagccttgccaacatggtgaaaccccctctctactaaagatacgaaaaaattagctgggcatagtggcagtcacctctaatcccagctactcaggaggctgaggcagcagaatcacttgaatcagagaggtggaggttgcagtgagctgagatcgcaccactgcactccagcctgggcaacagagcaagattctgtctcaaaaaaaaaacaaaacaaaaaaacaaaacaaaaaaacccaattaacattctttcaccccggatttcctagtctttattttagctataacaagcaaaacacctctttccatccttctaaaggcgtgttcctgaaacctcacttggagagttttacggaagtgcagtgagaggagtaagaaatcctgagcacacagccaactaacgcaggaacagaaaaccaaagaccccatgttctccttcataagtgggagttgaacaatgagaacgcatggacacagggaggggaacatcccacaccagggcctgtcgaggggttgagggggcagggcagggagagcattaggagaaatacctaatgtagatgatgggttgatgggtgcagcaaactgccatggcacgtgtatacctatgtaaccaacctgcacattccgcacatgtgccccagaacttaaagtagaattaaaaaaaagaaacagaaagaaatcctgagcacgtagtaggaaccacggtctgtgatcacgtgcatcgtgcagtctgtgtgtgcacactgggatgtttccagcataaaagctccttcgaaaattcgtttccatcctgacattttaatgcacattttttatgcttatgctattctcagctctcacgtgcaaattacaccagcaggtgccccgggtccctgtcactattgaaaagtagaatgtcaaatgcatttgtactttttgccaatgcaggctaaagaaaatgactcttaaatggatagctttagtctgccaaaatggctgtcaagttagacgctaggataaagggaaagtccatcaaaggcacatttcagatttgtgttatacttctcttaaaacctctttttttttttgcagttaatagtttctggataatcctacaagtcaccgtatcttttttttctttttccttttagctggaaataatgacagcaaagccaaacaagttgtaagcaaaataaaagaagaaaccttgaacgacaaaggtaccgagagatactccaatggcttttttttgtttttttttttccttgggacaggtcgtttgcgtggttcatggctgagcttcagtcacgtgccaggtggcatttgggagagatggctctgatttttgcactcttcttttggggatttctggccccatcctagagcaggagatggtcaaggcaaggcgaagatagcatcactcagctctgacatctgctaggaaaggcatgcagatgtgctggtagcttgcactcttactcaaatgtgtgttccccagggaacaggagccattgtcctttcctgttgacctccagggcacatgccaggaggtgcctctgctggttgggagttcttgacttaagataaatcaggccgggcgcagtggctcgcgcctgtaatcccagcactttgggaggctgaggcgggtggatcacgaggtcaggagttggagaccagcctggccaacatggtgaaacccaatctctactaaaaatacaaaaattagccaggcatggtggcatgtgcctgtaatcccaatgacccaggaggctgaggcaggagaatcgcttgaatctgggactgcctgggagagagagcaagactccgtctcaaaaaaaaaaaagaaagaaagaaaaaaagataaatcaaacaggaatatgcttgcccttaagattttcgaccaggtgctagaccaaattctggtgtgctctttctgtctgttcacactaaggaaggtgtgcacacaactttctaatatccatctagattctcaatgctctgtccttttatttatttattattttatttttcatttgtatacaggtagggagtgcaagtacagttttgttaacatggatgaatggcgtagtggtgaggtctgggcttttagtatagctaacacctgaatcacgtacattgtacccgagaggtaatttctcatcccttgctcctcttccacctcccacccttctgagtctccagtctctgttattccactctttccatgtggacacattatttagctcctgcttataagtaagaatgtaggaggtcggtcagggtggtaggaaaaattgtagaagatgcaaaccttcttgggaggccagaaggttttgcaaatgctcccgaataagatttggctgaaggcagccagattctcttatccagtgcctgaaagcttaggttagataacgaggggatgtaaagaaactgatctagataagttagtttgcttaggcctcagaacctggcctttaatcatccacgcacagaactactctctccctctctccgggttgcgggggacgaccatatgaattgcccacgaatgtgttgactcaaggcctttgtcattaaatgtatactaaataaaggcccacagcagcagcttgtcaaagccgtggctgctgactctttaaaacaccctcctcagtgtctgtgagtggccccatcccctagcccacgctttcactggaaatctgtgtctgagtgcatttgttcatccgtcgctcagccaaagtctgcgagtcggacccagcaaattggactcgacctaagaagaatggtatttgactttcggtttctgagttatgtcccttagggtaatggcctccagttccatctgtgttgctgcaggagataggatttcctcctttttcatggctgcatagtattccatcaggtatagatatatattttctttatgctttcgtgtgttgttggacacctaggttgtttccatatcttggctcctgtgaatagtgctgcaatgcacataggaatgcaggcatctctttgatacactgatttcatttgctttgagtctgtgcctagcagtggaattgctgaattatgtggtgcttttatttttaatgatttgaggaacttctgtactgtttttcatagtgactgtactaattgacattcccaccagtggtgtacaagggcccccttttctctacaccctccccaacacttgtaattaactgtagaaatcatcattctggccagcgtggtggctggcacctgtaatcccagcactttgggaggccgaggcgggtggatcacctgaggtcaggagttcgagaccagcctggctaacatggtgaaacctcgagtctactaaaaatacaaaaattagccgagcgtggtggcaggggcctgtaaccccagctactcaggaggctgaggcaggagaattgcttgaacctgggagttggaggttgcagtgagctgagatcacacctttgcactccagcctgggtgacagagcaagactctgtctcaaagaaaaaaaaaaacaaaaaacaaaaaaacacaaacaaaaacacccttctgacaatatccattttagctggtgtgagatagtagctcatggtggttttcatttgcatttccctgatgattagtgatgttgagtaccttttctttgtttatttttttgtttctttttgagacggagtctcactctgtcacctaggctggaatgcagtggtgcgatctcggctcactgcaacctccggctcccaggttcaagcgattcttctgcctcagcctcctgagtagctgagattacaggcattggcgaccatgcccagctaatttttgtatttttaatagagacggggtttcgccatgttggccaggctggtctcgaactcctgacctcgtgatccgttcgcctcagcctcccaaagtgttgggattacaggcgtgagccactgcacccggccgactaccttttcctataagcaccttttcatatacctgttggccatccaaatgctaagtgcttttctcggccatgtttatgtgtggtaccttattttttttttttttttaaatgcacatcccttccttggctgtttgaatttgagatggtgttttgagaattcccccaagtgggggatgggtgtattttgattctttatttgtttgtttgttttttgatacagggtctcactctgttgcccaggctggagtacagtggtgttatctcggctcactgcaacctccgcctcccaggcccaagtgtttctcctgcctcagcctccccagtagctgggaatacaggtgtgcagcaccacacccagctactctttgtagagttggggttttgccttgttgcccaggttcatcttgaactactgggttcaagcggtccattcacctcggcctcccaaagtgctgggattataggtgtgagccactgtgcctggcctattttgatgatgatgacgattattattaatattttgagacagagtctcactctatcacccaggctggagtgcagcaatgtgatctcggctcactgcaacctctgtggcccgggttcaagcgattctcctgcctcagcctcccgagtagctgggattacaggcgcccacccaccaagcccggctaatttttgtatttttagtagagacggggtttcaccatcttggccaggctggtcttgaactcctgacctcatgatccacccgcctcagcctcccaaagtgctgagatgaccggtgtgagccaccgcgcccggccttgattctttttaaagccatgagagtgaaatgaacgctacacagagctgagcctggtcactgcctatgcccctatctcctcctttctaccctaagctgctgtgaaacaccttgttattacctctgccaagggctggggtatgttgaaatttcatagccggcattgcaggatccctgtgattttcaggaacacactcccacaggggctcccgctcagccagagccaagcccagtgtacaatgtcacagagtggcagcagcctggccagatcttttctcctcattaggatctgccttggggcaaaaggattggtttctgtgtagagggataattaaggaattagagacaccgaggggttgaggaggaattatttaattatttatttgtaccgaccccgtcggattaacatttaaaggaccgagttttgaacaaagagtttggttattttttaagtattttctggggcggggggagctctgtgtagggggaagtatatcatagaagtgagaaacaaagacagttgtttaattgacacatgcattatattattttttattttttaaggaataatatgttttatgatttgagattatttgcctagtgactttgtagctgtatagctagagaagcagagtttttataatgcttgggaaaggaagagacaaggcttattagccgcagaaaaacaggcagttaatttttaatggacttcaactctttctcttcctcagggagaactgggttttcttacatacaactgagtttttgcttatacatttttaaattttttaaaattcctgtttcatctgtgacagggggtcctattccctgccaccttggcccttcctcatttgcagcaggttttcaaaggagtggcattttctaacacaatgaatccaaaagtgccttctccgggcctgtcacatcagcatttccggggagtaaacaagaaatgcaggtgcccagggcccatctgtgaatcggggcctctgggggtgggggcggggccctggaatctgcattcttatgaggccgttaaatgatccccacgcaccttcaaatggtacacttgctgctgtcctgaaggcattcaaccatcaatctggagcccaaagagaagtttctggaaactgacaagtgaggcattcttttctcatgactttttgcttttaatctgaacggcttaaaaactatatatagttccccaaaattcacatatgtgatccacctaaccaaaatgacagccaagaaacaatgatttataatcaccaacttaattttattagattctgaaaatgtttcagatttagacaacatgaattttgaccaataattttttttttttttttttgagacagagtttcactcttgttgcccacgttagaatgcagtggtgtgatctcggctcactgcaacctccgcctcccgggttcaagcgattctcctgcctcagcctcccgagtaactgggatcacagacacccaccaccaggcccggctaattttttgtatttttagtagagatggggtttcaccgtgttagccaggcttgtctcaaactcttgacctcagatatccacccacctcagcctcccaaattgctgggattacaggcgtgagccactgcatctgaccacaataacaaatcattgctgttttcttggaaaagtttgtgtaggatattcgatcatcagtttttaaagtgcagtgttttgtggacaagtagcatgacgaatacatgatttgtccccaccattaaaaaatgttagtttacttgtggcatataaataccgatggcctttaagccaatcttacagaaaagaagaaaagaatcgtttgcactttctgtggctgtttaaaagctttaccatcttgtaagagggtgggaagatggggtgtgccgtggagatggttaatgggcacaaaaatatactttagatagaatgagtaaggtctcgtatttgatagcacaaaagggtgactacagtcaacaatccttcatggtccatttaaaaataactaaaagttgctggacatggtggctcacccctgaatcccagcactttggaaagccgaggcaggtggatgacttgaggtcaggagttcgagaccagcctggccaacatggtgaaaccccgtctctactaaaaacacaaaaattagccgggcgtggtggtgcacacctgtagtcccagctacttgggaggctgaagcaggagaattgcttgaatctgggaggcggaggttgctgtgagctgagattgtgccaccgcactccaacctggactacagagactccatctcaaaaaaaaaaaaaaaaaaaaagaaaccaattaaaggtgtaattggaatgttagtgacacaaacaagtgatgaatgctcgaggggatggataccctatttgccctgatgtgagtattacacattgcatgcctgtatcaaaatacctcattatcccataaatatatacacctactatgtgtgcatgcaatttttttttttaaaagaaaaaagtttaaaatctgaacaggtttggacattcatcagtggtggccctggtatgtccactgctgggggactctccagtccttgatagatgatgctgaggcccagctgggtggggacatttcggctgtggccattgagcctttacctcgactgagtctgcctccaggctcaggagcccccagatccgtggtccagccacacggcagggtctgccctctgcctgtgagtggtatctgctgcccacaacatcttatggacgaccacagctcctacaggcatcccttccctcctcagctgagacctgggcacacctccaccaaacccgtacgaaccttgctctaaattgtgcttctctctggactggcctgcacctgctggaactctgattcttgtccccacaacctccagttgcccagcgagggacagagggagctgaatgtgctgtttcgttcttgctctgctgggatcccggcatcgggtaaccccggttcagccatgtggatttatttttaagcaagtcggctcacgtcctgactccaggagcacagattgctgtggagtgtcagtcacacaattatttcaacatgctgggcgcctgtctagcctgctttcccctcctgcctttcctgctctcaattctctctccttagttcttgggttaatactctggcctgcgtactttgttgtactttctgtctttgaagtcgtgctcctctgagatcccacgctgggcagggcatgggaagctacgtgcccacagaaggacggctaattgagctctcggaattataaatgcgcgattgttttcaggaatctgggcgagatggctcatttcccaagctagggattttccagggaagcgttttcactccttatcatcacttagccattgtgcccacacctttgtggctcctgggtaattatgtgctgatgaaagctgtcttacttagaacaaatagtctcattcacttaccgaaactcctccaaatataaataaatcaaaccccagcggctccatgaaagcaaacacagaaaggcatagccgtgttcaaatgaactcagatggggagagataaccagttaaacactcttaaaagcactgaaggcaggcccattctcttttgcagctcgtacatgccatggtggaacccctgtaatcctaaatcctaagagagatcagactagacacgtgctgtgtatcctctttggaaggtgcacggtgtcctcattttctataatgattgtgtaactttaatcacaaacagcatcttctgattcatttagcttcctggctaggcacgatggctcacgcctgtcatcccagctctttgggaggcctaggcgggcagatagcttgaggtcaggagtttgaaaccagcctggccaacacggtgaaaccccatctctactaaaaatataaatgttagtcaggtatggtggcgggtgcctgtaattccagctactcaggaggctgaggcaggagaatggcttggacccgggaggcggaggtttgcggtgagccgagatcatgccactgcactccggcctgggcgacagagaaaaacttcatctaaaaaaaaaaaaaaaaaaaagcttcccaaatattattcttccagtagcttgtgccgtcttcatcagaagagggactagctgtttggttcatgtgcttccacccagttattagaccaagtttgttttcaataaaagaaatcactggtcaatgccttctgtaattgatgggtgtcaagaaggtaaattttgcacgccgccttgggaggcacttctactttgaaaatagatctttgtgaaccatcattttggcctatccaatgacctataaaatacttgaatttatcatgaaaacagaatactgtgaaatcaggatgaaggttgataacaggtcatcaacgtaattgagtagattgaaaatacaagagtcagtgaagtgtaggatgaatgcttgttgtcagtaagagagctctttgtgacccgttccacgtgcaagagatgagggttgttgttttgggaatactcaccctcctcatcgcctgtccctgctaaaatcagagctttgtgagggcagagatggattctgtgcacaggtatcttctgagtctctgattcagtgcctgaaacacagtggctcccgagacaatctacctcagtgcctgttttacaggctcacctgtgacacatgactgggacatatgttattcatgatgacatgcaagagtctctgtgtaggtgtctactggtcttcatcatcaaacagagcgagaactccaagtcaggaggcagacatatcttggggcaagaagacacctagaatttttcttcaacctgtagactttcggattgggtagaaggattgttaaggaggttgcgaaacttggaaaaaggatgatgtgagtgttgatggcatggaattctccccacacccctgggtatccatttttaatgtacagaattcttgtgacatgattttagggcatagaatccttgagagatcatgtctgtgctgaagttggaatcacagcactttatgtgaatgtgttcgccaacgattaattatgtttattcccgagaagttttaaccagattgtggatgtgtattctggttcagcatatattcacaattacctttgttttttgttttgttgttttggagacaaggtcttgctctgtcacccaggttggagtgcagtggtgtgatcatagctcactgcagcctcaaactcctcagtaggaaacttcctaccccagcctcccgagtagctgggactagtagcatgcaccactacacatggctaattttgttttttaaattttttctagagacggggtctcattatgtcgcccaggctggtctcaaactcctggcctcaggcgatcctcccaccttccaaagtgctgggattacaggtgtaagacaccaagctcagcccctgtgtttttttgtttttttttttttttttgctttttgtttgtttgttttgagacggagtcttgctctgttgcccaggctggagtgcagtggtgcgatcttggctcactgcaacctctgactccctggttcaagccattctcctgcctcagcctcccaagatgctgggattacaggcgtgcaccatcacacccagctaattttttgtatttttagtagagacagggattcaccgtgttagccaggatggtcttgatctcctgactttgtgatctgcctgccttggcctcccgaagtgctgggattacaggcgtgagctatcacgcctggcctgtgttttttttttttttaaacataaaatggcccttattgactgttttccttttcatagtgagtccttttgtttctttcatgttttcgagaagtgtcccgagtcaggctgtagacaggcatatgcgtagataaacagatagactcatgcgttcctgttggtaatttttccttgaggtcaccgtatgtgttctcatgcgtgggcatagatgtcccacactctctgaaagtttaattggtcctcgcaggtctcattgtgttccttctcttcagggctcttcatatctcagggtggtaataaccttccaaatctctatggccgaggcgggcagatcacgagatcaggagatcgagaccatcctggctaacacagtgaaaccccgtctctactaaaagtacaaaaaaaattagctgggcttggtggcgggtgcctgtagtcccagctactcgggaggctgaggtgggagaatggcgtgaacccgggagggggagcttgcagtgagccgagatcgcgccactgcactccagcctgggcgacagagcgagacaccgtctccaaataaataaacaaataaatagaaatacaaaaattagccaggcatggtggcgcatgcctgtaatcccagctactcaggaggctgatgcaggagaattgcttgaacctgggaggcggagttttcagtgagccgagatcgcaccactgcacttcagcctaggtgacacagcgagagtccatctcaaaaaaaaaaaaaaaaaggaatatgcatttaacgtttctttgcgtcttttcgtggctcgatagagcccagtatatattttcactaaagagcaaaagcgcctttccatgggcctttaaatacttaagaataagcacatccacacatgggcctcccagatagtcggtgcgtttccagaaatgacggtgtgttgtggttcacagcctctttgggttttggtctccaactcccagcctcaggcgatcctcctacctgagcctcccaaagtgctgggatgacaggcacagtgagccaccatacccagctattttttgaaaactcatagtctcatatttccctaatatttagggttagggctagagttaggtagaggttagaggtgctctgacgagtgtttcccaagtcttggagcccacctctggccaaatcaccgcctgcagttggaagcaaggctgtttctgagatgagtcatactgacatattttgctattgaatgcacggttgccctgatccattcagagatacttctgcagcaccatgagctccttaatccctgcccctgttcacctacaagggtctgcaagcgagcccccttccgcaactcatctctttgtgtaatccttctccagaccctgaatatatcagcctgttggcatatgtatctatgtgtgtgagatcagcctgttggcatatgtatctatgtgtgtgagatcagcctgttggcatatgtatctatgtgtgtgtgtgtgtgtgtgtgtgcgcgctctgaggatattggcactttttaatcttcttccattagacgacaaggctgagggcttccacttgccgccgacttgccggcacacctggggcatgtttaataagtaattgtgtatggtctgctttgcaaatgcgctacttcacatttttccatcccgcccgtaacgaggactggggttgttttacaagttaattacccaaaagattatcgagtgggtttagaggcacaaattctacgcgctatttaacagataagaattaatgagtgttgttaaaatgggaaaaaaaaaatgtctctgtcagtggagggagttatctctaccctgcctggctgtgttactgttgtttttttttttgtctgtgaatgagaaccgaggtagagaaacaaggcgagtgttctcattgctcttctcccaccagagcacaggcggcacgtgtgaaaataactattcacagtttctttcccaccgtgtctcaagaggggtgaatgccagggtcgggcccggtggctcacgcttggaattccagcactttgggaggctgaggcaagaagattgcttgaggccaggagttcgacagcagtcagggtggcgtagagagactccgtctctacaaaatattaacaaatcagtctggcttggtggggtgcactgtggtcccagctactcgggaggcagaggcaggaggatcgcttgagcccaggacttcaagaccagcctgggcaacatggcaagaccttgtctctacaactaaataaaaaaattagtcaggcgtggtgtgcgtgcctggagtctcagctactcaggaggctgaggcaggaggatcgtttgagcctggaggtcaaggctgtggtgagccatgatcgcgaccctgtactttagcttgggcgacagagcaagacccttttctctaaataaaaatggaataatagtaaaaagaagctgaatttcagctgttttcagccattctctttattccttcaaatgcctctgtattctgcagtatcctttaaaatattaagagcaattttagctaatcaggaggctgagacaggagaatcgcttgaacccaggaggcggaggttgtggtgagccgagatcgtggtattgcgctccggcctgggcaacaagagtgaaactccatctcaaaaaaaaaaaaaaaagggagacacagataaggccatgtggagacagagactggagtgatgcggccatcaacttagggataccaggagctggaagaggcaggaaggatgccccctagagtcttcagaaagtatcagacacctttgggaggccaaggcgggtggattgcttgaggccaggagttcgagaccagcctggccaacatggtgaaacctcatctctactaaaaatacaaaaattagccaggcgtggtggcgggagcctgtcatcccagctcctcgggaggctgaggctggagaatggcttgaacccgggaggctgaggttgcagtgagctgagatattgccaatgcactccagcctgggagacagagcatgattctgtctcaaaaaaaaaaaaaaaaaaaagaaaaagaaagaaagcatcaaacacaattgcaaggggttgaatgctgatctccaaaagatatgtccatgtcctaatccccagaacctgtgaacaggaacttatttggaaatagggtctttgcagatgtaattagttaaggatctcaagatgagatcattctggattagggtgagtcttaaatccaatgatagctgtccttgtaggagacaggagaggagacacagacacagaggagaaggccttgtggagacagaggcagagactggagcgatgcggccacaaacccagggactcctggagcccccaggaactaggagaggcagggaggccccttcctgagagcccccggagggagcatggtcctgagacacctgatctcagacttttggtctccagagccagtagaggatgaattcctgttgaattaagttccccaggtgtggtcatttgtcacagcagcctcgggagacgagtagagacatagatcgggcaggaatagaatatctagttgcattgctgatagaggcatactacagctgtgtgacatggtgtgacatcagcacactgtgtcctgaccccaggtcatgggacaagaacttggggagacatagtcacccccctggctcatcagggaaatgcatggcttccggtaaggtgaccctgaacatgcgtgtgtcactctgaagtgttggcctcagactctgcctccaaattccaagtcccctgggggttccgctggaggtggacacgcccccatccatgccttccttgcagtcacgggaacatcccttactcagtcctctctggtcaccgatggggcatgacaggaggcgctacatgtttccaagcagccggggttccagatgcttggaaattctgcgtgcggcctctctatgggaaaaagggaggtctgccaggagtggaaccccagtgagaaagtaaactcaaaacagaaatgaaaggtttctagacacagtacaagccccctttgtggtgcgcgcagggacttacgtagctcggcccctccaccccctggctggccccagtggccgaggtgtgttgggtgctgatctgtgacaccctcctgcttcacacgggcagggaggggttctggagagagtgcaggtgggctggagagctgagctccctgcagcaggtgagtgtgagtcctgaacagactcgttccaaggaaacaggtgcaggaaagaacacaggtcttggaggaatcagggttgagccagccctgtgacctcgggctgtccttggccccagtgatggcttatctttacctggaacttcaacctcttatcatcacctataacgctgaccactgatcctcacctgggactcgaacctctccccatcacctgtaactcggaccacttgtcctcacctaggactccaacctccctccatcacctgtaatgctgaccactcattgtcacctggaagtccaacctctcatcactacctggaactccaactccaactcttttttttttttttcatgagacggagtctcactgtgttgcccaggctggagtgcagtggcacaatctcggctcacggcaacttccgcctcccaggttcacgccattctcccgcctcagcctactgagtagctgggactacaggcacgtgccaccacgcccatctaatttatgtatttttagtagagatggggtttcaccatgttggccaggacggtctcgatctcttgaccttgtgatctgcccgcctcagcctcccaaagtgctgggattacaggcgtgagccactgtgcccggccccaactccaactcttatcctcatctgtagctctaacctgttatcctcacgtgtaaatgtgatgtcatcctcacctgtagctgtaatctcatcttcacctggcattctgacctcttaccctcacctgtagctctaaccggctatcctcaccgatagctctgacatcatatcacctgtagctgtaacctcgtcctcacctggaactctgacctggctgacgtgcttgcagcatgtgggtggggccgatttccctcctgccccagctccctgctgctgccaagtccaggtctctcctgtggggcaggtatacccctccctgggtctcagctgggcccactggccttcacagggagcctgctgtctgcactcccattcttgtcctgccctctcctccggcgccctgtctgctcagatgtcctcatggcctaggcacctgcagccgccaggacagtgagcccggacacaagcagccttccatccggttccccctgcatctgccaacccatcttgcccacagccaagcttctgtgaaaaatcatagcagtcatgaaactcatgagtgctcgggcaaatcagaaaaattgccagggatcctaccatggacacgcgtccctgaaccccgaatggtccctgtgtgttgtgtgtgcgcaggagacgggcaggtcactgtgtgtcgtgtgtgcaggagacagggaggtccctgggtgttgtgtgcccaggagatggggaggtccctgtgtgtcgtgtgtgcaggagacggggaggtccctgtgtgtcgtgtgtgcaggagacagggaggtccctgggtgttgtgtgcccaggagatggggaggtccctgtgtgtcgtgtgtgcaggagacggggaggtccctgtgtgtcgtgtgtgcgcaggagacagggaggtccctgtgtgtcgtgtgtgcggaggagacggggaggtccctgtgtgtcgtgtgtgcaggagacggggaggtccctgtgtgtcgtgtgtgcagaggagatggggaggtccctgggtgtcctgtgtgcgccggagacagggaggtccctgtgtgtcgtgtgtgcggaggagacggggaggtccctgtgtgtcatgtgtgtgcaggagatggggaggtccctgtgtgtcatgtgtgtgcacaggagatggggaggtccctgtgtgtcatgtgtgcgcaggagatggggaggtcgctgtgtcttgtgtgtgcacaggagatgggaggcgtcaacacacatttcatgctcacatttccattcactgtccacactgcacacttgtacatggtcaatgtctagacatttatagtttgtttatgtgttatattcatctactttatatatattcatattttaggttcatatatttattgtatacacatttatatatttgatctatattaatattttaggtttatatacttactatatatttattattataaagcatatacattaaattataatgtattattatatatgatgtattatgttcaatgtatatattaaatacataatgacataatatgaatttatattataatgtatatacatatgaattcacattcatatgtatgttacattttgtaatgtatatatattttgtaacatatatttgtaatataaaattatatacaagatatactttgatatattttatttatatatttatatataaaacataatataatatgcacaatacattttgtgtatatataaaatatatattacataaatatataatgataactataaattatatttgtgtcattataaataatttatattaaatatttatgctattctataaatagtatatatatttagtatatatttttatatcatactttataataaacacgaatttataatatataagtataaactatagttattggatgtttaattttatgtatatattattttatatatatcatactatgtaacacataatatataataaatataatatataataagcatatatcataatatataatataaataaacattgtaacatataatatataatacatatatatcagtatacaaaatataaaattaatatatacataaaattatatacctacttattttattttattttttaagagacgtgagtcttgctgtgttgcccgggctggctttgcctctggaactcaagcgatcctcccacctcagcctctcgaggagctgggactacaggcgtgcaccatcatttcctcctaaaattgtatgtgctgcatatataaaatgataaatgctttacatatactttatgaaattatatatgctttagataaaagcagaggtttcataaaactgaactgtaacatgcatggcatttaaatcccattgaagtgaagggctgggcttgagggtagcgtcaccctccctgaccgtcatacccatttccatttccccaggaaggaccaggatgctttgtttaagcagcacgtttgaattgctggcattgcctgtggcctccctgtggcgagggatggtgaacgacagcgttttccctcctccttcctcaccttgcaaacctcacttcgttggatgcataattgctgactcatccccatggatcgccttggactgtgtagcaatcactgctcttttcacagtccctcttgaatttctttcctttttttttcttttagtcggaatttcgctctgtcacccaggctggagtgcagtggtgcaatcttggcccactgcaaccttcacctcctggattcaagcaattctcctgcctcagtctccccagtagctgggattacaggtgtgtcccaccacacccagctaatttttgtatttttagtagagatgggaatttcaccatgttggtcaggctggtctcgaactcctgacctcaggtgatctgcccacctcggcctcccaaagtgctgggattacaggagtcctcttgaatttcacttaagatgggctgggtgcttcgtggcaggcttttcacatcagcctttgcatttctgggtgtgacccctgtgtctgctgccttctatattcctctcttacttggcaggattccacccctaggtgggtttattttttcccccagtcccctgcctgcctgagaattcctacctatggctcctcctgggaaagggctcttggctgcgtcttaaatcttgggttatgccttggtgcatactggtgttgcaccagtggtgcaacgttgccggcatcccttttgcctgagggcaggtcacttgtattctgtcttgaaggaacctgacttttaaggagggacgacctggagagtttctttattattgaacttcactgactccctgaggatagactgatcctgccaaattcttgggtccccaataaaacagcattccatgaaataaaaagtaagaacagatggcaccaggaattccactgctgggtatatacctcaaagaattggaaacagggtctccaacagatatttgcacaaaccacgtttgcagcagcagtattacttacaataacccgaaggtggagagaaactgtgtccttccagaagcaaatggataagcagaatgtggtatatccaaacggtggaatattacgcagccataaaaaaggaagggtattcagatgcatgctgcgatgtgggctaaccttgaggacattaatgctaagtgaaataatccaatcctaaaaggtggagagaaactgtgtccctccacaggcagatggataagcaaaatgtggtgtatccaaatgatggaatattacacagccataaaaaaggaaggatattcagatgcatgctgcaatgtgggctaaccttgaggacattaatgctaagtgaaataaaccaatccccaaaggacaaatactgtaggattccactcctatgaggtacacagagtacctttaaatttttagagacagaaagtagaatggggtagttataggggttgggcgaggaaaaggtggggacttaatgtttaatgggaacagagtttccatttggcaagatgaaaatattttggagatgcatggcagtgatggctacataacaatatgaatgtatttaataccactttactgtgtacgtaaaaatggttaaaatgctaaactttatgtgatgtgtatttttccacaattcaaaattataaaaaaaaaaaatgcagctgggcatggtgactcatgcccgtaatcccagcactttgggaggccgaggcgggtggatcacctgaggtcaggagtttgagacgagcctgaccaacatggagaaacctcctactaaaaatacaaaattagccgagtgtggtggtgggcgcctataatcccagctatttgggaggctgagcaggagaatcgcttgaatccgggaggcagaggttgtggtgagctgagatcgcgctattacactccaggatgggcaacaagagcaaagctccattaaaaaaaaaaaaaaaaaaggttaaaatgctaaactttatgttatgtgtatttttccacaattaaaaattattttaaaaatgaggccgggcacggtggttcatgcctgtaatcccagcaatttgggaggctgaggcgggtggatcacttgaggtcgggagttcgagaccaccgtggccgacatggcgaaaccccttctctactaaaaatacaaaaactagcctggcatggtggctcaagcctgtaatcccagctcctcgggaggctgaggcagcagaatcacttgatccccggaggcggaggtcgcagtgagccgagctcatgccactgcactccagcctgggtgacacggcaagaatccatctaaaacaataaaaaaaaaataaaataagtaattgcccttaaattggaaatgctcaacaacccacgtgattctgaatctgaaaaggccagatcagggagatacagagaagaataaataaaacacaaggcaagagaagatttatctctggagcatccttgtgcagctgttggtgagtgactcgtgtgtgtcaattgatcatacactcatgagtggataaaagtacccatgttttaggtcaagaaagactgtgacacacgtgtccagcacgccaagcacacagcccgtggggtgtcatccatgtgctgtgccctccctgtctccctctcccaagctcctgcatggaaacagaggtggacacgaaacctacctacccaccccctcccaggttaccgccatcactttcatcacaaaacagagtctggattcagggattcagcccagggcaggagctcaggtcatcttcctctttcagaagggagatttctgctgcctctggcccagcctttccctctctttccccccatgagctgccattggagcacccacctgggtgcaggtgagagagaggaggaaggagaccaggtgaccccttcctggctggttaccctatgtcccggtaacagacggttagagctgattctcatggcagaagcgtgactgccagagaccacctgcggcgcttctaatgctctggtccgtgtattcgtcttgtagcgttgccgagtgttacagagatccacagaccaggtggtttaaacaaaagatacttattctctcacagctgtagaggctacatgtctgaggtcaccgtgtcggtaggcttgctttctctctggcttgtagacgccgtcttctccctgtgtcctcacagagtccttcctctgtgtgtgtctgtgtcctcatctcttcttatgaaatgtcttagtctatttcaggctgctgtcacagaataccataggctggatgacttacaaacaagacatttattctcccacagtcctggaggctggatgtctgagatcagggtatgggcaaggctgattcctcctgaggtctctctcctggacttggagatgctgtcttctccctgtgtcctcacagagtccttcctctgtctgtgtctgtgtcctcatctcctcttcttatgagatatcttagtccatttcaggctgctatcacagaataccataggctgggtggcttagaaacaatagacattgattctcccacagtactggaggctggacatctgagatcagggtatgggcagggctggttcctcctgaggtctctctgctggacttggagtcaccgtcttctccctgtgtcctcacagggttgtccctctgtgtgtgtctgtgtcctcatctcctcttcttataaggagccagtcccattggatcagcctccccccaaccccctgaaacctcattttaccttaattgcctctttaaagaccccatatccaaatatgatcacattctgaagtcctaggggtgaggatctcaatgtatgaatttgagggggacaaaattcagcccatgacaaccagtgtttctttccaaggggctacctgaaaacgtttctgcaacccccagcaagctggcatcgtctcagcatcttgccatggggttccctccatgcctcccaatggctcctttgagtaagaccaaggacaaacccataccactcccttctcctgttttctctgccctcattgtcccctcaagccctgaggctgatcagtccccacaggaccacagctaccctgtagctatgagcagtggcttcctcaggagtgagccaggctcctgtaccccatgcctccctggcacagaacaagatttaggttctgggggtacctgagggaatcccgttttttttttttttttttttgcaggggagggtggaggctcagagtagggaatttttttttttttccgcctgctgtgaggaaattcacccctgttatctgatccatgcacactctggagctggctgaggtcctaactatttcctctgtaaacttctgcccttggaatgggttctgcgatgattaatacttagagtaaacttgattggattgaaggatgcaaagtattgatcctgggtgtgtctgtgagggtgttgccaaaggacattaacatttgagtccgtgggctgggaaaggcagacccacccttaatcatctgggtggccaccatgtcatcagcaggccagcgaggctagactataagcaggcagaaaaacatgaaaagactagactggtctagcctcccagcctgcatctttctctgtgctggatacttcctgccctggaaaactggactccaagttcttcagctttgggacttgggctggcttccttgcccctcagcctgcagacagtctattgtgggaccttgtgatcgtgtgagttaataccgaataaatgcccctttctatatatctatcctgttagttctgtccctctagagaaccctgaccaatacagggtccgttccttaccccctacatctataaccctgctgcctcagttgatagggaagcagaaagagccgcttttttaatgtttaattttattaagtttgcagtttcccagtgcccaaactcatgttgatttcaaaaactgtccttttaaagcatgtgggcagggtgacaattcatagcaggtgacaaaaatgttttataaataatatccatggaaatggaagctgtcactgtctgcagaatgcagccaaaatattcagaagatttgtatcactctaagttctcgtgctagtaagaaataaaaaagcaaatgatgactgggcctctaagaaataaagtaaaattaggaagcaggagtatgaaaataatgacattgtgcagaaataaatacaaaaggaaagtagcagagaagcaaaaaaaaaaaaaaacaaaaccatcaatagtagtttccttaagaaaaatgaaagaataatatcccaccatttattcatccttcattccacacacaaaagaagcaaggacagattagcatgaattggaacaagaaagaggaaataacatgtaataaaaatatgatttaaacttatgcaaaaaaagtaatttattcttaactcaactaacatatttgattacctcctcctgggcaaaggatgaaaggctgtcttattgcaaaaaattagaattttgctaaattcatgcaaatggaattacagatcacagataaaacaacatgctgaaatttcaaccgtcagaactttccaccaagtgttcctaatgaattcttgaatatctggttgggtgcagtggctcacgcctgtaatcccagcactttgggaggctgagttgggcgggtcacctgaggtccagagttcgagaccagcctggccaacatggtaaaaccctgtctctactaaaaatacaaaaattagctgggtgtggtggcacaggcctgtaatcccagctacttgggaggctgaggcaggagaattgcttgaacctgggaggtggaggttgtagtgagctgaaatcatgccactgcactctagcctggtgacagagcaagactccgtctctctgtctctctctttctttctctctctctctcacacacaaaataaataaataaataaataaataaataaataaataaataattgattatctatatactttttccaaaccatcaaggacaatctagatcaagaatctggaaactgttgaccctggaacatatctgacccttaacttgtttttctcattaaagttttcttgaaacacagccatatacattcatttacttattgcctgtgactgtttttgccttaggtacacaggtttgaagagttgcaacagagaccttatggcccacaaatcctaaggtgtgtagtatttggccatttatccaaaaatctactggctgtactcttcaaagtgaccagagccaccaacctgtgtctgagtaaaccgttttactcccaaatgaacacttttcaaagaagcatcatcggctggttctacttaccaacctaaataaagaaaatctagtttaatcttatccactgaatagacttccaggttaaaaaaaaaattactcctgacttagttgcaactcatccacctgtagaccaaaggatgcttctcattaggtaacagggaagcatttgggataattcaacatccattaattagtaaacctctgaaggaattaatctcataacagcagccggaatgcaggagatgctctacacccgaatcacaaattgaatggatggcaagtggattttccctcctaaggctgattgattggttctggctgccagcaccctgagataagaatgatcctgcagcaaggaatagtcatcaattagtgatgcctgctgtggctatggaatgagaattacggtctgtgtgctacattctttccattcttggtggttctctcataaaccacaataaagcatgcatcttttaaagcaaccatgaccatcactagccaccaccatagccctctggctgattcatggatgaatttccaaattcaaatgtgaatttccagtgtcacatttgtgttcctttccctaaatgatgatgatggtgatgatggtgatggtaatgatggtacttgttggatgtgtgtatgtatgtatacacacacacacatatatatacacatacacacacacacacacacacacacacatatatatttgagatggagtctcactctgtcgccaggctggagtgcagtggcacaatcttggctcactacaacctccgccttccaggctcaagcgattctcctgcctcagcctcccgagcagctgggactacaggtgcgcagcaaatgtatatatatatatttttttttctttttttttttaaatttatttattttttattattatactttaagttttagggtacatgtgcacattgtgcaggttagttacatacgtatacatgtgccatgccggtgtgctgcacccaccaactggtcatccagcattaggtatatctcccaatgccatcccccccctccccccaccccacaacagtccgcagagtgtgatgttccccttcctgtgtccacgtgatcccattgttcaattttaaatacaaccaaataagcttgcttcttgcctgtgtggaatttatagtccagctggagtgaggaattaaataatcatccacttatctgagtgagcaaaattatgataaacactcttaaaaagtgtcctttaacagctgtcttgaaagattcaattccatcctctcatgaggttccaccctctgggtttgctttctccaagacctaccctcctgtgtggcttctttcttgactgtttcttttatgctgcctttcctcagcgtttcctcgtagcatctcacactacacacctttccttaggtcttgcaaccacgtccgtgttctccaaaactctgctctgctagttctcaccaatatatttgtttccaaactcctgcctcctacacctccctgcttccacagcaagtgcaggaatgtatttgacattttccttctctctgtgtaagtcagtggactaccatcctctcagctgcctacagtcgatcctagagtgtctgagatgcttttctccaccttggcattcctctccctggtggcaactgagagctctgtagaccacctacatgcttatcaaaaacactccgtcattttcggtatcactccctacagcaggtcacacctatcccttacctgcttcataactctgcttcctggctagtctctcggcttccaggtttccctccctgaactgtctacactgcagtcagagagatcctgctgagtcacactgttgtcttaacctgcttaaacccatatgggcagaatgcccttcatgcctccacctgtttgctgtagctgtgcacatgtggttcctggttcttgagaattcttcccctcctctgcctcctgaccatccaagtccctttcatgctagtcttctcagcttttatagcatgctgtaaagcagttgtcctgaagccaggtgccttacaactccctgctcccttgggacacttaatcccttctatcgccaacctcacacattgtatcgttggttgtttaattgtgtcactgatttccccagccccatgatggtccatggaacatcactgggatataaaaagtactggccaaaggaataaaatacaggaaaatattttgtgcattgtgggatctcatgaatgacagctgccacaatgatgatgttgatgataatggtgattctgatggtgatgatggttgtgatgatggtggtagtgatgatggcaatgatgatgacagtggtaatggtgatgatggtgataattatggtgatggtgatatagtaatgactgtgatgatggtgatgatgatgatgatggtgatgatcatgacgatggtgatgatggtgatgataatgattatgctgctgctgctgatgtgataatgatgatggtgatggtgatgatggtgtttatgatggtgatgatagtgatgatgaaaatattggtgttgatgatgctgatgctgatggtgatgatgatggggtgatagaaatgataatgatgatggtgatgaggatggtgatagtgatggtcatggtcatgtgatgatgatgatggtcagtgatgatgatggtcatgatggtgatgacaatggtggtggtgatagaaataatgatgatggtgatggtggtgatgctgctgctgctgatgatggtgatggtggtgatgatgatgatggtgatagtggtggtaatagaaatgataatgatgttggtgatggtgatgatgctgctgatgatggtgatgatggtgatggtgatgatagaaatgataatgatggtgatgatggtcatgctgctgctgctgctaatgatggtgatgatggtgatggtggtgatgatgatgatgatagtgatgatgatggtgataatgatgatggcgatgatgatggtgatgatggtggtgatgacggtgatggtgatgatgatggtgatgatggtgatggtgatgatgatgatgatgatagtgatgatgatggcgatgatgatggtgatgatggtggtgatgatggtgatggtgatgatggtgatgatggtgatggtgatgatgatggtgatgatggtggtgatgatggtgatggtgatgatggtgatgatggtggtgatgatggtgatggtgatgatggtgatgatgatggtgatggtgatgatgatgatggtgatggtgatgatgatgatggtgatgatggtagtgatgatggtggtgatggtgatgatggtaatgatgatggtggtggctatgatgttggtgatggtggtgatagtgatgattatgaaaatggtaatgattgctgttcatggattctgtgaaagaaccaaccccttttcctgaaacaatcttgctctacttgactatctgtggactgttctgtgtccttcctcccaagtctctgtggcttgcatgtcctccttctggtgggtaggttggccaagtctgacaccctcaactctgccctccttccatagctaacaacagccctaatatccgaagactcagggattctgctgtcagctcccttggctcagccaagcaaagactgtgcttgtgggagcccagaaagagggaatggaatacttctccagagagtaggtgttgcatttctgaatattgtaattaagccagatgagtctaggcaggcccacaggacctcttcaggcatcttcttgtccatgttttgcactatgcaggagaagtgatgctgtcagccatgcaagccatggccccccatacagcagactctcctacgaagccatgtagcttgcaaacaatgccatgttttagtttcatgttacccctcctgcagatttgcacatctaggctctgcttttaaaataatcatgcacctgtcaggctggaagttttcaggaaaatccttctcacctcatgtgtgttgctggctttttttttttttttttttttttggttgtggcttcctgagaacggggatgctacagcctgccactgttggaacaaaggtgcttttagtcactctacctgtcgctcttagggaacgtacgtgccctcaggggaaataggcggatgcacattttgcttctggctcttttgcctctttatttttttcatttttatttttttgaggcagagtttccctcttgttgcccaggctggagtgcaatggtgtgatctcggctcaccacaacctctgccctctgggttcaagcgattctcctgcctcagcctcctgagtagctgggattacaggcatgcgccaccatgcccagctaattttgtatttttagtatagacggggtttctccctgttggtcaggctcacacttctggaggctagaagtccaagatcaaagcatgccacgttcagtgtctggtgaggacctgcttcctggttcacagacggtgccttctcactcttgtcatcacgtggcagaagggtcgagggagctctctggggtcccttttagaaggacactcatctcattcctgaggccccaccctcatgacctcatcacgtcttaaagggctccacctcttaacactatcaccttgtaggttatgtctcaagacagggatctggggccgggtgtggtggctcacgcctgtaatcccagcactttaggaggctgaggcaggcggatcacctgaggtcaggagttcgaggccagcctggccaacatggtgaaaccctgtctctactaaaaatacaaaaattagccgggtgtggtggtgcacacctgtaatcccaagctactcaggaagctgaggcaggagaatcgcttgaacctcggaggcggaggttgcagtgagccgagatcacaccactgcactccagcctggcgactgtgtgagactccgtctcaaaaaacaaaacaaaacaaaaaagcaaaagcaaaaacaaaacaaaacaataaccaaaaaatggggatttcgagaggacacagacattgaaaccatagcacatggcgaccttgagtctttgagtttacgtgtgcagcatgaatgctcggtggtgatggatgaagagagagcaaggggggaatgccacacacttctaaactgtcagacctcgtgagaactcactcactatcatgagaacagcaagggggaaatccgccaccatgatccaatcacctcccaccaggtccctccctcaacgctgggaattacaattcaacgtgagatttggatggggacacagagccaaaccataacagcagcaatagtaaactcatacatcatatctatacatctctcctgaaccatccctgctagactcagtaggacctgtagagaccatctttccctgtattccttcaacatcctgcttccttatcatatgtttctaaggttgtatagttccatgagagattacagctacttttttttttttaagacatctcatcctgcaatgcagtcttttttttttttttttttttttttttgagacggagtcttgctctgtagcccaggctggagtgcagtggcatgatctcagctcactgcaacctccgcctcctgggtcccggttcaagcaattctcctgcctcagcctcccgagtagctgggattatggggacgtgccaccatgcacagctaagctctgtatttttagtagagacagggtttcaccatgttggccaggctggtcttggactcctgacctcatggtttgcccgcctcggcctcccgaagtgctgggattacaggtgtgagcgaatgggcccggccaatgcaatcttttagcaggaaatccatccaggattttggaatcaacagaaaagaaaaaccttgggttttggagtctcagattctggcggtcctgctagatgtgttgacgagtgtgttgggccagttaattaccctcataattgttctaattgcttttatcctgcaaatatccctctgtgttcattagctttgccattacgactgagcccaagtggattaaagaaagcctgtgatgccaccagacatcatttttgtttcggcaaaacagctttctctaggaatctggccttaatgtgttttggatgccccccacactgacagggtccttcatgagctctcctggatagaataacacaaaaaactcaaagcccattttaagaaacagcagcatcattaaaaaaaaaaaaaaaaaaaaaaaacctccactgccagcccacaggtcgctcattttcttcctagaaataaattccagttgagtggacacgtcttttacgggggaatttcagtcgtgattgatcatccgttgacctgtttaaaatgattgtcaagtgactgggctatcctcattcacagataactcaggcaggctcagattaattaacccttcgtttgtttgccatgtaggactaattagtcatcatccatctactgggaatcagacgtcattggcacagttatcaaggacagggactttgccggcttatcatgtagaaggaagaattaatggtgttggtgatatatggtcttgtgtagtggtagggtattcctctccctcttttcttcatgttcttctttctttgcttgccacacattcatttacaggggactctgaagccacgtgagggttaggggcacgtgaagaccttgtgtaactcttcactcccccaaaacttaactaatagcttgctgttggctggaagcctttcctgcaactagacggtcccatctaggggtaatgggagacagtgacagatcatgaggcaggtcattattgcaccagacacaaataatatagtaatattcttacaataaagtaagccaaaggccgggcgcggtggctcacgcctgtaatcctaacactttgggaggttgaggcaggcgaatcacctgaggttgggagttcgtgaccagcctgaccatcatggggctaccccgtctgtactaaaaatacaaaaaagtagccaggcgtggtggtgcgcacctgcaatcccagctactcggggggctgaggtaggagaatcacttgaacctgggaggtggaggttgcagtgagccgagatcgcaccactgcactccagcctgggtgacaagagcacaactctgtctcaaaaaaaaaattaatcaagagaaaaaaatatagtatgtattatatactatattcttacaatgaagtaacctagagaaaaatatagtaaatattctatattatattcttacaataaagtaagctgtgattttccttaagaaaatcgtaaggatgagaaaatatctttactgtttatcaggtggaagtggctcatgataaatgtcttcatcctcgtcatcttgacgttgaggaggaggaggaagagaagggggtgtctcgggtggcagaggcagaagaaaatccacatataaggggacacccattcaattcaagcccgtggtgttcaagggtccactgtcataggggaggctcaatattttagtttcctggagctgctgcgacacaattctacaaaccagctggctgaaagccacagaagtcaaatctctgacagctctgaacaccagaagtccacagccaaggcaggctgaccacctggtcatccaagggcagagcccgtgtcaaaggacattcctggagcagaaagccaacacatccgggtggaaatacaaccttccagtcactaagtatatttgcaaatctccagcaggtcactattgcaccagacacaaagaataagcgttcagtaagttgaagtattgtgtgcacacggccgggcgcagtggctcatgcctgttatcccagcactttgggaggccgaggcaggcggatcacgaggtcaagagatcgaggccatcctggccaacatggtgaaactccatctctactaaacatacaaaaaattagccgggtgtggtggcacgcacctgtagtcccagctactcaggaggctgaggcaggagaatcacttgaacccgggaggcggaggttgcagtgagctgagatcatgccactgcactccagcctggcgacagagcaagactctgtctcaaaaaaaaaaaaaaagtattgtgtgcacactgcaattatgaaatgcatttcattctggagtattaaggcagggctgtgccccttgcggaggctctggaggaggatcctccgctatctcttctggcttccttcgctagctagcaatcctggttgtttcttgtcctgtagaacagaggactccaaccccctggctgtggactggtactgagcaaagcttcatgtgtgttcacagccacttcccactgcacgcattaccgcctgaggtcacctcctgtcagatcagcagtggcattagattatcagaagattgagaaccctattgggaagtgggcagaccagggatctgggttgcatgcttcttatgagaatctaatgcctgatgatctgccactgtctcccatcaccccccggatgggaccatctagttgcaggaaaacaagtttggggctcccactgagtctacatggcaatgagttgtattgtagaattacttcatttaacgtatcatcatagaaataaagtgcacaataaatgtcatacgctcaaatcatccccagatccttccccctgcactcacagtgactgtctttctatgaagacagtttttgtgtgtgtgtggaaaaattgtgttccatgaaactagtctctgtgccagaaaggctggggacggctggtgtagaagcatcaatacagtatctgcctttgtcgtggccatctctgtgtctctatgccacagtgttcctcttctccttttttttttttgagatagagtttttgctcttgtcacccaggctggagtgcagtggtgtgatctcggctcactgcaacttctgcctcccgggttcaagtgattctcctgccttagcctcctgagtagctgggactacaggtgtgcaccaccgtgcccggctaatttttgtatttttagtagagacagggtttcaccatgttgggcaggatggtctcagtctcctgacctcaagatctgcctgcctcagcctcccaaagtgctgggatgacaggcgtgagccactatacccggcctccaatgttccttttcttataaggacaccagttattcagttaacagcgtacactactctaatgcaacctaattgtatgcaatgacaacctagttgtatgcaatgacactactctagtgcaacctaattgtatgcaaagatctgatatccaagtgagctttcattcctaggttctgggtggacacatcttggtgaggtcacagttaaacccacgtcacccaaggctaggggcagaatcagagtggatgttagatctccaggctcttgttctgggagtgtcattcaaagcctttcttcatggccacctgaatgacgatgtcatcctctgtgggtaacagacaccagcattgtgaatgatgctggcttcctttgctggtttctttctgacatttcccttttgtgctttcgtttatggcaagtgtagacatacatgcacactcagacacatacacacacgcacacatgcactcttgccatctacaatgcctcagatccgtactgcaattggccccagccaccctgtagaatttagatttagcgaaaaaagacttcacgtgttcgccaaattctgcgtttcctcctgagtcagaggcacctgcaatgcaggcagcgggaagttgttcttctaccagaacaagagcccctaggaaaattgccccttttattactgttttggtcaaaatatggcaacaacattggtgactccaggcgagttagtaaaaatcacagagaggcacattttgtgtccggggaatgctgggatgctcctaaaacccactgagccggccgggtgcagtggctccagcctgtcatcccagcactttgggaggccgaggcaggtggatcacgaggtcaggagatcgagaccagcttggccaacatggtgaaaccccgtctctactaaaaatacaaaaattagccaggcgtgggggtgcacgcctgtagtcgtagctactgaggaggctgaggcaggagaatcacttgaacctaggaggcggacgttgcagtgagccgagatcgcactactgccctccagcttggcgacagagtgagactctgtctcaaaaaccaaccaaccagccaaccaaccaaccaaccgaccaaccaaccaaccatcccatcgagccgttctcttgctgactcaagagagaataaatcaagaaacaaacacacaaggaaaccaaaacaaccctgtagctgaggattctcccctaggaggaagaaaacgggcatccacacggcgtgtgcccagctaaatataaactgcgaggggaagggaggagacagtgatgacaagccccagccttttccacaagaagaaaaaggtttaagttttcaatgctgcccatgatatccaagaacgaaccgcatttcacagccgcggtgtgcataccatactttcacttatcggaagctcattcattgtgtgatgtgcactaattacccgctggagatttgagaacgcacctgctgactgggagggcgtattcccacctgatgtggttgctttctgcactccagaaattccctttgagatgggctccatccttccatgacagcgtgaccgcttgtcctgtagtcacagtgttgtctgaagaatgcaggatagtttattttcatttttgtttatttatgtttctgttttagaggcaggttcttgctctgttgcccaggctggagtgtagtggtgctatctggctcactgcagcctctacctcttggactcaagcgatcctcccacctcagcctcctatgtagctgagactacacatacatgccaccaacacccagctatttttattttttatagagacagggtctcactatcttgccctgggtggtcttgaactccagggctcaagggatccttccaccacggcctcccaaagtgctgggattacaggactgaacctggccttgctgtggtctgtttcgagaagactttgtttttcgttttttgttttttggtttttttgagatggagtctcgctgttgtcacccgggctagagtgcaatggcgtgatctcggctcactgcaacctccgcctcccgggttccagcaattctcctgccttagcctcccaagtagctgggattacaggcatgtaccactatgcctggctaatttttgtatttttagtagagatggggtttctccatgttggtcaggctggcctcgaactcccgacctcaggtgatttgcctgcctcggcctcccaaagtgctgggattacaggcgtgagtcactgtgcccggctgctcacccagctatttttattttttggatggggtctcactatgttgccctgggtggtcttgaactcctgagctcaaggaatcttcccaccacggcctcccaaagtgctgggattacagccctgagcctggcctcactgtggtctgttttgagaagcctttgtttttaaacagaaccacatgttggtatttcagagccaactcttctgtcaagaatccaaatcagccaggcacggtggcatgcctgtgtagtcccagcaattccagaggctgagacagaaggatcatatgagcccaggagtttgagatcagactgggcaacatagtgagactccatttctttagaacaatactaatcacatgagggtggtaggccattgcctgggctggacaggtgagtagagggcaggtgtgcaggtgcagaggtctttttttgtcctcattccatgcacgactgtttctcaaacttgctatgctaagatgctacaggaacttactttacgtcacaatatcattgaccttttttcttccttcctgtggcttcctcttcccccactctctcacctgtgtgccctattttggataaccctcctcctgggttcctttctcaccatctcctgctgtcaacatctcacctctatttcctggccggatgatgcctcctccaggaagcctgcctaggtttcctgttggcttgcaaactctatgtgggtgcgaactgtccacaccgcgtcaggtacgcaggggcccttgaagtatcacacgttggcagctcagccctgaaaacttcagctccagatacaacaaccccttccccttttctccaacctgataatttataactccagggtgactcggttcagcggcactgcagtccctcagctcttccttgcagcagccgtggtttccatgggatgtagagggttatcctgcttggaaagcattagagctgggggactagagaccccctaattctggcgtggggagaatggaggccccagaggaaatggagcaggtgttttagtggaaaagctggttttgaaattccagcctcgcctcagaacacagcatagcttccctagatgatgtttcttttgaaaggtctcctctgaaaagagtgtgaggattctggcaaacttgcaacaatctctgtaacgatgggatggctgtgtccccacccacatggcacctggaattgtaatgattcccacctgtgaagggtggggccaggtggaggaaattgaatcatgggcgcggtgacccgcatactgttctcgtggtagtgagtgtgttctcacgagatctgatgttttataaatggaagttcccctacaggagccattttgcctgccgccgtggaagatatggttttcgtcttccgtcgtgattgtgaggcctccccaaccccgtggaactgtgagtccattaaagctctttttctttataaattaccccgtctcgggtatgtctatcagcagcgtgagaatgaactaatacagatgcaaagtagagccgcggtttatgagccacaagaaataccaacccccagccaggcgcggtggctgacgcctgtaatcccagcactttgggaggccgagaccggcggatcacctgaggttaggggttcgagaccagcctcgccaacatgatgaaaccccgtctctctactaaaaatacaaaaaattagccgggcagggtggcgggtgcctgtaatcccagctactcgggaggctgaggcaggagcatcgcttgaacccgggaggcggaggttgcagtgagccgaggttgcgccattgcactccagcctgggcaacaagaggaaaactccgtctcaaaaaaaaaaaaacaaagaaggaaaagaaaagaaataccaacctctccctttcaaacctaaaaccccaacatgctggatgctctagggggtctctggggcttcgctgcttacgtttgcccttgttgggtcctgggtttttatactcaacgggatcctggaatttatgtttcatttgtgattcggttccaatttgacacaactgcctgccttcccccagcggttcgtgtgatagacacactcacgctgtcaatcatggagctgtggggcgcgtctgggagatctatagcaaaactccatccactccggttcccttgtataatacaaaagggttttatcagtcatgtatttcgcctcaaaactagaagcatggatttcccaacccgattcaccattaaaattgtgaatttttctggttctggtaaggatacgttgactgtataatggattacataacagtgtgttttcttcaccttagtaagtagccctgggagtttgtagcaaagaaagaagaaacccgagcctcaagaaaatttctccgacgatggtgcccagaacaggggtcaggggtcacgtgtgatgcgcgaaaattaaataagtgataattaagggaaaagaaaaactcagtgcctcattgcactaactgtctggcaagcgcccagtgtccagctgtggacagcacagttgtctggggcagggaagatatggactttcctgcagagagtgctactctgcagcagtgaggtacacctttcagggatgtcccatgatggtgacagagacaccagatacacaggtagcaacagtttcatttgaaaagatcattcccacagatgggagcttttgcaataagaggaggagggactactgtaatgggaggaggaggggctgtgataatgggaggaggaggggctgtgataatgggaggaggaggggcggtgataatgggaggaggagggactatggtaaggggaggagtgtggactatggtaacgggaggaggaaggactggtaacagaaggagggactctgctaatgggaggaggtactatggtaatggaaggagggactatggtaacagaaggacggactatggtaacggaggaggggctgtggtaacggggagggtctacggtaacgggaggaggagggtctatggtaacgaggagggactatagtaacgaaaggagggtctgtggtaacagaaggagggactatggtaatgtgagaaggggggactgtggtaacggagggtctatagtaatgggaggagggactatggtaacggaaggagggactatagtaacgggaggagggtctatggtaatggaggagggactatggtaacagaagtagaagggtctatggtaatggaggagggactatggtaatggggagggactacggtaacgggagaagggactgtggtaacggaggagggtctatggtaacggaaggagggactacggtaatggaggaggggggactatggtaatggcggggagggattatggtaataggggaggaactattgtaacaagaggaggagggactaatgcaaccactggtggacgctgcctatagcaccatgaagcacacccgagcagtgacatctgggagcctcttggagcgcaggcagcataccattttcttttctagggacaggcacgtgatgctcggaacaaccgtgattggggtcgttcgatgtggggttcagtcatggataaaagctgccaaaccctgtggctgcatagctaattttgagcaggtcctaaggaagcgttgcttgatcctctgacgtttgctccaggtgaggctggcccaacatcccggggcctgataggaggagagaaacccaaccaaaatgtgatcacgttagatgggaattttgttcaggtcaaggaagacgaggaattcagtccatccctgaaggggcaaataaagaatgtgaatttggaggatgtggccagccttgtcctaggctgacttggaagcatctgtgagtaatgaggaagggaattttttttttttttttttcagtaaaaccattttctggaagacaaaggcagtggggaattcttaaccttcacagattcccaacagcacagttgtgtggaatgatggactgattgtgtctccgtaaaatacaaagccctcagctgggcgcggtggctcagactgtcatcccagcactttgggatgccgaggcgggtggatcacctgaggtcaggactttgagaccagcctgaccaacatggtgaaaccccatctctactaaaactacaaaaattagccgggcatggtggcgggtgcctgtaatcccagctactggggaggctgaggcaggagaatcgcttgaacccaggaggcggaggttgcagtgagccgagattgcgccactgcactccagcctgggagacagagtgagactctgtttcaaaaaaaaagacgaactgggactcctcaaactgggggaatggtgcatttgtagacaaaactcatggtgtgccatctgcaggtgtcattgtcaggaaggtgagcttggttcatctgtgcccacttgcaagctctttggagagtgaggagcaggttgggaagcatctatcctcagtcatgaacccggagctcctgctggaaaagacagccttggggtctctgtcatgcacatttcagtaggggagtccgggccgggcacaggggctcatgcctgtaatcccagcactttggaaggctaaggcgggcagatcacttgatgtcaggagtttgagaccagcctgaccaacatggtgaaacccgtctctactaaaatacaaaaaatagctggggctgggtgctgtggcttaggcctgtaatcccagcacttggggaggccgaagtgggtggattacttgaggtcaggtgttcgagaccagcctggccaacatggtgaaaccccgtctctactaaaaatagaaaaaattagccccggctaattttggtggtgtgagcctgtagtcccagctacttaggaggctgaggcaggggaatcgtttgaacctgggagatggaggttgcagtgagctgagatcgtgccactgcactccagcctgggtgacagggcgagactctgtctccaaaaagaaaaacaaacaaaaaaaaacaaaaactaaacacataggagagtcccttagcccctcacgaatactccacacacacatctagtccagctgcatcttgttgactcacaagacatcaagataagcctgattcaatgaagttcttcaaaatcagagttcatttgctcattttcttttcttctctccaccaattagtggtgagagtttcgcctgaatcacagtacctgctgtctccagttctgatgttggtatcacccatcttcagacaagatttcttgtgttatttccacatcagcttagccactgtctctcaacatgaaatgctggctggggggaagtttcaaccgcagaagcaaagctcttaaactcattgaaaagacaagctctttcccccttggtagggtcacgaaggctcctcagtgaagggtgtggtaggtttgcttctatagggtagaaatgagacaccctgaaaatcaggaggctttcattggcttttaatttacacagaaggcaatgtgtagtttcaaaatattcttttttatttacttatttacttttatttatttatttgagatggagtcttgctctttcgcccaggctggagtgcagtggtgcgatctcggctcactgcaagctccacctcccgggttatttatttttttgagacagagtcttgttctgttgcccaggctggagttcagtggcacaatcttggctcactgcaacctccgcctcccaggttcaagtgattctcctgcctcagcctcctgagtagctgggattacaggcacctgtcaccatgcctggctaatttttgtatttttagtagagacggggttttgacatgttggccaggctggtcttgaactcctgacctcaagtgatccgccctccttggcctcccaaactgctgggattacaggcgtgagcttccgcgcctggcctcaaaatattcttaatgagtaaatacccgtaagcatttgaatacaaccatttatgttttttgttgtttagcaattgtttgaacttcaatgtgcctcataaaaatgtttcattataaaacatttcacacatttgaaagacgcagagaataatttgaacagcatttgtgtacccaccatccagttgtatcaaatcgtaatgttttgccaaattagttataaattacgtatgtgacttgggtacccctctccaattattttgttattacataaaaaatgactttataacatgggtcaataggagaccttttttcttttttttttttttgagacagagtcttattctgttgcccaggctggagttcagtgccacaatcttggctcactgcaacctctgcctcccaggttcaagtgattctcctgcctcagcctcctgagtagctgggattacaggcacacggcaccacgcccggctaatttttgtatttttagtagagatggggttttgacatgttggccaggctggtcttgaactcctgacctcaagtgatccaccctcctcggcctcccaaagtgctgggattacaggtgtgagcctccgtgcctggcctcaaaatattcttaatgagtaaatacccgtaagcatttgaatacaaccatttatctttttcattgtttagcagttgtttgaacttcaatgtgccttctaaaaatgtttcattataaaacatttcacacatttgaaagacgcagagaataatttgaacagcatttgtgtacccaccatccagttgtatcaaatcataatgttttgctaaattagttataaattatgtatgtgtctttgtgtgcctgagtgtacatgaaataagacatttcagagactattgtgctcttgggtacgcctctccaattattttgttattacataaaaaatgactttataacttaggtcaataggagacatttaaaatattattttccatgcatctttgtccttgtttattttctctagaaaagaaaaatgtatttccctgttcttattttcaattcccaaatgaagcttcaatgtaaaactaattttctgagaatgtagcatcgttcttttttttttttcttttttctttttttttttgagacagtcttgctctatctcccaggctggagtgcagtggcacaagcttggctcactgcatcctctgcctcccaggttcaagcgattctcttgcctcagcctcctgagttgctgggattacaggcacctaccaccacgcgtggctaatttttgtatttttagtagagacgggatttcaccatgttggtcaggctggtcttgaactcctgactttgtgatccgcccacctcagcctcccaaagtgctgggattataggtgtgagccactgcgcccggctagcatctctctgtatttgctgaagccatgtgtgctgtgaagattgtagttttagccattgtggttcctcttgaaagggggccctatatcttcctgatggggaatggcttaactgaagcctggggaatggctggtgttcgtgaaatggctgcattcagatgagaaaccgcacatacacatcctcacaaagtctcagagtcagctttccagggggctgggttttattccggtgcaaaggagtgagaatattgtacacacgaatgatccatggtggctcctgcctgtaatcccagcacttttgggaggccaaggcgggagcatcacttgagcccaggaatttgagactagcctgggcaacatagcaagatctcgtctctacaggaaaaaaaaaaaaaattatccgggtatgatggcatatgcttctggtctccctctcaagatgctgaggcaggaggattgcttgagcccaggaggtggaggctgcagtgagctgtgactgctccactgctcttcagcctggctgatggaatgagacagtgtcacagaaaaagaatgagaaaaataagcccaggatgcagcaaagaatgctatcctttatttattaaccccctaccctggttgtatattgatggtcatttaaatattagagggtataaaaatacaatttccaagaattacctgaactattttctttttcttttcttttctttttttttttgagactgagtttcgctcttgttgcccaggctggagtgcagtggcgtggtctcggctcaccgtagcctccacctctgggttcaagtaattcttctgtgtcagcctcccgagtagctgggattacagccatgcccaaccactcctggctagttttgtatttttagtagagatggggttttactaggttggccaggctggtctcaaattcctgacctcagatgatccacctgcctcggcctcccaaagtgctgggattaaaggtgtgtgccaccacacccggcctattttcttagaattaatattttatcctctgccatcagccgtcgtaggggtatgagcagtttcctgcctattgtaagggtttagagaagggtttgtgataaattggccgtgtggtgaagagattcccattcgggaaagacattgggcagagggtaggatgtcatgtgaagacagcattcatttcaggcagggagagggggttcatagaacgctagtgttcagtgaactgttcctagaactagttcatatgtatacatgtgccatggtggtttgctacacctatcaacccgtcatctaggttttaagcccagcatgcattaggtatttgtcctaatgctctccctccccttgccccccacctcccgacaggccccggtgttcacagagctctagtatccacccaaggctcaccaaaggcagtcaccctttgctatggtggagtatcctgggagccataggtatccctgagctacctcaggttaaagactgcatacctgtgaaagcatgtgaggatttacccatttctgtgtattttgaggaaatctcacttccatcttcagagcttggtagccccaaggtaaaattttaagaagtaaagagattgtaagtttgcatattctgggaggtgatatgaggacaagctcttaggatgaactctctaggcatacaggagaaagaagtaaaggtcaaagcaaagtggcatcaaaaaggccaaaacctggccaggcacggtggctcacacctgtaatcccagcactttgggaggccgagatgggtggatcatttgtggtcaggagttcgagaccagcctggccaacatggtgaaaccctgcctctactaaaaatacaaaaatcagccaggcgtggtggtggctgcctgtagtcacagctaccagggaggctgaggcaggagaatttatttaagttccttgtagattctggacattagacctttgtcagatgaatagattgcaaaaattttctcccattctgtaggttacctgtttgctctgatgatagtttcttttgctgtgcagaagctctttagtttaatgagatctcatttgtcaatttttgaggcaggcattgttattaccccaatttcataaatgaggaaatgacagacagatagatagatagatagatatgccagttgtccctgaggaggcgaaattttgctcagttgaaaaccactgtgatatagatagatgatggatacatagatagatattagttagacagaaaatagctagatagataatagctagatagatagtaatggtcaatgatagattgtgatcaatgataggtaatagatgacaggtagataaatgatcgatggtcaatagatgataggtagatgatagacagtagatagagagtaaacagatgctatataatgatcaaagatagataaatgatagataaatatgtacttgatagataataaatggtaaatagataaatgatggtagataagtagatgatagatgataaatggtaaatagataaatgatggtagatagataagtagatgcttgattgtaaatggtaaatagataaatgatagacggtagataagtaggtgataggtggtaaataggtcgatagatattctataaatagttgatagataaatggtaggtgatagatgataggaagtgagttggatgataggcacacagacaaatggatcacatatgcatacaatctgtcatgctaaggcaggctttgtcaaccttggcagtatgtccatctggagctggatgattctctgtggtgaggccatgctgtggactgtagcgtgttgagcaggatccctgggctccacccacttgacatggatgtacccactataccccccaccgcagttataacaaccaaaaatacctccagacatttctatatgttcctgggggagggggaaacaaaaaggcctccaatggaaaaccactgatgtagatccctacagatgccagcccagttctgtggggatgtgcctactaccattcaatggcagtaacctggacctaagaccagtatgctctctgaggctctggaaagggactcccagcctcgcatcttgaggagagcttagacatcctacgtagcattatgattcccctccaaacatggctgtgctgtgtggatcaggggtctcctcccttatctcctccatcccacccagccgtctcctttcacctcagtccctgtgtgttgagtgtggaaatatctctgtgcccaggatcctgggccggttttgtggcggggattcttctcccacagctccatcatgcatgttccctcatctccttcgatgctgatgtgttattattcgtagaacagtgatgaaatggcagcatgataccatagaacggtgataaaatggcagcatgatatcatagaacggtgataaaatggaagcatgataccatagaacggtgataaaatggaggcatgataccatagaacggtgataaaatggcagcatgataccatagaacggtgataaaatggcggcatgataccatagaacagtgataaaatggaggcatgataccatagaacagtgatgaaatggcagcatgataccatagaacagtgataaaatggcggcatgatatcatagaacggtgataaaatggaggcatgataccatagaacggtgataaaatggcggcatgataccatagaacagtgataaaatggaggcatgttaccatagaacagtgataaaatggcggcatgataccatagaacagtgataaaatggcggcatgacaccatagaacagtgataaaatggaggcatgatatagaacagtgataaaatggaggcatgataccatagaacggtgataaaatggcatgataccatagaacggtgataaaatggcagcatgataccatagaaaggtgataaaatggcatgataccatagaacggtgataaaatggcggcatgataccatagaacggtgataaaatggcggcatgataccatagaacggtgataaaatggcggcatgataccatagaacggtgataaaatggcggcatgataccatagaacggtgataaaatggcatgataccatagaacggtgataaaatggcggcatgataccatagaacggtgataaaatggcggcatgatatcatagaacggtgataaaatggcggcatgataccatagaacggtgataaaatggcatgataccatagaacggtgataaaatggtggcatgataccatagaacggtgataaaatggcggcatgatatcatagaacggtgataaaatggcggcatgataccatagaacggtgataaaatggaggcatgataccatagaacggtgataaaatggcggcatgataccatagaacggtgataaaatggcggcatgataccatagaacggtgataaaatggcggcatgatctcaagggttgggattagacacccagaaatgggagcacctgtggttgggtggagttattgatccatccttctccagtgttcaactcctccacctatgctcatatcacttataaggcagacctggccaggcatggtggcttatgccggcaatcctagcactttgggaggctgtggtgggcggatcacgaggtcaggatttcgaggccagtctggccaacatggtgaaaccccatctctactaaaaatacaaaaattagtggcatatggtggtgggcgcctgtaatcccagctacttgggaggctgaggcagaagaattgcttgaacccgggaggcggaggttgcagtgagccaagatcacaccactgcattccaacctggtcaacagagtgagactctgtgtttcaaaaacaaacaaacaaaaacaaggtagaccttatgggtctttccctgggagccttctacagagtggttgttgctacagacagcagtgatatgagacaaaccatctaaggccctgaaatatgagtcttgaaaatggctgtggacaaggaaaatcaatgaaataacagtgacaccagcaccccactctctctagggctcttaaaagttcttagcctgtagcctcttttccaatccactccagccttccttttctttgaatttgaaaatgaactttgaaatttctttcagtgacaagaaaatgtcactgtgttacgtgttgtatatccatgtgtctccttgggaagaaaattaaaggactaattgaagaaagaattagaaacactgaatccacagaaacgcagccacactctgtaattaatttttgaagaaaagaaaatgaaatgcttgccgatggtgaacctctccagcatgttcattagatatttgcattttctgcctattccattaaaagtacctctaatcagacagtcaatcaaaagtgcttatccagacatcttctttttagaatttgaatcatgccatgttctgtataggagtgagaccttaccacataaacagggtagggcttgctgtgtgctcagaaacgacacattaaccaggctgaactgatggaactccagctctctgtatccttctttgtccctctaatacttgggcagattctgccccaccattaaaaattcaatcattaataccaagaagaaaattgaggggtttcaaagaacctcaataaaccacagatttaggtctttataagaccttggtaagcagttgtggattctatagtttgtacctaccataagttatgatgatcattatagcattactgataacattttaaaaacttttattgagctgggtgcggtagctcacacctgtaatcctggcactttgggaggctgaggcaggtgtatcacgaagtcaggagtttgagactagcctgaccaacatggtgaaatcccatctctactaaaaatacaaaaattgggtgtggtggtgggcgcctgtagtcccagctactcaggaggctgaggcaggagaatcgcttgaacccgggaggtggaggttgcagtgagccgagatcgcaccactgcactccagcctggcgacagagtgaaaactccatctcacaaacaaacttttatgataatgtgtatggaaagtgtctcctcttgaaatgttccattttctctaaccaaagccaacgctccagccagccagtaggtagcagccagtaggagctgtcagaactgattgctcttatcatcactaaacacacaaagagggaaaagccatttcctcattccccaaattccagctccatccttcctctgaaagcatcatgccatttctcgctccggatatgtatttggtgtttagtcattcaaccgtgacatatctaacgttggcagagagggggcagaattcgaagttcttgccattccaggaagaggaagccatgttccctgtctaagcatctgcccacatcgggccgtgtctcggtaccaactccaccaagagagcagtgagtgacaaaggcaaggatgttcttaccaaacttggcgataacctggctccattaccatcctagattaataacccttcagtcattccagaggtggatgttgatacccaagaaatggtgggtgatgtgtatttttttgttgttgttgttgaaacagagtctcactctgttgcccaggctggagtgcagtggcgcgatcttggctcactgcaatctccgcctcccgggttcaagcgattctcctgcctcagcctcccaagtagctgggattacaggcacgcaccaccacacctggctcatttttgtatttttagtagagacagggtttcaccatgttggtcaggctggtcttgaactcctgccctcgtgatccgcccaccttggcctcccaaagtgctgggattacaggcgtgagccaccacgcctggccccattataaccctcttgcatagtctatccttcactcttgcgaaatgtttaatgagatgttgaataaatgttactatgctttgtatctttttttttgcttctatgtcacttttctttttgccgtgggtggcaatggtgagttcttttgcactcagggaagcttcatgcctcatcaccccaaccttctggaaattttgattcttatagttcaaacttccataatttttaaaaaccatttttaagttcagggatacaggtgcaggtttgttacataggtaaactcgtgtcatgggggtttgttgtatgattatttcatcacccaggtattaagcccagtacccattagttattttcctgatcctgtccctcctcccaccttctgataggcctcaatgaatgctattcccctctctgtgtccatatgttctcatcatttagctctcacttataagtgagaacatgtagtaatttggttttgctgttcctacatagtttgctgaggataatcgcctccagctccatccatgtttctgcaaaggacatgatcttgttcttatttatggctgcatagtattccatggtgtctatgtaccatattttctttttctttctttctttttttttgatatggagtctcgctgtgtcacccaggctgctggagtgcagtacccttgaaaattcctctgcctcagctcactgcacccttgaaaattcctctgcctcagcctcccaagtagctgggattacaggtgcacgcccccacgcccagctaatttttttgtatttttagtagagacggggtttcaccatgtgttggccagactggtctcgaactcctgacctcgcgatccacccgccttggcctcccaaagtgctggaattacaggcgtgagccaccgcacctggcctatgtaccatattttctttattctgtctaccactgatgggcattcagattgatcccatgtctttgctattgtgaaaggtgctgccacgaacatacacgtgcatgtgtctttatgacagaatgattgatgttcctttgggtatatacccaggcatgggattgctgagtggaatgatatttctgtttttaggtctttgaggaatggccacactgtcttacacaatgttggaactaatttacactcccgccaacagtgtttaggtgttcctttttgtctgccaccttgccagcatctgttgttttttgatgttttagtaatagcctttatgactggtgtgagatggtatctcattctggttttgatttgcgtgtctctaatgagcagtgatgttgaatgtttttgcataggcttgtcggctggatgtatgtcttttttttttttttttccgagacagagtctcactctgtcgcccaggctggagtgcggtggcgcgatctcggctcactgcaacctctgctccccgggttcacgccattctcctgcctcagcctcgcaagtagctttggtttttgactttagttacatgcactttttcagaaatcaaggtatgcataagcaaagcacatctgtctttccaaactggatttaaattcgccatttactaactaaggaatattgtgcaatttagttaacttctctaagcctcattttcctcgtctatgaaatgggaagaatagtaagatctacctcaaaagaatgttgtaaaggttaaacaaggtaatcaaattgtttagtaatatgcctcccacatatcaagccctcaaccccgccaccatgcctggctaattttttttgtattcttagtagaggcagggtttcaccgtgttagccaggatggtcttgatctcctgaccttgtgatccacccgcctcggcctcccaaagtgctgggatgacaggtgtgagccaccgcgcccggccagctgcatgtgtatcttcttttgaaaagtgtctgttcatgtcctttgcctgacgtggcaaagggtgtgctttcaatgggattttttttgtttttatttttgttttgttttgtaaatttgtttaagttccttataaattctggatattaaacctttatcagatgcatagttggcagatactttctctcattctgtaggttgtctgttcacgctgttgatagtttcctgggctgtgcagaagctctttgaaactttcgtaactttaaaccaagtgttagctaactccgtttctcaactgagtaacttcagaaattaaattagaacaacaggttctgccttttgaagacaaagtagcataaccctagccatccaccacatgctatcacttgattctgattgctgttttgaggattctttttgtcccaatctctaattagttttttaaaataagcgttttgtagagaggatgtttttctcaagagttaccctgttttgactatggtagccacaccccagtgatgtacatgtgtttctctattttccatttcataaccaccgttatgtaggtgaatccttgatctgacacacagtgcctgtctttccctatgaatggcttagtgatttgcctggaaatcttagcttgctgtagtgtgtgtgtgtgtctgggcacagttttagagaaacaagcaatgattcttttttttttttttttttttaatttcctgagtcccaaagtgtttgagacaaatctcgttttcccatatcgggtctagggttatttgttcagatcctttgtcattcaggactctgtagctctttctttattccttactgaaatctcacattgacgaagagctctttccacctgatttgcttttccattggcagatgtcctttttgttcctcccttgatgcttttaggattttctcttgatctttaaagctccacggtttcatcaggatgaggttgatggacatatgggcatttaaaaataaatcgtatggcttactatacatcttataatggcagatctgggtttttatctcagggattttttttttctttgcacgaaacctttccatttacaattgacccttgaaaaacatgggggttagggacaccaacccctcacacagtcaaaaatccatgtgtaactttttttttctttttcgagacagagtttcactgttactgcccaggccagagtgcaatggtgtgatcttagctcactgcaatctccgcctcctgggttcaagcgattctcctgcctcagcctcctgagtagctggcattacaggcgcacgccaccatgcctggctaatttttgtattttcagtagagacggggttttaccatcttggtcaggctggtcttgaacttgtgacctcaggtgatccacccactttggcctcccaaagtgctgggattacagatgtgagcccctacgcctggcccatgtgcaccttttgattctccaaaaacttaattattaatagcctactgtttacaggaacccttgccaataacataaacaggtgattcactcattcatattttctatgttctatgtattgcatactttatgcttagactaaagtaagctagagaaaagaaaacgttaccaagagaatcatgagaaagagaaactacatttactattcatcaaatggaaagggatcatccccgaggtcttcatcctcatcatcttcacatggaggaggctgaggaggagaaggaggaagagggaggttggtctggctttctcaggggtggcagaggcagaagaaaatccacatataactgacctgtacagtccaaacctgtgaaggatcaactatgtttctgtgtctctttctcccagttcttgtcttcagagataccaacattggatgttgcctctcaactggtttccttctctttcatgttcttttctccaatcacttcatgtcatcatctttttcttctacattctacacgcttccacaagcctgccctctgcacccctgacatgattctccacattcattttttttctttttttgagacagagtcttgctttgtcacccaggctggagtgcagtggcacgatcacggctcactgcaacctctgcctcctgggttgaagcaattctcctgcctcagcctcgtgagtagctgggattacaggtgcccaccaccacacccagctgtattttgtatttttagtatgacagtgtttcaccatgttggcctgcctggtctcgaactcccgacttcagttgatctgcctgcctcggcctcccaaagtgctgggattacaggtgcacaccaccagacccggctaattattgtatttttttttttttttttgagacggagtctcgcacttgttgcccagggtggagtgcaatggcgcaatctcggctcactgcaaactccacctcctgggttcaagtgattctcctgccttagcctcccgagtagctggaactacatatacctgccaccacacctggctacattttgtatttttagtagagatggggttttaccatgttggcctgggtggtctcaaactcccgactttagatgatctgcccacctcaacctcccaaagtactgggattacagggtgagccaccatacccagctgagtctcctcattcttgattttgatcttccctctgtctactattgtccgggcttctctaggatgtgatgttatatctcctactcgtttccggcacccttcttattatgttaccgcattaacccttttgttaaacgtttaatatttttgtgctctgaatttattattttttatctgatatgaatatattaggttggtgcaaaagtaattgctgtttttgccattaaaagtaatgatagtcttttttttttttttttttttttttttttttttttagatggggtctcgctcttgtcacccaggcaggagtgcagtggcaccatcttggttcactgcaacctttgcgtcccaggctgaagacatcgtcccacctcagcctcccgagtagctgggactacaggcatgcgccacaacgcatagctaatttttgtattttttgtagaaacaggctctcactatgttgctcaggctagtctcaaactcctgagctcaagcaatccgtcgtcctcggcttcgcaaaatgcagggattccaggtgcgagccattgtgcccggcctgataatattttgactctgactttcttttcgtttctatttacctttaaatctcttttatgttccacctgaattactcctctgtgggtatcttttataggctgtatatttgtgttttccttccaacctatttcttgctataattgagatagtgaaggattagtggtctcaggtccttctgcctcgccccacataaatcttcatttcaactgatgctcttcatttcttttttatggaatattactttcctgttttttgtgtttgcctgtttttcccatgagtcccaagatggatattttccctccatacgggcatttattttaatgcccagtcttcacccctggaggatgcgtgagttggttcttttttcctccttgccccgtggacctcagacatggacacacgtgtctgtggttttgagggctttgttttatccgttcagttcttcagctgcttaagatggacggacagaggccgagcgcagtggcttacacctgtagtcccagcactttgggaggctgaggcgggcagaccacaaggtcaggagttcgagaccagcctggccaatatggggaaaccccatctctactaaaaatacaaaagttagccaggcgtggtggtgggtgcctgtggtcccagctattcgggaggctgaggcaggagaatggtgtgaacccgggagacagaggttccagtgagccgagattgcgccactgcactccagcctggctgacagagcgagattccatctcaaaaacaaaaacaaaaaagatggatgggcagggagtggaggctgtgggtagtgattgctgtccatgacccctgtctgtgagcacctgctctctaagctgagggaatccctggtgtcatcccagcagtggcgtgttccatgctgctgtaggccaggaacatggtgcagccgaagtggacggccatccagtgatgacttggccccagtggacagctgcccagtgatgggacatctggagtagatggccgtccaacaacagttcattattgttgtgctacgtctggtgtttccagtggctggaaccactagagctccgctccattgggttggagccattccagggtgggaatggccaccaggagacgatgcctacccttctcttcttgcaccaagtcagcacccatactcaggcgaggccctgtgtctcctcctcctccccagcatagtcttgctggagtcatgtagaaaagtcatggaaaggggcttgtgaagggatacgctgccttcttcctgggctctcctggtatcccactggtactcagtcattctccttccaaactgaggtgtgtgcatacatataatttgctggcccttaaaaaccacgtgtaggcctggctcctgtaatcccagcaatttgggaggccaaggcaggaggatcacctgaggtcaggagttcgagaccagcctgaccaacgtggagagaccccatctctactaaaaaaaaacaaaattagctgggtgtggtggtgcatgcctgtagtcccacctactcagggggctgaggcaggagaatcgcttgaacccgggaggcggagattgaggtgagccgagatcgcgccattgcactccagcctgggcaacaagagtgaaactccatctcaaaaaaaaaaaaaaaatgcaatcagctataatccttccctaaactactggtgtgactgtcttctgactccttcaactattacccaaaagatgaatgacttcttagtgaccctttgtcctaggaattatttcataggcttctgtagcaaatggaaccttgggtctcactaggataataagcatgttctgaattcctggacgcttttttctttttttcctgcacaacttcatttcggggtaaatgaggacagcacctgagttccccactcccctttggattctctagggggttgaaggtttcttctactgacatacacatggcttcaggaagatggtgttggacgctttttctttttttgagacagggtctggctctgtcgcccaggctgaagtgtaatagtgcagtcttggctcactgcaatttctgcctccgggctcaagcaatcttcccacctcagtctctcgagtagctacgactgtaggcacgtgctaccatgccctgctaatatttgtatttttttttgtaaagatgaggttttgccatttgtcccaggctggtctcaaactcccgagctcaagccatcttgcctgccatggcttcccaaagttctgggactacaggcaggagccactgcgtccagcctggttttggactcttggtcttgggtttggccaaaactttggtggttcagatggactcttgtagattttaaggagaattgaagttttgtggcttaagctgaactgctgttctcaatgcccgtgctggtccgaatgcccatgctggtccctatagcccttcatctactgtggctggtcttgtaggtctgttttatttgctgtaggagcctttgcctgtgcttgtagctatcaccgtagcattcaacacacctctgctgtatcccctgaagacgccgaaacgtggtattctcaccccaaagagtttccaccctgataagttccagcaaggcagcccagcagctacgcctgcagacacttgttggtaggaagaagtgtcagatgatctgtaacactgtgcgttgatcctgcatgtctgaagaacttcacagaattgtcgcatggtgagcagtgatactaagcaaagctgagtcacccgtaagctcccaggccctcagcccggcaagtaggacggtattttcacacctctgttgatgaagcacctcagatagctcaagtttttggagacagcctcgtaggagttttagtttaaccataatctgcttgcggatcactgatgtttccatgagtcattccctgagattgtagtgaagaaaacagatactatcccattcgcttctttgcaaaatacccacaaagccacatgcattttcatactgaacatcttgggataccatttattttcctgcaggattatatcatagtttagggttgagtgtgcctccaggagtcatcagctaagcttcctgttttgtggatagagaatacgggaggacatctgatcccctatgactgccagcatcaggcctgggattgtggttgtccaatggtgcttttagggggcaaaaatgcacagctgtttattgaaacaacaaatgttccaggctgggcacggtgactcacgcctgtaaccccagcactttgggaggccgaggcgggtggatcacctgaggtcaggagtttgagaccagcctggctgttatggtggaaccctgtctctactaaaaatacaaaaattagccgggtgtagtgttgggcatctgtaattccagctactcaggaggctgaggctggagaatcgcttgaatcgaggaggtggaggttgcagtgagttgggattgcgccactgcactccagcctgggcgacagagtaagggcagggagggctctcagtctggtagtctcacccaggtggtccagggttccagcactgagagccaggatgccaactcccaatgcatcatcagcctcctcttcagccatgcaggaagtcagggctggtcccagtggttaatccagacaccagagtgcatagcatggccctccccatgtccagcacactggcctttcactgtaccatgtcctctttctcccattgggtggcctgtgttgctttctcaatctccaagtctgtgtcagcaaggaagtgttccatcctttactgagtcatgacctgtctgaggctgacaagtgccagagctcatgttattcaggcatatttataagcaggtgtttttatttaaagacttagtccacatattacaagtattctgatggactcatcaaagcagatagggaaagttggccagtctcattttgaatgttacgatgtagccgaacatttacaaaactgtctttgactttctttctttttaattttactctaagttctgggatacatgtgcagaacgtgcaggttcgttacataggtgtgcgtgtgccatggtggtttgctgcgcctatcaaccaatcttctacgttttaagccctgcatgcattaagtatttgccctgatgccctccctccccttgcccccagctccctgacaggccccggtgtgtgatgttcccttccctgtgtccatgtgttctcattgttcaactcccacttatgagtgaaaacaggcagtgtttggttttctgttcctctgttagtttgctgagaataacagtttccagcttcatccatgtccctgcagaggagatgaactcatccttttttatggctgcatagtattccatagtgtctacataccacattttctttatccagtcttatcattgatggacatttgggttggttccaagtctttgctgttataaatagtattgcaataaacatacgtgttgaaatttttattttatcacggtcaaacgcttaccatgagagccaccctcttgacaaagtgttacatgtataatacggtcttgttaactctaggcacaactgctgtggtgtgcacagttgtacccagactgcagaactgattcatgttatataccaaaaccttatacttgtggaacagcatctccctacgtccctctctcctcatcttctgaaaaccatcattctactgtctgcttctgtgaatttgactattttagattctacatgtcagtgacatcatgcggtatttgtctctctgtgtctggtgtatttcacgttaacatcccccaggttcatccatgttgtggcaaatgacagaattcccttctttttaaggctgcgtggtattccattgtctgtatgtactgcattttctttctttttttgagatggagtcttgctctgtcacccaggctgcagtgcagtggcgtgatctcggctcactgcaacctccgcctcccaagttcaaatgattctcctgcctcagcctctggagtagctgagactacaggcacccgccaccatgcccggctaatttttgtacttcttagtagagacggtgtttccccatgttggccaggctggtctcaaactcctaactaactgcaagtgatctgcctgcctcagcctcccaaagtgctgggataccaggcgtgggccactgcacctggccaattacgttctttttttattttttttcttgagacagagtctctgtcgcccaggctggagtgcagtggcgcgatctcggcttactgcaagctccacctcccaggttcacgccattctcctgcttcagcctcctgagtagctgggactgcaggcgcctgccaccacgcctggctaatttttttgtatttttagtggaaacggggtttcaccctgttagccaggatggtctcgatctgacctcgtgatccgcccgcctcggcctcccaaagtgctggaattacaggcgtgagccaccttgctcagcccaattaccttccgtttaaggctgtaaagtatcccattgtgtgtatttacagcattttctttatttctttctttgagactgagtgtcactctgtcgcccagtctggagtgcagtggcgtgatctcagctcactgcaacctccgcctcccaagttcaagtgattctcttgcctcagcctcccaagtagctgagattacaggtgcctgccaccatgcccggctaatttttgtacttcttagtggacacggggtttcaccatgttggctgggctggtctcaaactcctaactaactgcaagtgatccacccgcctcagtctcccaaggtgctgggattccaggcaccgcgcctggcccaactaccttcttttgaaggctgcatagtatcccattgtgtgcgtgtaccgcattttcttttttttttgtttgagacggagtgtcagtctgtcgccaggcctgagccaccgcacccagctgtaccgcattttcttcatccattcatctattgaacgcttgggttcattccatatcttggtgattgtgaatactgctgccataaacatgggggtgcaaatgtctctcatagaccgatttatcttttggataaatacctagaagcatgcttgctggatcatcgagtagttctatttttaatttttttgaggaacgtccgtaccatttactgtattcacccatttctgcaggaaacagtggcagaggaacacaagttttcttcttccctgtcccagctgtgcaaaaagagacccacagccgggcgcggtggctcatgcttgtaatcccagcactttgggaggctgaggcaagcggagcacctgaggtcaggagtttgagaccagcttggccaacgtggtgaaatgtcgtctctactaaaaatacaaaaattagctgagtgtggtcgtgggtgcctgaaatcccagttacgtgggaggctgaggagggagaataccttgaacctgggaggcggaggttgccgtgagccgagatcgtgccactgcactccagcctgggcaacaggctctctcaacaaaacaaaataaaaaaaaaaaaaataaaaataagagacccacaagggctttggacctcctttctttgcaaaacaagaaaataatatagcagacattgggcagtttttcattctgactttccagtttcatttttgcttcttcctgtatggttgctgcctggacctctttcttattgctgggaggtctttcccctgcccccatccttttgagcctttctatctacttttcttttgaaagaaagtaaataaaaccccacacatccagacaataggagcgcacgcctcagaattctggctgcgagggactgaccccatccagagagaacgaacaaatgcatcaaaaccctggctgcaagcgactgaccccagcttgatccacttaagccagaagagcctttgcttctatgtttaatctgcaccaagcttagtgatcactttcttctcagaggccagaacacagagtccaacctttccaggatgccagcttcctatctctggggtctcctcttcctgcagagaagctttagtctcttacccgagctgcttctctattctcttttgccttgctttgcctataatactaacacactgtctttttcttatgttacgttggactatcccaaggcagggacccaattggcctggcttgggttccctgcctgactgtgggtttggctgaggagtgggcagcaatttccagccgttggcactgccagaacgcatgggtgtatggggtttctggaggcagcagctctatagtgaagcagatatgtagggggtgttcattaccaagacagcagtgattgtccacgagcagggtggttccaacagggagcctacagtctaactgcagatggatgctaccattttacatgtcccatgtatgacatccatgtaccgtatgttgctggacaccgcattatggcaactgaaaaacaaaaaggcattaaatgcctgggaaaatgtacagctcattacatctcatatggtttggctctgtccccactcaaatcttatttatttatttagagacagagtctcgctcactcaggctggagtgccgtggcatgatctcggctcactacagcctccacctcctgggttccagcgattctcctgcctcagccttttaattagctgggattacaggtgcccgccaccatgcacggctaatttttgtgtttttactagagacgggcttttgccaaattggccaagctggtcttgaactcctgagctcaggtgatccacctgtgttggcctcccaaagtgctgggattacaggcgtgagccaccgcgcccggccccaaatctcatcttgtattcccacctgttgtgggagggacccagtgggaggtaaccgaatcatgggggcaggtctttgccctgctgttctcatgatagtgagtaagttttatgagatctgatggttattataaaggggagtttcctgcacatgctctcttctcttgtctgtcacaatgtgagacgtgcctttcaccttttgctttccaccatgattgtgaggcttccccagccacgtggaactgtaagtccagttaaacctttcttttctaaattgcccattctcagatatgtctttatctacagcatgaaaacatacttatactttatttatccatccttatctatatcaaatactatttgaccatagattgtgtaaagacaatatggcacagagacaccatggaatactatgcagccataaaaaagaatgagttcatgtcctttgcagggacatggatgaagctggaaaccatcattctcagcaaactatcacaaggacagaaaaccaaacacctcatgttctcactcataagtgggagttgaacaatgagaacacatggacacagggaggggaacatcacacactggggcctgtcggggagtaggggactgggggagggatagcattaggagaaatacctaatgtagatgacgggttgataggtgcagcaaaccaccatggcacatggatacctatgtaacctgcatgttctgcacatgtaccccaggacttaaagtattaaacaacaacaacaaaaaaaaaaccagactcatacaacatccctacaaacaggaaaaatggggaggggaacatgggagtcaccttgtagtttacttagatttgctgtgagaagaagctatgggaggctttccaaaggctgcgggaaggatttgggctatcttcaggagattgagcttgacagcagcttcaaggcgccttgtgggaggggaggctgggggcaggaaaatcaggtgggtgaaaaatacactgatttgcagagaaatggtgccagcctggactgtgaaaacagagacgagaaaaaccacactcggcaatatttgagcacgtattaaatcctggatggcacattgcatttttatggatgtcattcctaagagattcacagtcaggggaagatggtacataacaactcgggcatgtcagatgcacctctgtagctgcgtgtccagatgccatggagtgagatgcctggttttgctcatagagttagaaacattatcagaaaatacatgtatttgagttaaattttagagagtgagtagaaattcatcgggtctacaaggaggcaaagagctttcctggatgaaattcctccttggcgttcacctaaaacttactaatttcttacagaacaaggataccacgggaggtgggtgccgcagaaccagggaactgtgtgtctgagtcaagatactgcagagaaatagaaccaatatgatgtgtgtactgatagaaagcacatttattttaaggaattttgctcatatggtgatggaggctggcaagtctcaagatgtatggggtagaccagccagctggagacccagggaggagctgatgatgtagttggagtccaaagtccatctgttggcagaatcccttctggctcaggtaacattagtcttctgttctagtcagaccttcaactgattggaccaggcccacccaccataggaaggacaaattgctttactcaaagtgtactgatttagatttttttttttttttttttgagacagagtttcactcttgttgcccaggctggggtacgatgcgatctcggtgcgatcttggctcaatgcaacttctatctcccaggtttgagcaattcttctgcctcatcctcccgagtagttgtgattataggcacacaccaccacgcccagctaatttatttttatttttttggtagagacaaggtttcaccatgttggccaggctgatctcaaactcctgacctcagatgatccacctgcctcagctgcccaaagtgctgggattataggtgtgagccactgcacccagcccagtcttttgttctattatgaccttcaactgattagaccaggcctacccaccaattcctttactcaaagtctcctgatttcgatatttatctcatttaaagcaacctcaaagaaacacccagaagaacatttaatcacatatgtgggcaccatggctcagccaagtggacttataaaatcaaggatcaagggtgcctcagaacaagagtacccagacagaacacaagttgggcagtatttcaagaggcaggggaagccatggaagctgctctgaggggacttgtgatcaggtgtgtatgttagggaggtcactgtggcagcagggtatagggtagactgcaggggtcttgtggcctctgtctctgtcacaggccaagtcatattcaaatttataaaattcaaaatttttacatcattaatttgaaattttattaaataaatacagtatatatatatatatatatatatatatatatatatatatatatgcttctttttatatactttaagttctggggtacatgtgcagaacgtgcaggtttgttacataggtatacatgtgccatggtgggttgctgcacccatcaacccatcatctacattaggtatttctcctaatgctatacctccactagcccctgaccccctgacagaccctggtgtgtgatgttccccaccctgtgtccatgtgttctcattgttcaactctcacttatgagtgagaacatgtggtgtttgcttttctgttcttgtgttagtttgctgagaatgatggtttccagcttcatccatgtccctgcaaaggacatgaacccatcctttttatggctgcatagtattccatggtgtgtctgtgtaccacattttctttatccagtctgtggtcgtatagtatttctggttctggattcttgaggaatcgccacactgtcttccacaatggttgaactaatttacactctcaataacagtgtaaaagcgttcctatttctccacatcctctccagcatctctcgtttcctgacttttttagtgatcgccattctaactggcataagttggtatttcattgtggttttgatttgcatttctctaatgacccgtgatgatgggctaaaaattcagagaaaatgtaataaaatgtttaatctagctcaagtatccttcctttgttgaatcagttttcaccttttctgtctttcctgctggctggcttgctggagcccgctctcatgagtggtgcaaggtcagagatagaaaaccaggcccatgtatggttgtgtcttttcacaagttcagccttttattgatgctatttcagtttacagaagccccaagatgcacggagttttcaaggaggcaattctccttaggacttcccatttagtactgaaatggcttgagcccttggagtactggagcctgtgtgccggcagcatttagtcagagctacaggcgcacaggctcctgctgtgacccaagtcagtcagtattgcaacctatacatactaatacacttcaccaatatatgcatgttatagattaaacattctacatcaaacaacgtaacatttatcatcaagagaaaaggggtaggaaaaagcttaacaaaggagcacagggatattgatgtggacaaaaaaaagtctcctggcctggccctggagggccatcagtggtcgccatcttgcaaggaagagcctttgatatcagtggggcagagccttttgcggtggatgctgcgtaatgattacaagtgacagcaagatggcatctgttaaggtagccatttggagctgctgaagccctgttctttcatgaccacagagtcctctggtgaggattgacaatggaagagggtgtttggttgtgtccttaactgtttggatgtggtctttattgatcaggtgaacatctggctcctgtaggcatgatgccttttgaatgaaatgtaacatggaatctttttctaaggtggagtcacttatgtcaagcgtgctctacacactcactgtaagaattaaagaggaaagaagcatgaaatgtcacttgacagttaaacacaggtttattttagagaaacctgagaggggcttctggctgagttaggtcagagctcttctctcttatagactaagcacatttaagggttttggaagggggtgcttatcataggttcagaatgtttgtatgtgagggagagtttattgcagggttgaatatctctggtcagaggggaggctgtctcagggttggtatgtttttggtcggagacgggtttatcttagggttggaatgtttctggttatgctgacatgagtcatgaggctgatgttttcgggctggatttaggcggtttttaatcaaggggagcctagaatggtggtgtttgttcaagatggccatgctcccgctctgtcacccacaacctgaagaccgttatcatattgattttgtatctcctgtgcgtacctgatggagaatgactgaatgtttgaattaaaagactcagggagaaggcaaagttgtgtttaagttgcaagttgaaaaaaacaatccattggctctgttagcagctattagagaggttggggcgggagcagagtctgtagcttaactttgcttttgttatgtcgatgctatgagcgtgggaatcatggaaactgtgaataaatggaagagagtctgtcagtgacctactgctgcatcttgggccagcccaggcatccgtgagtgttcagggagacctcgggagagttctcaggcagaaactagccactcacatgcttgtcatctgcggggttgacatggtgggctatttttatgctcagacacttgggagaaagggcaggctgtacccaaaggcagataagtgctggccagatgggcttgctgggcaccgtcgaactcatggtcaccgtcctgcccaggagctagaaatagaactagccccgggacaatccgtgaggtatcaggtgagtatggcccgatacatgtgactcagagacacaaggagtgagggtgtgtgctctgtctcaatgagagaagagagaagtcagggcttgctttggcaacaccaaatgcagatatcagactcctattcagaaaccagaattctcatctcagcatttattttctggatatgtggccgacagataggcatctctgtttataatgcctttaattttgatcttgacaaggactagaggaagctcttactgaaccttcacgcccacaaacaaaagcttctaaatcggccgggcgaggtggctcacgcctgtaatcccagcacattgggaggccgaggcggacagatcacctgaggtcaggggtttgaaaccagcctggccaacatggtgaaaccccatgtctactaaaaatacaaaaaattagccgggagtggtagcgggcatctgtagtcccagatacttgggaggctaaggcaggagagttacttgaacccaggaggtagaggttgcggtgagctgacatcacgccattgcgctccagcctgggcagtaagagtgaaactccatttaaaaacaaaacaaaacaaacaaaaaaacttctaaatcacattcaggaagcattttgtaatattttatttcttatcagggagcattttgtaatattttatttcttctcaacccctgtagtggattgaatggtgcctctattttacccccacccccaccaaaaaaaaaaaaaagacaagttcaccttgaatctgtacatgtgattttttatttggaaataaggtctttgcagatgtaaaaaaggatctggagatgagatcatcctggattgcagtggatcctaaatctaatgacaggtgtccttgtaagagacggaagaggagacacagacacagaggagaaggccacgtggagacggaggcagagactggagtgatgcggccataagcccagggatgcctggagcccccaggagctgggagaggcaggaagaattcttccctagagcagggagcatgtccctgtaggcacctcgatttcacagatgtagtctccaggactgggagaggttaaatggctgcttttgtaagctccctagtttggggtcatgggttacagtggtcccatcccaacctgtaagctctggagaacatgagtctggaatgcaagcgtgtgcggtgattcagcttgatgcctgtggtgggaaaagagccccttgtattatggcttcctgctgtgtgtaagtaaaaccagtcctctgaggaaatcaaagcccagtaaacccgtgcaccctaacttcccaggatcgcaaactggagagagagcggcagccattttctccccctgccttgatttgctgaacctgccacccgtgcagcatttcccaggaggctaacctggtgatattgtccattcttggtcctccgcaatgcaggcaatattcgttgctcagctcaaatgcttgcgtctcctctttcttctctccacctgcaaaacatcttttcataggtcccattgggaacaccagctcgttggctggtatttccacactctttttccttccttttgttgcttcatctacctctgatttgccagttgtctgatgtctcctctcacgagcctatctttctcccaagcctagtagacacgaaccattgaaagcatccttgaatgacaaaagtccaaatatcaatttgcaaggtgaagactgtggcttttattatttgttctcaatggcgggtgtctggcggggagtccagtcgcctgacgttgaatgcagtcatttcctaggtgtgggtcaagattctgatgtccacaggcaataatgtccgtgaacgtgtgtatgtaccttgatggacattactgactgtggactccagaacattggacattgtatatattgatggacatcatatatatatatacacacacacacacagacagacgcacacacacaccatggaatactacacagccacaaaaaagaatgaattaacagcatttgcagtgacctggatgagactggagactattactttttttattattatactttaagttctggggtacatgtgcaggacgtgcagtttttgttacataggtatacatgtgccatggtggtttgctgcacccctcaacccgtcatctacattagatacttgtcctaatactatcactcccctagccccccacccctcgacaggccccagtgtgtgatgttcccctccccgtgtccatgtgttcttattgttcagctcccacttatgagtgagaacatgtggtgtttggttttctgttcttgtgttagtttgctgagaagaatggtttccagctttattaaaagtcaggaaacaacagatgctagagaggatgtggagaaataggaatggttttacactgttggtgggagtgtaaattagttcaaccattgtggaagacagtgtggggattcctcaaggatctagaaccagaaataccatttgacccagtaatcacatgactgagtatatacccaaaggattataaatcattctactataaagacacatgcacacgtatgtttattgtggcactattcacatagcaaagacttggaaccaacccaaatgcccatcaatgatagaatgtataaagaaaatgtggcacatagacaccatggaatactatgcagccataaaaaaggacaagttcatgtcctttggagactattactctaagtgaagtaactcaggaatggaaaaccaaacatcgtctgttgtcactgatacgtggaagctaagctatgaggacacaaaggcatgagaatgatacaatggactttggggacttggggagagcttgggagggggcagcgagggataaaagactacaaatagtgtggaatgtgtactgcttgggtaatgggtgcaccaaaatctcacaaatcaccactaaagaacttactcgtgatcggatgtggtggctcacacctgtaatcccaacagtttgggaggctgaggcgagcggattaccttaagtcaggagttcaagaccagcctggccaacatggtgaaaccctgtctatactaaaaatacaaaaggaattagccaggcctggtggcacacacctgtaatcccagctgcttgggaggctgaggtaggagaattgcttgagcgtgggaggtggaggttgcagtgagccgagatcatgccactgcgctccagcctggctgacagagcgagactctgtctcagaaaaaaataaaaagaacttacttatataaccagatactgcctgtaacccaataagttatggaaaattaaagaaaaacacacaaaaagagtatattcaggatcacttaagtaagcatgatactacatcacatctcgttgcggaaattatatggattatcattccatgagtgtaccagcttccggaagtttctgagctcatatggggagtgggaagtaggtggtctcgtgggaactgcagggctggccccttgtcaggacggtcatcactagtgacataaataccccatggtagagagagctggggtgtcttcgtcggttttgtgtcactagaaaggaacactggaggctggataatttatagaggaaagaggtttatttgggttatgattctgcaggctgtacaagaagcacagggccagcatctgtctctgctgaggacctcaggaggcttccactcatggtggaacgggaaggggagctggtatgtgtacagagaccacacgaagagacaggagggaagacagacgggagacgccaggctctatttaacaaccagcctgtggagaactcatagagtaaaaactcactcatgcttcaagaaaggacattgatctcttcaggaagaatccatcgtccgttgctcaaacccctcccattcgacctcccatccagcactgaggcttacattttaacctgagtttgggagaggaggaattttaaagcagagcctgtagattctaaagcaaaatattctgggtctcctgcttgtagaatggttgtgagtgtgacttcctttttctatttttattttatttttttgaaacagagtctcgctctgttgcacaggctggagtgcaatggcactgtctcggctcgccgcaaccttcatctcccaggttcaagcgattctcctgcctcagcctcccaagtagctgggattacaggcgcgcaccaccatgcctggctaatttttgcatttttagtagagacggggtttcaccatgttgaccaggctggtcttgaactcctgacctcgggtgatctgctggcctcggcctcccaaaatgttgggattacaggcatgagccaccatgcctggcctgggattgttatttctaaatgattccagctttttttttttttttgtctcagctgaggcacagcggtggaacttgtcgtcttatcattgacttgttatgttcatgaaggacttggaaaaccaacgctgatcctcagagtaacagcatagatcctcacaagacagtctatgaagctggagccccctgggttgtaaaatgcctccgcaccccgtctctgtttctgaagaaggaagctctgctgagcagctaaacatgacgtgcttgttaagtgtgcattggttaaagaacagatgaaggtacaggctcagtctccaaaacttcattatacaatctcacagatgagtagcaccgttcagcattgagtgacacctactttcccgtctccaggtggttagatatcatcatctccaatttaaggcccatctaagaggtgcaccttttctcgatcctgaggctcaagtgtctaaacagcaactgtaaattttctccaatcagtgtttctcccctgtgtggaaataaattcgcatccttgaagttcagctctctccttcattttacaaaaaaacaaaaaacaaaaaaacttgttttaagcaagattaaaagtgaattttctattagcagtaattttatatcactccctgtcttgcttcttttgcactcactgaattgaagagaacgatatgaaattgcctggaaataaaaatgaaagtgcttctcagagccaaacaacactactcgtgtgaaagaatatagaatgaaagtttgaagtgtccatcagtcctgaacctgggatgatcctgtcctgatatccttaacgagaatgcatctaccaagaccctattcgcaaatcagttcacattcacggtgtttgggggttaggacttgggcatgtcattacgggaaatagctttgttggcttttctggttttacatagaaagagcaataaaggtcagccgcggtggctcacgcctgtaatcccagcactttgggaggccgaggtgggtggatcatgatgtcaggagttcaagaccagcctggccaacatggcgaaaccccatttctaatgcaagcagggcttaaaacctagatgacgggttgatgggtgcaggaaaccagcatggcacatgtatacctatgtaacaaacctgcatgttctgcatatgtatcttgcaacttaaagtaaaataaatctatctatctatatctatctatctatcttagggctgctgtaataaacgaccacacacttggaagtcttaaagccacaacaagtttattcttttccagtcctggagaccagaagtctgaaataacgatgtgggcagtactgtgcttcctctggaggctcacttgaacctgggaggcagaggttgcagtgagccaagatcatgcctttgcactccagcctgggcaacaacagcaaaactccgtctcaaaaaaaaaaaacaaaacaaaaaacaaaataccgtgaatatgttctctaaattaatctcacagcatgggagaaggtgaacaggataccccagtactgatgacaagtattatgggatggaaaagagaactggcattcttctttgctggcaacacaacctgtttttgttgatgtgaaggcagttaaccttgttgctagataaatgttactgcagatgtctgacgtaatgagaatgcgttatccacagcaaaatgcttttgaaaaagaaactgcagggaacttcacagtgagtgactaagactcactactgcagtctggcgtggtggctcacgcctgtaatcccagcattctgggagggtgaggcaggcggatcatgaggtcagtagatcgagaccatcctgggcaacagggtgaaaccccgtctctactaaaagtacaaaaaaactagctgggcatggtggcgggcgcctgtagtcccagctacttgggaggctgaggcaggagaatggcttgaaattgagaggcggaggttgcagtgagccgagatcacgccactgcactccctggtaccagagcaagactctgtctcaacgacaacaaaaaaacaaaaacaaaaacaaaagcatgatattaaagacactgtgctccatgactcagaagttgaaagagctactttgaatctgcaaatgatacctccatggatgtcgcctaagttcatgaaagatggaagcatagtgacagtaacaataatttaagaaggtttgaaaggaaaatcttggggtccccaaatcactaagctcaagggaaaagtcaagctgggaacttctcagagcaaacttgcctcccgttttattcaaagttactcctggccaggtgcggtggctcacgcctgtaatcccagcactttgggaggccagggcaggcagaacacgaggtaaagagatcaagaccatcctggcctatatgatgaagccccatctctactaaaaatattttaaaaactagctgggcatggtggcgggcacctgtagtcccggctactcgggaggctgaggcaggagaatggcttgaacctgggaggctgaggttgcagtgagccgaggtcgcgccactgcactccagcctggtgccagagcaatactctgtctaaacacacacacacacacaccccaaaaaaataatgaatgcaaccatttgtctcttatccacctatgacctggaagccccctccccacttcgagtcgtccccgtgtttctggatggaaccagtgtacctctcaacatatattgattgatgtctcatgtctgcctaaaatgtataaaaccagcgtgtgccctgaccaccttgggaacatgtcgtcaggaccacctgaggctgtgtcatgggtgcgtcctcaactgtggcaaaataaatttttctttttttttttttttgagatggagtcctactctgttgtccaggctggagtgcagtggtacgatctcggctcactgcaacctccacctccctggttccagcgattcccctgcctcagcctcctcaatagctgggattacaggtgcccgccaccatgtccagctaaagttttttttgcatttttagtagagacggagtttcaccatgttggccagacttgtcttgagctcctgacctcagacaatccgcccgcctcgacctcccaaagtgctgggattacaggcgtgagccaccacgcccggacttaactttctaaattaactgacaccatctcagatattcagggttcacaaaggcttggaggggcctgcaaatatatacaattatagaattaaatagtgatggatagagtcccttattcaaaaatactgttataaattaagttaaaatattaaagtcaaagaaacttcacacccataatcgcaatgctttcagaagatggaggattattttgagctcaggactttgagagcagcttgggcaacacagcaagatgccatttctacaaaaatttttcaaaaatagctgggcatggtggtgtgtacatgtggtcccagctactggggaggttgaggcgggaggatcacttgagcccaggagtttgaggctgcagtgagatgtgctcaaatcactgcactccagcctggctgagagaccaagaccttatctcttaaagaaagaaaataggcggctgggtccggtgactcacgcctgtaatcccagccagggcacgcgaatcacctgaggtcaggagttcgagaccagtctagcgaacatggtgaaactccgtctctactaaaaataccaatattagccaggcatggtggcaggtgcctagaattccagctacttgggaggctaaggcagggagaatcacttgaacctaggaggtggaggttgcagtgagccaagatcatgccattgcactccagcctgggtgacagagtaagactgtgtctcaaaaaaaaaaagcatacttttgagttaaaacaacagaattaccattcaacccagcaaccattcctgggtacatacctaaagaaataccaattattctaccgtaaagacacttttgcacatgaatgttcattgcagcattatttgcaatagcaaagacatgggaattaagctagatacccatcagtggtagactgggtaaagaaaatgtggtacatgtacgtcgtggaatactgtgcagctgtaaaaaagaacaagatcttattattttttgcaggaacatggatggagctggagatcattgtccttagcaaactaatacaagaacataaaagcaaatatcgcatgttctcacttataattggaagttcaacattgagtaaaggtggcctcaaagaaaggaacaacagacattggggtctgcttgagggtgaagggtgggaggagagggaggattaaaaagctgcctattggccgggcgcagtggctcacacctgtaatcccagcactttgggaggccgaggtgggcagatcacgaggtcaggagttcgagaccagcctggccaagatggtgaaaccctgtctctactaaaaatacaaaaattagccaggcagagtagcaggcatctgtaatcccagctactcgggaggctgaggcacaagaatcacttgaacccatgaggcggaggttgcagtgagccgggatcgcaccattgcactcaagcctgggcggcagagtggcactctgtctctactgcatatcagatattgtgctgattatgtgggtgacaaaataatctgtacaccaaactcccatgtcacgtaatttgcctgtgcaacaaacctgcacatggactcctcccgaatctaacatacaagtttaaaaaaatacatgtttgtacagctgcaccacgtgtgtatgtgttttaagctatgtgttatgatgactcaaaaacgttcaaaaaattaaaaggtgttaaagttataaaaaagaataaaatgcatcacacttttcaaatcatgaaatacctttttttacccatcgtgaatgtaaacattgacaccaatgggaagcttgagtattgtgtccattttacagggcaagaaaacaggggaatgggtaaatagcaaaacgagcaaagaaatgagtaggcaaaggcccatcacctatttctttgtggatgtctttgttgaactttttttcaacaaaatgaaaccaagccccctgattgttagttacctcacgcccatagtcttggccagtgagtcttttcgtaaaatggtactcaccgcagagtacattctgaatacacgttagacaacgatgaccaggaaaattcctgagtttttgatcgatcacattcctggccaaatcagatggatatttaagacctcagtgtgccctttgcaatcttgcaactcctgctttggttctctggaagaaatcttcttgtcgaagattcttactaaaactcaatgggttaaaatgcaaagatcttatttgttgcatagaatcaagactctgggtcaatacctggcagagtgactggaggctgcattggggtggactgtttttagacggcaggtcaggccccagagagaggtagttgggtgggaaacataagtcctatttctaatgcacagttgttgtgcctcctctggatatccaaatgtttggcacaatctgttttcctagaatcccagctgacatagagcagctaatgctcacatactgtcatccagccagtggctcatttagccaattaacacgctgatttcaaaagcattgtgaaaatatcactgcacacactaactagcttctgaccatcccttcccttcccttcctggcatatttctccagcgtaatctctgctcatagcctttcttacgagctacccacacccttgagcttcacaggacccattcagtctgtttgtgttttctccccgacctttcagcaatgtcaccatgatcttttcaagaatctttttctttgcttctcctgacaaatgcatcatccttctgagcaataaacagaggaattggcaaagttaataatgtcgttattgagcacttagtgaatggtgagcattatgctaagactgttttgtggtgtatccatacaccattccaacgatatatattttttaatttaagcatactttattggtaaacaatactaacaattatctgaacatttcgcgagtcaaaaccttattgctggtggagagtcttgcctcaatgttgctggctgtggactgatcagggtggtggttgctgagggtagagggtgctttggcaatttcttaaaatagacaacagtgatgtttgtcacatcagttgaccctttctgtcatgaaagatttttctgtatcaagcgatgctgtttgatagggttttacccagagtagaacttttttcaaaattcgagtcagggccgggcgtggtggctcacgcctgtaatcccagcactttgagaggccaaggcaggtggatcacctgaggtcaggagtttgagaccagtctgaccaacatggtgaaaccccatctctactaaaactacaaaaaaattagctgggcatggtggcgggcacctgtaatcccagctactcggcaggctgaggcaggagaatcgcttgaacctgggaggtggaggttgcagtgagccaagatcgcgctatggcactccagcctgggcaacaagagcaaaactccgtctcaaaaaaaaaaaaaaaaaaaaaaaaaaaaccaaaaaaccttcctgaaaggattcctcattctgaatgccatttagaaccttggtgattcatggcaggaagttaagatatccacattaacagaaatcgggaaaaagtgaattccaatattcatgaatgacattgagggggttcaagacttcagtggaggaagtcacttctgctatggtgaaaatagcagaagtaaaggtgcaggttgaagatggggctgaactcctgtaatctcatgataaaactggaatggaagaggagtttcttctcatgaaggagcagagaaaatggtttcttgagatagatactattcttgggcccatttcactgatgagaaaactgaggcctctccaggttgaagggtacaactaccaagtgtgggagtctgggctctaccccattactggacatctccagagcctgttctcccttctgctaagtttgcgggtcgctcaacattgtctccttggacgtgtgataagtcttcctgctcctccttcatcagtctttaacatttgagagacatttagagtggcctggaccaggctctttgctcattctcttttcttctactgaggcctctttcacaagtaggttttctcatctctctcttctttcatttattctctccttcattctctctttctcattctcttattctctctccctgtcttctttcctcttctcttccctcctcttcccctcctacttcttccttcccctccttctcctgcccctcatctcctcctacttctcctcctccttctccttcttctccttcatcttctttcgtttcttctccttccctttctctcctcctccttctccttctccctttccttcccttcccctctcttcccctccccttccctcccctcccctcccttcccttcccttttcttttctttttttttttctttcacggagtctcactctgttgccaggctggagtgccgtggcgcgatctcagctcactgcaacctctgcctccccggttcaagcgattcttctgcctcagcctcctgagtagctgggattacaggcatgcaccaccctgcccagctaatttttgtatttttagtagagatggggtttcaccatgttggccaggatgatctcagtctcctgacctcgtgatccacctgcctcagcctcccaaagtgctaggattacaggcatgagacaccgcacctggccccttctactttttttttcccttctccttcacctcctcttccccctcctcctgcttctcctcctcctctttcacctcctcctccttcctttctcctcctcctccttcctttctctctgtctctctctctctctctctctccctccctcccccccccccccccccccccgccgtctctctgcttctctctcattcactctcattgacgtccatatccaaatttttggaatcgcagtgctgccctcttagttctttgtcatgaaccatctgttgcccttggattgttttaccttttgtatccttggcagcttgacatacccatggtctaagcaagagtgttttctctgaaagtgcaggcatgagctgatacttgtgtgtttcatccattatcagcactgttttatgcatgtaaggagggtgtgtggcatttgcttcgtgggttgtaggaagggacacccaggaaacaaacaactaaagtgaagctttcctgcgggctaggatttgaaggtcatactaatgtccttcgagagagttaatgtcaagaattggtgtgaccaaacagtggtggatgtcatagtgttttcctcttttcataggttcacttttcaaatgagacagtagccatgagggaccatccatgcaggctgagactagtcttcaggaaaatatctatgcctagtagtttcagaaaggttagggttgcatagatgtacccacctgtccatcctgatccttactctaaattcgacctcttctatcattgctttcaccatcactgtcttgttggtgatgggcccagcttcgagaaactcagatctgcctcagtgctgctggagctggagagctggaagaaaaccaatatggcgtttgaaccgcacaatccaaaagtattgtagcagcactgattcataggttccttctcagtagaacctcttttgaattcctccaaacaaagccttctatttgagccatggcccttgagtagaccgatgtcatggactattagagtatgctattggtgctccagctacccatggccaaccaccaggcattacttaggtagagccccactgcctggcctatgcaccaggcatcaacatgaggtttcataaatacctgggagtacaagtgcagaatctctgttgaaagaatgcaatactctttttatttcttcaccgaataattaaataatttttatttcttcattaaagggcaattgaagagaagacaacatgtctctcttagtaggtaccatccccgagtagaactcatcctcctctgtgcaaagattcccattgttcagatcactctaatgctttgaggaaaacctccccacagtgtaacatacagaacactcttccgggggttatggcagatgctggagtctcttctaccaccacctaaagatgctggggtactctgcaacaccacctgaggaaaggaacaggatgaaacacctgttgtattagtcacctagggctgccatgacaaaatactacaggctgggccgcttaaacagcagacttttattttcccacagttctgaaggctggaagtctgtgagatcaaagtgtgggcagggctggttcttcctgaggcctctctgctgggcttgtagacaccgtcttctccctgtgtcctcatagggtcgcccctctgtgtgtgtctgtgtcctcatctcctcttatgaggtgtcttagtccatctcaggctgctatcacagaataccatagactgggtgacttataaacaacagacattgattctctcacagtcctggaggctggaagtctgagatccaggtatgggcagggctggttcctcctgaggcctctctcctgggcttggagacgccatcttctccctgtgtcctcacagggttgtcccaatgtgtgtgtctgtgtcctcatctccttttcttatgaggtgtcttagtccatttcaggctgctatcacagaataccatagactgggtggcttgtaaacaacagacgtttattctcccacaatcctggaggctgtaagtccaagatcaaggtgtaggcagggctggttcctcctgaggcctctcttgtaggcttgtagatgccatcttctcactgtgtcctcgcagggtcgtcactctgtgtgtctgtgtcctcatctcctcctctttttttttttgagacggagtctcgctctgtcgcccaggctggagtgcagtggcgggatctcggctcactgcaagctccacctcccaggttcaagcgattttcctgcctcagcctcccaagtagctggaactacaggtgcgtgccaccatgcctagctaattttttctatttttagtagagatggagtttcaccgtgttagccaggatggtctcgatcacctgacctcgtgatccacccacctcagcctcccaaagtactgggattacaggcgtgagccaccacacccggcctcatctcctcttcttataagcatcccagtcttctcggattaggggcctccctggtgactttgttttaccttaatcacctctttaaagactatctccaaatatggtgacattctgaggtcctgggcgttagggctttaacatagggatttgggagaaggaatcagcccatcacagctgtgcattctaagactccagtgactttgtgctgacaatggcttttccttgggtagctctaaccagatggtctggctgggtctatcttgagtctagtgactcccaccacgaggccaactgagcagggtggccaggaaagcctgtggccttacaacaaggtgatgctcacctgcagcacacaggccatcactgtagctctgctggctttattcttgggtttatagtgatggcttctttctgcctctgcctcccttgaggcatctcgtttctgtggttggagtactgtgagcctaagagacagagagcatgtccacagtcaggcttcccttacttgcttcagtagcatctcatgagtgtttccaatgcattcagggagactcttcttcactgaaggagtcagatccattttgcagctttgctgcttggaaccttgatggaatggctgagtacatggccgccagcgtcactcatgcacgaaaagtgttgttgaaagctaatagaaactgaaatctggtcgggcacggtggctcacgcctgtaatcccagcaccttgggaggctgaggcgggtggatcacctgaggtcaggagtgcgagaccagcctggccaacatggcgaaaccccatctctactaaaaatacgaaaaattagccgggcatggtggcaggcacctgtcatcccagctactcaggaggctgaggcaggagaatcgcttgaaccctggaggtggaggtttcagtgagccgagattgcgccattatactccagcttgggcaacaagagtgaaaatctgcctggaaagaaaaaaaaaaaaaagaaaaactgaaatagaagatttcccttcccccagttcactttgactgcgctaaagtaatttcctttgagggcagagaggacacggattgctttgggcatacttcaaaatgctactgtctccctaggaatattgcaaagtggttactttcccccaataacacacaactggatatttctttgatcttcaccctgggaacctggtggagctcccggaggtaaaatttgtgaaagtacaaggtcccctctaagatgggcccccagaagtttttctgttgttgttgttttttgagacagagtctcgctctgtcactcaggctggagtgcagtggtgcgatctgggctcactacaacctccacctcccagggtcaagcaattctcctgcctcagcctcccgagtagctgggattacaggtgcctgccaccacgcccggctaatttttgtatttttagtagagacggggtttcactatgttggccaggctggtctcgaactcctgacctcaggtgatctgcccgccttggcctcccaaagtgctgggattacaggtgcgagccaccatgcctggccaggagtttttaacttacttaggcttgtccactgtcagcctgcagctgtttaataattaccctgcaaatgtgtccatcaggtgctggctccagcaggaactcctagacaagcacaattccacttgccacctgtctgtccagtcttcaggcagcatttcgtcttgtgatctctattttctgatggatcgcagagttgctgattttcagtatgttctgctctttgcctattgtgaggataggaattaaaatgcgcaagctctctacatgttagtgaagtggctacgttgtctggggtatataccctggggttcgtcattgggcatcaggaaaatttaggacaaagacacacacgaggagtttaggagtggaagtttaatcaggagaagagaaagagaaatggttttctctatagagaaaggggtctccgagcggaaaggaccagctggcaccaaatgtgatggattttatagtccagtttgaggaggcggtgtctcatttacatagagctcagagattggttccatcaagcatggcatttacatagcccacaggaaaggctggttgcccaccctaatcgtttatgcaaatgggctttgtagttggtcggggctctccgagagattggttccatcaagcatgacatttacatagcccacaggaaaggctggttgcccaccctaatcggttatgcaaatgggctttgtagttggtcggggctctcggtcctgtttttcttactttacatgtggctgacaaagaggagggaagatggagccactgtcttgaacgtgtctagtctctagttcctgctgggaagatggagccgccgttttgaatgtgtctagtccctagttcctgccgggaagatggaaccgccatcttgaacgtgtctagtccctagttcctgccgggaagatggagccgccatcttgaacgtgtctagtccctagttcctgcccggaagatggagccgccatcttgaacgtgtctagtcgttagttcctcccgggaagatggagccgccatcttgaacgtgtctagtccctaggtcctcccgacattcacccgtacaagctcccagctggcttgtgtatgtctgcagctcgacttgacaggctgttcattgttagaaaatgacttggggctgcttttcgttaaagagaaaagctgccgggcgcagtggctcacacctgtcatcccagcacttttggaggctgaggcgggtggatcattaggtcaggggttcgagacgagcctgaccagtgaaaccgcgtctctactaaaaaaaaaaaaaacaaaacaaaaattagccgggcttggtggtgcgtacctataatgccagctacttaggaggctgaggcaggcgaattgcttgaacccgggaggcggaggttgcaatgagcgaacatcacgccactacactccagcctgggcgacagagcgggactccatctcaaaaaaaaaaaaaaaaagaaaagaaaaaagccttgccgaggactcccatacccttactgtctgcctaagtgatttcttcttaactcctgtatcactggcagactctgagttgcctgttgggtggagtactatattgccgagtatcatgactgtattagatgtgagggagacagtgtgaataggacatggtccctgaagagcacagagctttcacctggggctgggcggagcttctgtcctatccagtgttatggaacccttgcaagcacaggtcaagcagctcaagggctggaagacgtgcacacaaaatccaagggcaacgttggaaagaggtttagtgtttcttagaaaaatgccagaaggctgaagaagtgggggccccgagcagctctgaagggtgtgtatgcaattaaactgaagccaaaggctgagagagaggagtgagagccgcctacggagctctgtgcagcttcatcataaactcacagacaggcttcatgcagcgccgtctcagtgcattcaatgtttggattccacatgcatgcgtcctcaacccccttgcaatgctgttctccttggagggaaatgggtccttcttaccctatcacatgcaggtatctggtctaccagataaatgtgtgagaaatcaccaacaaagcagaaattacttttaattacaaagcagagtcatcgtaaaactttgtgcaaaatctttttttttttttttttccagacagggtctccatctgttacccaggctggagtgcagtggtgtgatcatggctcactgcaacttcaacttccgaggctcaggtgatcctcacatctcagcctcccaagtagctgggatgacaggtgtgcaccaccacacccagctaatttttactatctgcttaagtcatttcttcttaacccctgtatcattagaggagaaaccggaagcccctatttttgaaattagtaaccacctatcacctaaaattcctctcattactgtgacgataatgatgattttttcgagaccggatctcactctgtcacccaggctggagtgcagtggtgtgactgtggctcacgacagcttcagcctcccgggctcgagtgatcttcccaccacagtgtctaaagtagctggggctgtaggtacgcatcatcattcccagctatgtatatattttaaatattttgtagagatgggatcttcctctgttgctcaggctggtcttaaactcctggcctccagcagtcttctcacctgggcctcttaaagtgctgggattacaggcgtgtaccaccgtgtctggccaaaaaacatatctattctggggttcatagtgatgcttgtttctgccttggcctgtcttgaggcatctcactcctgtagttggagtactctgagtgtaacagatggagagtatgtccacacccactcttccctcacgtgtttctgtagcatcccgtaggagttttcaaatgcatttggagatgtattcaccctgtgacagattcaatgcatctctacaaggcagaatagctctaccatggtgtggctatggcgcttggctacctgagtctttattctgccttccaggtgcttgttggttggataactttgggtaggttcttgtacctctttgagcttcaagactgtcttagtcagctctggctgttgcaagaaaatacagttgaccttgatacaaaaattagctgggtgtggcgcctgtaatcccagatactcaggaggctgaggcaggagaatcgcttgaacctgggaggcggagattgcagggagccaagatcacaccattgcactccagcctgggcgacagagcaagattccatctcaaaaacaacaacaacaacaacaaaaaactagagttgacccttgaacaatgtgggagttaggggcgtcacacacgtccctggcacagttgaaaatccaaagataacttttgactcacccaaaacttatgaatatcctattgttgagcagaagccttatcaataccataaagtcgattaacatatattttgtatgttttatgtattgtatactgtattattaaagtatgctagagaaaagaaaatgctgtttgtttttttttagccgggcgtggtggcgcacgcctgtaatcccagctactcaggaggctgaggcaggagaatcgccttataaggaactttgagaatcaaaaatcataaggaactttcattcttttttttttttttttgagatggagtttcactctgttgccctggagtcaggctggagttcagtggtgtgatctctgctcagtacagcctacgcctcccacgttcaagtgattctcctgcctcagcctcccgagtagctggcactaaaggtgcacgccaccacgcccagctaatttttgtatttttagtagagacagggtttcaccacgttggtcaggctggtcttgaactcctgaccttaggtgacctacccgccttggcgtcccaaagtgtggagattacaggcttgagccaccacgcctgataaggaacttttattctaagtgaagtaactcagggatgaaaaaccaacatcgtatgttctcagtgttacgtgggagctaagctatgaggacacaaaggcataagaatgataaaatggaatttggggtcttgggggggaagagtgggaggggggtgagggataaacactacaaatagggtgcagtatatactgttcgggtgatgggtgtaccaaaatctcacagatcaccactaaagaacttaggtaaccaaataccaccagtaccccaatcacttatggaaagataattaaaaacaaaaaaggacaccaaactaaatttttaaaaatcatagagaagagaaaatatatttactatttctgaagtgggagtggatcgtcatgaaggtcttcatccttatcgtcttcaccttgagtagcctaagatgagagcggacaggagggattggtcttgctggctccggggtggcagaggtagaagaaaatgcccgtagaagtggacccgtgcaattcaaacctgtgttgtttaagggttaactggaccatagatggggtggcataaataacagaaatttatttctctatagtactggaggcagaaatgtttacatccaggtggcaccatggttgggtacttgagaggttcctcttcttggtttacagatggtctcgcagggcagagagagaggggggtggagcacgagggagcatgtgtgccctggtgtctcttcttacaagggcacgaatcccaacataaggatcccaccttcacgacctgatgtaaacatcatcatctcccaaaggctccgtctccaaataccatcccctttggcattagggtttccacacatgagattcggggtgacaccattcattccatagcaggagccctccttggcagactgggacaccaacgcctcttccctcttgggctgacacgagctgtaaatgtcagtggacatttaaatactgcgttacacattcgatgtcctgtctgcaatggagccgggttctgtaaacataagctgccatggcgaaatcggatcatcatcgcccatcaagctctttggcagcagtgctgtaatcagtgcaaacatttatttatataaatgctcccatcccctcggcatgaagatatacttaggctctctcaatggacagccacgccacaagcccaggaatgagagcttgtcagatactgaggctgttttcagagccagtgttcggctgaagtggcacagaagctatcattgtttgcaaatctctgctgcttgtcaagccacagggttaagtaaccccggatgttgcgaacactctgaagtgctgacctgcagtgtctttttggatcactgagccctcaggcagacaggctgtacgtggaccgacacgtcatggctgctgtcttgcacttaaccctctttatctttagaccttgattgtgcacctgtttctcattggaagctaatgacaatccacgaagcggcttggcagtgactgtctctgattgtgtaaggaggggttgccacattcacccatgttgttgactttcaactgtacacttgaaaacgtcaaaagtcagagtaagcattgcctcatgtctccgagtgtagcaattctaggaaaactcttccgaatgggtttaaagtcaaacaaatccaatcaaaacagacttgcagggccaggcacggtggctcatgcctgcaatcccagcactttgggaagccaaggtgggcagatcacttgaggtcaggagttggagaccaacctggccaacatggcgaaaccccgcctccactaaaaatacaaaaagttagccaggtgtagtggtgcgtgtctgtaatcccagctactcaggaggattagggaggagaatctcttgaacctgggaggtggaggttgcagtgagctgagatcaccccactgcagtccagcctgggtgacagagcaagatcccatctcaaaaaaaaaaaaaagaaaagaaaagtccacatagggaaatatgtgaagctctttgggtcatatgatcgctaccacaacagcgcaatatgtaaatgaatgggcaagttctgtgttctaagaatcttgagggacactgagatgtaaatgtatatatttatcacgtggcacaaaatacagttgacccggccgggcacagtggctcacaactgtcatcccagcactttgggaggccgaggcgggtggatcacctgaggtcgggagttcaagaccagcctgaccaacatggtgaaacccgtctctactaaaaatacaaaaaattagctgggaatggtggtgcgtgcctgtaatcccagctactcatgacgctgaggcaggagaatcgcttgaattcgggaggtggagattgcagtgagctgagatcacgccatcgcactccagcctgggcaacaagagggaaactccacctcgaaaaaatatgtatatacagctgacccttgaacaacacgggggttaggggtactgacctctatgcagttgaaaatctatgtataggttctgactcccccaaaagttaaatactggtagtgtactcttgaccggaagctttattcataacatagagtcgattagtacatagtttgtatgttatgtatattataaagtcagctagaaaaaaaatgctaaggaagagaagagaaaatattttactacttactaaatggaagtagatcatcataaaggtcttcgttctcttttttttttttttttttgagatggagtctcactctgtcaccgaggctggagtgcagtggcacgatctcggctcactgcaacctccgtctcctgggttcaagcacttcttctgcctcagcctcccaagtaactgggattacaggcacacgccaccacacctggctaatttttgtatttttagtagagacggggtttcaccatattggccaggctggtcttcaactcctgacctcgtgatctacccgcctcggcctcccaaactgctgggattataggcgtgagtcactgcactctgcaggagtagggagaggagggggaggggaggaggagaagggagggggggaggaggggggacgaagagggaggaggagtcatctcgggtgaaagtccaaatgggtgaatctgctcagttcagatgtatgttgtccaacagtcaactgtgttatccttcttttgattttttttaacccactgtttaaaagatgtggaaatagttttttggtttacaaggtgcacaaaaataggcaaggggctggattttgctagagggctgcagttgaccaaccccgggttagaccattaccattgtcagtgggcacacaaagtaatgaaattattatagaaaacatgaggcgttgtttactggaaaggggtcttgatcctgaccccaagagagggttcttggatcttgtgcaagaaagaatttggggtgagtccatagagtaaagtgaaagcaagttgattaagaaagtaaaggaataaagagtggccactccattggcagagcagcaccgagggctgccagttggtgatttttatggttatttcttgattctgtgcgaaacaagggaaagattattcgtgagttttctgggaagccggtgggcggttctgggaactgagggttcctcccctttttagaccctatagggtaacttcctgacattgccatgacatctgtaaactgccatgaggctgatggaagtgtcttttagcagcgaatgcattagagttagcgtataatgaacagtgaggaagaccagaggtcagtctcgtcgccatcttggtttgcatggggtttggccagcttctttaccacaacctgttttatcaacaaggtccttaggacctgtatcttaatgccgacctcctctcatgccagtggtcatgtgcattcatctggctggaagggtatctttttttttttttgagattgggttgtcactgtgttgcccaggctggagtgcagtggcacagccttgaccttctcagctcaagtgatcctcccacctcagcctcccaagtagctgggactacaggcatgcaccaccatcaccacacccagctgcttttttttttttttttttctgtatttttggtagacacgaggtttcaccatgttgcccaggctggtctcgaactgctaggctcaagcaatcctcctgcctcagcctcccaaagctctggtattacaggcatgagccactgcacctggccttcaggactatcttcagacacttgttgtagcctcttcatttctgcacatccctccccagcggagatgctctcacaaattgctcataaggaaatttcttgtgggctccaaaatctttcccctaaaacagagttctgttgaatttctccctgacaatgtaaattaacaacttgtcttcacaagtgtgggacaaagataagactagaaatgatctctccgcccaccctgagacaaatgcatgtttgacatcttcctcttctgtatgttgactttgtcttatgcaaaagtggatttactgtgcatgaaatgaacgcgtgattgactgttcctctacccgcactttgccatgtaaaatgtgtattcagagagtgccaatcaaagactcacaagaatgtaatcatttgcctcttttatctactctccttcttttttttttctttcctctttccctcctgcctgcttttttccctttctataccaaagccctcaaaaccatccttggaaaaagcacagggccgcacgcagtggctcacgcctgtaatcccagcactttgggaggccgaggcaggtggatcacctgaggtcaggagttcaagaccagcctgccaacatggcaaaaccccgtctgtactgaaaaataaaaaaaatagcagggcgtggcgttgcatgcctgtaatcccagctacttgggacagtgaggcagaagaatcatctgagcccgggaggtggaggctgcagtgagctgagactgcgccactgcactctagcctgggccacacagcaagactctgtctcaaaaaaaaaaaaagccaggcgcggtggctcacgcctgtaatcccagcactttgggaagccgaggcgggtggatcacctgaggtcaggagtttgagaccagcctgacaaacgtggtgaaagcccatctctagtaaaaatacaaaaattagccgggcgtggtgacgtgcacttgtaatcccagctactcaggaagctgaggcaggagaatcacttgaacccgggaggcgaagggtgcagtgagccgagatggcgccattgcactccagcctgggcgacagagggagactccgtctcaaaaagaaaagaaaaagcacggagcacaggtcctatggtgactggcgtctgtttttcctggactggggcacattctcaaccgtggcaaaattaacctctaaactaatggaggcttgcctcactcatcttctttgattcaaaactttgagttaatccatttatgcctgaagttgcaagtttttgaatttttgccatcagatcttggcgatgaccttgagcagtaggatataaataactccacatgcttagcattccaataatggaacactaggcatacgtgggtttaatcaaaggagagatcatctgtgctggacctgcctcaaagagggtgagatgaatgagtaattcttcttcttcaaataaacttgagatggtctcagagatccttttcctggtttttgttgttattattgttgttgtttttgaggcagagtcttgctctatcacccaggctggagtgcagtggtgcaatctcggctcactgcaacctccacctcccaggttcaagcgattctcctgccccagcctcccaagtagctgggattacaggcgcccactaccatgcctggctaatttttgtatttttcgtagagacagggtttcacccttttggccaggctggtctcgaactcctgagctcaggtgatcttccccacctcagcctatcacagtgctggaattacaggcgtgagccaccgcagccggccctttttgctggttttgaagaagcagactcccatatgacaagttgctgagggtgtcacagcaagcagagagccaccattgtctgacagccaaaatgaaaatgagacttggccgggcgcggtggctcacgcctgttatcccagcacttttggaggccaaggccggtggatcacctgagatcaggagtttgagaccactctttccaacaaggagaaaacccgtctctactaaaaagacaaaaattagctgggtgtggtggcaggcacctgtaatcccagctactggggaggctgaggcaagagaatcacttgatcttgggaggcggaggttgcagtgagctgagatcgcgaaactgcactccagcctaggcaacagagtgagactctgtctcaaagaaaagagagaaaatgtgactcaatctcacaaccacaagaagctgaattttgcctcccaattcagcatgcctggaagagcatcctaagctacagatgtcatctcagctttgtctgacaccttaattccagccttgtgagactctaaatggagacatcctgttaatctaaacccaatcttctgacttacagaactgtgagatcataaaggggtgttgttttttaaactactacgtttggggcgttttgttacgcagcagagctagctaagatggatggctccttaagcagctcatttgagggcagagggaggcaacttctgcagacagatgggcatctatattcgctaggttcaagctgttaatgctgctatgtatacccaaatgacctcactaccttctcaccaggcagcaagaaacaggatcctcagacgaacagaagtccaacaccttagtctaagtctgtttatgttctcctgataggaaatcttttcatctcataaaaagctgctgatgtaggcctttctcaccctgtaccccacgttactgatgcctgttttgttgccaaactggactggtgtccacttgcctggtgcacttaggtcaaacctccacaatgaggctttgcagcaagagaaaggatagtgtttatttggacagcaccaagccaggagactcaggcagctcacgcttaagacctaacgttttttttttttttattgaaacggagtttcactcttgctgcccaggctggagtgctatggcgtgatctcagctcaccgcaacctccacctcccgggttcaggcaattctcctgcctcagcctgctgagtggctgggattacaggcatgcgccaccacgcctggctagttttgtacttttagtagagacagcatttctccatgttggtcaggctggtctcttaactcccgacctcaggtgattccctcgctttggcatcccaaggtgctgagattgcaggcgtgagccaccgcacctggcctaagacccaatcttttcaatgacttccgagccatagtgtttcaagtcgggtaaatttcaggacagaagctgctccaggcaaaatcatgaggacgaagttctgatttttttatcttgcccaaattcctatctaaagggtctagggagtcattctttacaaaccatgagttctcattagatgggttttatttaaccctatatatcgtaacttactttccaatgtgactctggcataacataatgagacaaggaaaaacaatgtatttaaccccaaaatatatttccttgccataccttgaaattgccctgagaagtctcttgtgggaaaaatccacattctatagagaatagcctttcctccctccctcccttacctcctttacctcccttccttccttccttccttctccccttccttcctcccttctccccttccttcctcccttctccccttccttccttccctcccttctttcccttccttccttccctccattcctttccctctctcccttctttccctccctccctcctttccctccctccctccttccctccctgcctccctccttccctccctcattccctccttccctccctcattccctccttcattccctccttccctcccttccttccctccctcccttccttccctccttccctccctctcttccttccctccttccctccttccttccgtccctccctttgttcctttgttccttcccagatctgggacataatcaactgagagccaggcccccttttaggtctgataagaaacattttacaacctgttctctctgaagtctgctatctgagagcttcctgtgcaaaataaaacttggttcccacaatcctttatctccacctggacatttcctttctgttgattccaggtcttcagataaactcaaccagttgtcaaccagaaaatatttaaacttacctatagcctggcagcccccaggttgagttgtcccacctttctgaaccaaaccaatgtatttctgaaatgtatttgattgatgtctcatgccttcctaaaatatataaaatcaagctgcaccccgaccacctggggtacatgttctcgggatctcctgagggctgtgtcacgggccgtggtcactcatatttcgctcagaataaatctcttcaaatattttacagagtttgactcttttcatcaacaattataaatcacggctgggcgtcgtggctcatgcctgtaattctagcactttgggaggccgaggtgggcagatcacgaggtcatgagatcgagaccatcctggccaacatggtgaaaccctgtctctactaaaaatacaaaaattagctgggcatggtggcgcttgcctgtagtcccagctatttgggaggctgaggcaggagaatcgcttgaacctgggaggcggaggttgcagtgagccgagatggcaccactgcactccagcctgggcgacagagcgagactacatctcaaaaataataagtaaaaaaaaaatcataaatcaatacatggaagctatacgttggtttggcctaaaaagggatatcttgggccaggtacggtggctcatgcctgtaatcccagcacatttgtaggctgaggcaggcagatcacctgaggtctactagtagttcaagaccagcctggccaacatggtgaaaccccgtcttgactaaaaatacaaaaaattacccaggtgtggtggcaagtgcctgtaattccagctacttgggaggctgaggcaagagaatcgcttgaacctgggaggcagaggttgcagcgagccaagatcatgccactgcactccagcctgggcaacaagagcgaaactccatctcaaaaaaaaaaaaatatatatcttgaagctgggcccgagggtggggttgcttacaggaacaaggtggattcaaagacttttggacttgcaattggttaaggaagtggagctttgtctaagacttgcggtcagcagtaaaagcacattggatctggcccatgggcaggacctcctccaggaccctcaggaagaaatttaaaacaaggaacagggatcagagttcagtccctagctctcccacgtctgaggtcttcatgccagaggattccatagggtagaggtgtgagtttcttttattttttttaattatactttaacttctggggtacatgtgcagaatatgcaggtttgttactaggtatacacgtgccatggtagtttgctgccatccatcatctacattaggtatttgtcctaatgctctccctcccctagtcccccagtccccgaaagacccctgtgtgtgatgttcccctccctgtgtccatgtgttctcattgttcaactcccccttatgagtgaaaacatgcagtgtttggttttctgttcctgtgatagtttcctgagaatgatggtttccagcttcatccatgtccctgcaaaggacatgaactcatccttttttatggctgcatagtattccatggtgtctacgtgccacattttctttattagttgctctagggaagcgaacatccctgactctaatttccttggttgttattttaagctactgtgactttcttcttcatcaagttgctcattaacttctcccagccagcgaagtgcctggagtttccttcctggaaggaactcaagatttctcttgatttccatgcttggtcgggggtggagagagtttcctggtttgcccctaagaggggtccctgccaggtctcagttcctcaagctttctctttagcacctttagcagacagatactatcacagcttacagtgcttgcagcatgggtggtggcgtggggattttgatgccgttggattttccccactttttccattttgtgcccagaagcattactcttgaagcatttaaatttgaacacagtgggaaacagcttcttaggaattaagttttaactggtttccagtgtatctaaacagcagacaggtagacccttggtaacttctttttgatgtataaacaactcagaccattaaatcgacgctcattagcaacctatgctgctcatccaagctaccctgaagtttacttttagcccagtcctgtgggtggataatggtttcaacgcattcccaggaggacgatttacctccttggagacagaattgttcttgaaagctcttcacaagtccgcgtttccacggcaacatcaagattgacttctcgcccttgggtagtgccttgtcttcgaaagcctttctttcctctttacttacacaagctctttggggcatctgctctttgcctcgcgggtgggtcaatggtgctttcattttaatcttcttttctagactagacctgggagtcagaggacaactttaattatctgaacactttaccattctgacaacaatatttacagagtttatcctgaaggtggtttctgaggacagctgtgtatccgaggagcattgttttaacttgagttctctcgtagtgatgtatctcaagtgctcaagagggagaggagggccatcgtagtaaacacaatgaaaacaaaggcgtcacccacttatttatcccaccatgccaggcagctctctccccatctctctctttctctctctgtatgtctctctctctttctctccctctctgtgtcacaacctctgtctctctcattctattcctctctgtccctctctgtcactttctctgtgtctctcctctttctctctctctgtctctcgcttattctctctgtctctcagtttctgtgtctctctccttctgtctctctttttttttttttttgacacagagtgttgttcttctcattcagtctggggtgcaatggagtgatctcggctcactacaacctccgcctcccggattcaagcgattctcctgcctcagcctcccgagtagctgggattacaggtgcccgccaccacgctcagctagtttttatatttttagtagagacggggtttcaccatgttggccaggctggtctcgaactcctgacatcaggcgatccacccgcctcggcctcccaaactattgggattacaggtgtgagcctgtatctgtctctctgtgtctctctggcacactctctgtctctttcaagctctctttctgtgcttctatttctgtgtcacaatctttctctctgtctctttcctccctctgtctctctctttctctcccattctcaccctctctttctccataactttctctgtgttttgttcttttttcttcctctctcttgcttattttctctctctctccctctctctctctctctcacacacacacacacacatatacacacacacacagaataatctcgctgcagcgtctttcacagtaggtcttaggggcagatggatagctgcctcatacaaagaaaataggatttcaggtctccagagaggcgctccatacctgcataacgactaagagatactggtatttcacctttatttttaaattgataaatatatagaaatgagagacgcagggggtgacaaccaatctgccctccttcttggcaaattccggcagttcgggcacctgggttccttccctcctgaatgaagagaggccagaagccatcatgagcttcgtccctgctcaagactttgcaggctgtggtcgcatcagctcttggctccaagaactgggctttttgggtagcaggacggctgttgctacccacaagtgcgggaagaactgtcctctggctgcctggatcccggaggttctggcttaccaagacactcgtgaatttattaggatgcgtagggacggggcaggtgcagacggattcaggggctgtgttggctgttggtagatgcttgaaagctgttgctgctctgagctgaacgccttctccacaagcgctgcctcctggtctaaatgatgggtttttattttatattattttgagacagggtcttgctctgttttctaagctggagtgcagaggtgcagaggcataatcatagctcactgcagcctcaacctcctatgctcaagcagtcctgccacctcagcctcccacgtagctgggattgcagacatgcaccaccacactcagataattttttatgacttccttttgtagaggtagggtcttgctatgttgcccaggctgctcttgaactggcctcaagcaatcctcccacctcggcctctcaaaatgctacagtgacagggtgagccaccacacctggccatgatgattttcaaattagcccagttgggttacaaggttgactaagatctgattttcaggtagtggttatggacacacttatcacatttattctaggagctctttaataatatttcagaatggacagcatttctggaaatttttttcttagtattaaatacatttgcttttgtatgtctcagtggaagacttctttaagtttacatttttatgatttttttcttctgtatatataaatgttactcatcaagcaattcctgccctcctagcaaatttcttctgctatgcttttttcagaatttctatcagaacagcataaatttcacaaaacaaaccacctcagactctttttgtccaaccagtcagtatcagggcacttatctgttctttgaaagtctagaagaattttctaaaataccctctgcactcatctaccctttcttcatgccattctttcattattcttctctatttttcttatagctattggtctgattagacctaatttccttgattgaattgggataattagtatctctgagaaaattatttcctcgagattttcacattttacttacaaatgtaacatattatcaggatactaagaaacagaaacctatcattttaaagcttttttcatacagtacagtgtttcctatttgtaagtttgcatttcctgcctcattaaatatattattgacagtattttctgggaccttgtttctccttcttccttccttccccgtttccacccatcctttcctccttccctttcttccctcctttctccctccctccctttctttcttccctccttccattcattcttgcttccctcccctcccctccccttccctctttccacccatcctttcctccttcccccacaatgttgattttgttcatttctccctgcctacctaggaattcttgaaaaatatacttggatattgtgttattctgaagaaaatgctgtgaaaatggcacattatagcttcatctcaattcagcatttggtttatgattttcaagttagccctgttgggttacaaggttggttacacagatccaaaccatgccttcataggcgatgatcctccttgttccattaacgttttagacttcaatcattgctgtcttgtgtgactagggccatttctacttggtttttgcttgtttggctgataaatgtgaacgttttaacaattgttgaacaattgttaaaacaattgtcgaacaattgtcgaacagttgttttaacaattgtaattcctcctttttaatactctgtatctttaccatcaagatacagacatcacctttttcacaggctctgagtgtaggaggccaccattttggctttatatcatgaccagtaactgggagcgccctcgttggctgaagctgtacttcctgcttcttttctgttcttgccacatggataactggtatactccatcttattccatgagctacgtggcagacactcattttgtagctcctaggagtgcgttaaatactcccaaacactctaactttcatttctctaaattatctaaatagaatgaaggtatcgttgaaggtactccaggtggaatgaaaaaacctatctcaagtcttccggagatcctcctgtgttcggttccctggtccctctcatggtgccctgggaaagggacgcagctcctacatgggttaggttccaggtgaacgcagccactgagctcctagcaagtacgatttcctgtgtcctatgcgcagatcaccctggtgtcttggtccagtgggcttgaagcctcatactcttttgtttttccttgttttttattttattttttttatttttattacttttttttttttttgagagggagtcttgctctgtcgcccaggctggagtgcagtggcacaatctcggctcactgcaagctccgcctcccaggttcatgccattctcctgcctcagcctcctgagtagctgggactacaggcgcccgccaccacgcctggctaattttttgtagttttagtagagacagggtttcaccatgttagccaggatggtctcgatctcctgacccctcgtgatccacccgcctcggcctcccaaagtgctgggattacaggcgtgagccacccaccccccggccttgtttgttttcttttaaaaaaaatttcatgaggtacacgtgcagctttgttgtaagatacattgtgtagtgctgcggttcacgcttcagttgaacctgtcactcaaacggtgaacaaaatacctcataggtagagttttagcctttacacccctctccctcccctgctcttggaatgcgcaggtgtgccagcttcccatttttatgcctgattattcaatgtttagctcctatgtataattgagaacaagtggtatttaattttccgtttctgtgttaattcacttaggataatggcctccagctgcatctgtgttgctgctaaaaacatgatttcattcttttttatggctctatactattctacggtatatatgcagcaactacattttcttcatccaacacataattgatggacacctgggctgattccctcatgcctcccaagattgaatcaggaagaaatcagatccagaacagactcatttcatgacaagttatgaaattgaatcagtaatttacaaaaacctatcaatcaaaaaaaaaaaaaaaagccccaagaccagacaaattcacagctgaattcgaccagatgtacaaagaagagctggttccaatctgactgaaacgattctaaaaaattgaggcggagggattcctccctaacttattctacaaaacctgtatcatcttgataccaaaatctgacaaggacacgacaaaaatagaaaactacaggccaatatcccagatgaagatagacgcacaaatgctcaaccacatactagcaaacagaatccagcagtgcgtcaaaaagatgactgatcatcgaaaccttgtctctactacaaatacaaaaattagccaggcgtggtggtgcgcgtctgtaatcccagctacttgggaggctgaatcgcttgaacctggcgggtggaggttgcagtgagccaagatcgcaccactgcgctccagcctgggcaacagagcaagactctgcctcaaaaaaaaaaaaaaaagataattgatcgcaatcttaattgtgggcttcattcctgctctgctctttgtccaaagagatttttctgaatgtcaggggtgaagttcaagttctagcacccagtgagcattctgccttcccctgctgcagggcttgatgtatcggctcatcttcccctagtgatgccagccataccctgttccccttacccttcctaccagtgtttctcttggtgcgaggtagctcctgaatggatgcaaaaaaaaaaagatgctgattgcaagaatgagcaaagcccgttggttgcctgtattactccgttctcacactgctctgaagaaatacctgagactgggtaatttttaaaaattttaagttccgggtacatatgcaggattgtacatagataaacatgtgccgtggtggtttgctgcacctatcaacccatcacttaagtattaaagcccagcatgagttagctattctttttattattgtactttaagttctggggtacatgtgcagaacatgcaggtttgttatataggtatagacgtgccatggtggtttgctgcacccatcaactcgttatctacattaggtatttcttttaaagctatctctccccttgccccccaccccccaacaggccccagtgtgtgatgttcccctccctgtgtccctgtgttctcattgctcaactcccacttaagagtgagaacatgtggtgtttagttttctgttcttgtgttagtttgctgagaatgatggtttccagattcatccgtgtccctgcaaagcacatgaactcatcctttttaatgtctgcatagtagtccatggtgtctatgtgccacattttctttattcagtctatcaatgacgggcatttgcgttggttccaagtctttaatattgtgaacagtgctgcagtaaacacacatgtgcatgtgtctttatagtaggatgatttataatcctttgggtatatacccagtcatgggattgctgggtcaaatggtatttctggttctagatccttgaggaatcgccacagtgtcttccacaatggttgaactaacttccactctcaccaacagtgtaaaagcattcctgtttctccacatcctctccagcatctgttgtttcctgattttttaatgatcgcccttctaactgatgtgaggtggtatctcattgtggttttgatttgtacttcactactgagcaggcattagctatttttcctgatgctctccccctccctgacccccacccacaacacgccccagtgtgtgttgttcccctccctgtatccatgtgttctcattgttaagcacccacttatgagtgagagtgtacagtgtttggttttctgttcctgcattagtttgccaagaataatggcttctagctccatccatgtccctgcaaaggacatgatctcgttcctttttatggctgcatagtattccacggtgtatatgtaccattttttttaatccagtctatcattcttgggcatttgagttgattccacatccttgctattgtgaatagtgctgcaatgaacatatgtgtgcctgtatctttataatagaatgatttctatttatttggatatatacctagtaatgggattgctgggtcaaatggtgtttctggttctaggtctttgaggaattgctacactgagactgggtaatttataaagaaaagaagtttaattggctcatggatctgcaggctgtacgggaagcagagcagcttctgcttctagggaggcatgaggaaatgcataatcatagtggaaagtgaaggaaagcaggtgtcttacatggccctagcaagagaaggagagacagaggtgcagttggggtgggctggggagatgctacacacttttcaacaaccagatgccacgagaactcattcactattgcaagcacagcacccaggggatggcactaaactattcctgagacatccacccccgtgacccaatctccccctacaagggtccacctccagcactggggattccaattcaacttgagatttgaatgaggacacagatccaaaccatatcactacccatctatcaattcatccatccatctatccatccatccatccatccatcagttcatccatccatccatccatccattcatccatccatccatccacccacccacccacccatccatccacccacccacccatccatccatccatttatccatccatccatccatccatccatccatccatccatttatccatccatccatccatccatccatccatcagttcatccatccatccatccatccatccattcatccatccatccatttatccatccatccatctatccatccatcaatccacccacccacccatccatccatccacccatccatccatccatccatccatccatccatccatccatcagttcatccatccgtccatccatcaattcatccatccatccactcacccatcctctcatgtatccatccatcaatccatcgatccacccacccacccatccatccatccatccatccatccatttatccatccatccatccatccacccatccacccatccacccatccacccatccatccatccatccatccacccacccatccacccacccatccacccacccacccacccatccatccatccatccatttatccatccatctatccaatccatccatccatccacctatccatccatctacccatccttccacccatccatcaattcatccgtccatccgtccatgcatgcatccatctgtattagtctgttcttgcattgctataaagaagtacctgagattggatgatttataaagaaaagaggtttaattggctcatggttctgcaagctgtacaggaagcagagcagcttctgcttctggggaggcctcaggcaacttacaatcatgatggaaggtgaagtggaagccagcacgtcttaatggctagagcaggagcaagagtggaggggaggtgctgtgcacttttaaacaaccagatcttgtgggaactcattcatggtcacaagaacatcaccaaggggatggcgctaacccattcgtgagaaatccacctccatgatcccatcacctctccccaggccactcctccaacactgcggattacaattcaacatgagatttgggtggggacacagatctaaactatatcaccacctcgcaagccagtgatctcaatagaatgctgatgttcatgttgctagtggctataagccttttttctcaaggagcaagaaaaatgcatcttctagtttttttaaaaaaaatccattcacactgctgtttttggaagctcagcttgtgcttttacccatcctttgatcactggttccaattattagcagtagtatgggttttcctctttcttacatccccacaagtgtttttgtggaaaattacagcagtacctcaggagtttctatccagatgacactgtgctcagaatcagcgcttttaaactctccatggcaaaactgcctctcccctaatctgcagcagattgataactgccgtagatacaataaaaatgaattactaaaaaaaatgcatttaagaaacatggaaactagaagctctcagtgtgttttttttaagtcattggattgaacaaagcttaaatgactgtcattattttttaagtttctaaacatttactttcaatttctgaacatgtctcaccacagacagcttgcagtaacagttcacagagtggcagccgtctgattcaggagtgtgtgtaccatcataccatccaatatattactttatttatttatttatttattttttgagacagtctggctctgtcacccaggctggagtgcagtggtgcgatctcagctcactgcaacctccacctcccgggtttaagcaattctcctgcctcagccatccaagtagctgggatttcaggtgcctgaccccatgcccggctagtttttgtatttttagtagagatgcagtttcaccgtgttggccaggctggtcttgagctcctgacctcaagcgatccgcccgctttggcctcccaaagtgctgggataacaggtgtgagccactgcacctgcccacccaactgtatttctctaaggaaaatattgaaagtacttatttccttttccttgatggcctggtgacttggtacagatgggcttcattctccatgatgaggaagctgttatattatcttaaaacatgccttccaagagaaggttaaagtatatatttcagatcacaaggtcaggagcacttttggctgccacgtttggctgactcttggatgttgtgttatttaaagtgtcctagatcagccacaataaaacaaaacctaatcactgtgtctcaacctcaggtgtgtgctgcaggaagcgccagttcttgtgatatcggagccatgtccacctctgttctggggacccgggaccccacgggttggtctgagtatgtcatcaagagctagatgaggccgggtgaggtgcttcacacctgtaatcccagcactttgggaggccgaggcgggcagatcacaaggtccggagttcaagaacagcctgggcaacatggtgaaaccctgtctctactaaaacacaaaaattagccaggcgtggtggcgggtgcctgtagtcccagctactcaggaggctgaggcaggagaattggttgaatccaggaggtggaggttgcagtgagccgagatcgcaccaccgcacttcagcctgagctacagggtgaaactccatctcaaacaacaacaacaaagaactaggtgaaaagacctggcgtgctcctgcagcgcaaccagccgtgatcatacaaagaccagaatgctgcaggatggcatgtcatggcccatccctctcatctctgctccacgcagcaataagaccaaagctaacctgcttccagagacacctcgtggaaatgtgcaaggctcagcaaagaaaggctaatatctaatgattcatgtatttacacagctttttttttgagatggagtctggcactgtcaccaggctggagtgcagtggcatggtctcggctcactgcaacctccgcctcccaggttcaagcgattcccctgcctcagtctcccaagtagctgggattacaggcaatgcaccaccatgcccagctaagttttatatttttagtagagacagggttttgccatgttggccaggctggtctcgaattcctgaactcaggtgatcgcccgcctcagcctcccaaagtcctgggattacaggcgtaagccactgcgcccggcctgcttttttatttcttactagcacgagaacttagagtgatacaaatcttctgaatattttggctgcattctgcagacggtgacaccttctgtttccgtggatattatttataaaacatttttgtcacctgctatgaattgttaccctgtccacatgctttaaaagggcagtttttgaaatcaacatgagtttgggcactgggaaattgcatacttaataaaattaaacattaaaaaggggctctttctgctttcctatcaactcaggcagcagggtgatagatatagggggtgagggatgcaccctgtgttggccagggttctctagagggatataactaacaggataaatagctatatataaaggggggtttattcagtattaactcacaggatcacaaggtcctacaataagctgtctgcgagctgaggagcaaggaagccagcccgagtgctaaagctgaagaacttggagtccaatttttgagggcaggaagcatccagcacgggagaaagctgtagcatgggaggctaggccagtctaaccttttcacattcttttgcctgctttttgaatgtgctgtgctggcagctgattagatggtgcccaccccgattaagggtgggtctgcctttcccaccccactaactcaaatgttaaacttgtttggccacaccctcacagacacacccaggatcaatactttgcatccttcaatccaatcaggttgacactcggcattaaccatcacacctggtgtgtgtttctctgattataaggacaccagtcctactggacgagggcctcacccttttgagctcctacaggccctgtctgcaaataaagtcacattggagtttaagggttctgatgatgagtgagggagggcacggctcagtctataacgatgtcctatatctattgcaaagaaaaaatgaaggcactattcaattcctccaaattaggaggtttgccagagcctcagacaaaaggattttttagggaggtacagttcattccataatgatgttctctatcgcaaagaagaaggggtaattcagttcctccaaaccaggcgatttgccagaactccaaacaaaaggaatttttttttcttcttgatccctatttatcaacacatgcctctgtgtctttccagttgacttcatctcttgggcagcattaatttcagaaatctgtatttctgacttgccctcaggaaacccctttagatgttagaaattcttctgtggatgaagttatctttttttttttttgagacatagtcttgctctgtcgcccaggctggagtgcagtggtgtgatctcggcttactgcaacctccacctcccaggttcaaacgattgtcctgcctcagcctcccgagtatctgggattacaggcgtgcaccaccacacctggctaatttttgtatttttagtagagaccggatttcaccatgttggccaggctggtctcgaactcctgacctcaggtgatccacccatctcagcctcccaaagtgctggggttataggcatgagccaccacacccggccagatgaggttatcttcttgagtctcagggtttactgtctgtcactgagttgcaaataaaagaaaagttggatgagttattggcagcctcaagagcaacagtgagaattgtagactcactttctgcattggagggtgtggtgtgtgggctacgggaagcgtggacatcattcaccatgctaggtgccgagaggggcatcagacacagcaggtgcgtgaatctcctgtcttcatatgatactgtctcactgtcagaatcacagtgacagaaggcatttgttactgtggattcacactccgttagggttaagatttttattctgtgtgagttccttagggttactgtgaaaagcacatcttatcttctctcgataatttttaagtgacatttaaaaatattcaagcatgtgacttgaccgaattgcttagcatttgagttgttgcattaaatggagcatctcgtcactttcaagtatttgatactggcagttgctaagagttaaaaggcagctggatttgtcgcagacaatgagttaaggaatccttccacatttttcccatttttttttttttttttttttttttttttgagacagagtttcactcttgttgcccaggctggagtgcaatggcacgagctcggctcaccgcaacctctgcctcccaggttcaagtgattctcctgccttagcctccctggtagctgggattacaggcatgtgccaccacacccggctaattttgtatttttagtagagacggggtttctccatgttggccaggctggtcttgaactcccgacctcaggtgatccgcccgcctcggcctcccaaagtgctgggaatacaggcgtgagctgccgcgcccggcccgtttttcccaactttaaaagtaagggttctcaggaccctgtgtagagcagtgaaaataagacctcgtgtgtgtgtgtgtgtgtgtgtgtgtgtgtgtgtgtacacacgcgcctgcaggagaactgctgttccacttaggtgagaggatgggctgtgtgcttcagaccaggaaatgtgtcatcttgccaagcaacctggctgagtgtgctggagtcaggatcttgaacagaaacttccttttctggtgttgttcactacagagctaaaatggccaaatatatactgtgaaaattgttttttttttttttaacaaaagaccagatccctccttcagctgtatacatttttgaataaaatcatattgaactaacaaaaaaaaaaaaaacaccaaaactggggaacttgcacaatagaaatatatcctctcccaggtctggaggacaagactttaaatccaaggtgtctcagggctgagctccatccagacgctctaggggaggatccttttggcctcccccagctcctgggggctccaggcatcccacggcttgtggctgtatcactccagtctctgcctctgtcttcacatcatcattttctctcatctgtctcaagcatgcctgttcctcctccttataaaaaccccaggctaggcgtggtagctcatgcctgtcatcccagcactttgggaggccgaggcgggcagatcacctgaggtcaggagtttgagaccagcccggccaacatggtgaaaccccatctttactaaaaatacaaaaataagccgggcgtggtggcgggtgcctgtaatcccagctacttgggagactgaggaagggaggatcacttgaactcgggaagtggaggttgcagtcagccaagatctgtccgctgtattccagcctgggtgacagagcaagactttgtcaaaaaaaaaaaactcaaaaagacaaaacaaaaaaaactccgcactcctgtcatcctagcattttgggcagcagtatgataacaaggccaggagtttgagacctaccttggcaacatagagagacccctgtctctataaaagctaacaaacaaaaaacaaaaatctttgtcattatatttaggctaatacaggataatttcctcatttgaaaacctttaatgtctaaacaccctattttcatacaaggtaatcttttcacaggttctagagattaggaccaggagatttttagggacggagtggaggataccgtcatttagcctaccacattcttactaccttaggaaaggatggccaggcaaggtggctcacgacggtaatcccagcactttgagaggccaaggcgggcggatcgcttgagcccaggagttcgagtccagcttgggcaatattgcaaaatccgatctctacaacaactacaaaaagtagccaggcgtggtgctgcgcacctgtggtcccagctactcaggaggctaaggagggagaatcgcttgaattcgggaggtggaggctgcagtgagcccagatcacacctttgcactccagcctgggtgacagaacgagaccctgtctcaataaatgcataaataattttaaaaaggaaagtaattcagcacaaacatttgcatattcccaagatgatgctcacagcttgcagtgcctgcctgggtcctattcctatctgcctgggtctatctgcctgggtcctattcctatctgcctgggtcctattcctgtctgcctggggtctatctgcctgggtcctattcctatctgcctgggtcctattcctatctgcctggggtctatctgcctgggtcctattcctatctgcctgggtcctattcctgtctgcctggggtctatctgcctgggtcctattcctatctgcctgggtcctattcctatctgcctgggtcctattcctatctgcctggggtctatctgcctgggtcctattcctatctgcctgggtcctattcctgtctgcctggggtctatctgcctgggtcctattcctatctgcctgggtcctattcctatctgcctggggtctatctgcctgggtcctattcctatctgcctgggtcctattcctatctgcctggggtctatctgcctgggtcctattcctatctgcctgggtcctattcctatctgcctggggtctatctgcctgggtcctattcctgtctgcctgggtctatctgcctgggtcctattcctatctgcctgggtcctattcctgtctgcctcgggtctatgcatttcctttttgtctgaggacacatttttgcttcatgctgatatttttcacttcacctttctccccttttcttcttttctctttttccctctccttccctcccctccctctggggcagaagctggcatgcggcagagcgccagcagaggacgtggcccaagctcccatacatcttccctttacctcttccgctgacttttttctgggtgtgcccagagagcctagctctggacactcaaagatgcatcatttcaatgtatgttccaaagttacgtagcatccaaggcatatgagacatgcttaaaaacatactggtcatgcaagtgaggaggtgcaatgatgggtactgtcgttgcgattgcggaagccagatctagagatgcccggcgtggcttggggttcaggaaaacttcctgaaggaggtgacacatttgcgtttacgatccccaagtgaggcacacaagcatctctcggcgagaaccccacagtccatcccagaaaaggaaagtcaagagaatgggctacgtatgggaggaagggaactatttatggtcttcgatgagaaaataaatgtgcgtatgcgccccagctttgtgcttcggtattgccacatgccggaaccgcgtgaaaatacaagccgtcaatacaagcaagtgctagccctcttttattattctactgcagaagaaggaagtccttgcttctgagtcattttgtgtattagttacacatgccgtgtaacaaaataacacagactcagcagcgtgtcctaacagcctggtaatattttatccagaatgacgtgttttagaaagttatgtcctgtcaaagtaatccagataccatttccttttcttcttgtttttttggtattattatactttaagttctggatacatgtacagaacgtgcaagtttgttacataggtatacacgtgccatggtggtttgctgcacccatcgacccgtcatctacattaggtatttgtcctaaagctatcccttccctaaccctccaccccccagcaagccctggtgtgtgatgttcccctccctgtgtccatgtgttctcattgttcaacttccactgatgagtgagaacatgcagtgtttggttttctgttcctgtgatagtttgctgagaatgatggtttccagcttcatccatgtccctgcaaaggacatgaactcatcctttttttatggctgcatagtattccatggtgtctatgtgccacattttctttatccagtctatcattgatgggcatttgggttggtttcaagtttttgctattgttaatagttccgcaataaacgtatgtgtgcatgtgtctttatagtagaatgatttataaacctttggtatatacccagtaacgggattgatgggtcaaatggtatttctggttctagatccttgaggaatcgccacactgtcttccacaatggttgaactaatttacactcctaccaacggtgtaaaaatgttcctatttctccaaatcctctccatttccttttcttctccttatacagtaaggaatatgaaactaacacacactttctctcatttcattctctttctttttctgtctgctctctttgtctttctccctctctctctccctctctttttcctctctctctctccctctctttttcctctctctctctctctttctctgtctctctctttgtcttcttttctctatttctctctgtctctcagtgtttgtcacgctctctctctttgcctctttctgtctctttttttttttttgagacagagtcttgctctgtcacccaggctggagtgcagtggcgcgacctcggcttactgcaacctccacctcccaggttcatgcgattctcctgccttagcctcccaagtagctgggattacaggcgtgcaccaccacagtcgcctaatttttgtatttttagtagagatggagtttgaccacaatggccaggctggtctcgaactcctgacctctgcccaccttccaaagtgctgagattacaggtgtgcaccaccacagctggctaatttttgtatttttagtagagacgaggtttcaacatgttagccaagctggtctcaaagtcctgacctcacgtgatctgcctgccttcgcctcctaaagtgctgggattacaggcatgagccatcgtgcccggcctctttctttgtatctctctgtctgcctttctctctttgtcccttttactgtctcccgtccctctctctctttctgtttctctctctcactgtgtctctttgtctttatctctgtgtgttttttctctcttccccttttcctccccctccttttttctctttctctcttagcctttctttctttctctctttctctctctctctgcttctatctttctatctctctctttctcattcttacactccatctctgtctcttctctctctctgatggtgagtggagagtcatttcgttttggaatgatgatgagcattccagtaatagttttggagagtaaggctcatagagcttattaagcaaggtgtgtctgtcataaaattgattgctggcattttacacatcagtgcagacatggggggcacaggcagacccctccccccaccacacacacacactgcttatcctctgaaagctatgtggccttcataaaaatattaacagttcttttacagtaatgattttcccctatgaggctccccagtgaggaggctgtaaatgacactgaccaccagcagccctgcagatcaaggctgttctcttctcggccagcccagaaccagcctctgctcgctccctccctgaggactcctgtctctgacctctgcacacatgctgtgatttgctcttccacctcacaccattccccatcctcacctttcagaactcactggcagtgtcccccaataccttccacctctctccagaaattaccttcccatctcaatgtaagggaacttgcttcttccctcagagatctgctgtctctgctgcaagtaatagctagttttcatgcattttgttctgtctgactttaggttgttgcattgttctcccaacctccttgaacccatggacctggaggcagaattatatacctgtgaatttgcttttctttctagttcctctccctccaaaacctcagtccttctgggaaaaaaaaaaaaaaaacagctttaacacaatcaaacacatcacttttagcgatggagacccactgggaatttagagagaaagagtgaagttgatatactgaatacaatagacataagtctacctctctacctatgtgatgttataaagctgtccctgagtcattcactctctaaaaatgtcatctttggctggacacagctgctcacgcctgtaatccaacactttgggaggctgatgtgggaggctcacttgagcttaggagttcgagaccagccatggggacatagtgagaccctgtctccaaaaacataaatgtaataaaaaataaaatgctttcttttattattcttctgcagaagaaggaagtccttgcttctgagtcattttgtgtattagttacatatactgtgtaacaaaataacagactgagcagcgtggaagagctcatacttactatctgtagcaagggatccataaatggcgtccttttttattattatataaaattctatattctcctgtggaagaaggaagtccttgcttctgagccattttgtgtattagttacatatgccctgtaacaaaataacacagattcagcaacgtggaagggctcgtacttcttactatctgtagcaggggatgcataaattgcttcctgtttgattattatataaaattctatattctatattcctctactgcagaagaaggaagtccttgcttctgagtcattttgtgtatcagttacatatgctgtgtaacaaaataacccacagactcagcagcgtggaagggctcatacttactatcccacagctgctgcgggtcaggaatctgggcaggtgtaactgcattctctcttcggggtctcactgggctataaccaaagtgtcatctggcctgaggtcctctctggagctcaggatcttcgaaattcacatggttatacgcagaatccaattcctggaagctgcagatctggggatctgagtatcttgctggcttttggccaggggctgctgtcagctcctagagaggccatgcccaggttctggccccaaggcgctctcacaaaacatcagctcacatcaaggtcaggaggagaatgacaggtcccacacagactcaaggaaaggggactatacaaggatgggactcattgatctccctagagtatgagctcctcattgtaccctactgacatgtccaattcagtgttacttcctggacaggcgtggtggctcacgcctgtaatcccagcactttgggaggctgaggcgggcggatcacctgaggtcaagagtttgagaccagcctggccaacatggtgaaacattgtctctactaaaaaaaaaaaaaaaaaaaaaaatacaaaaatacaaaaattagctgggcctggtggcatgtgcctgtaatcccagctacctgggaggctgaggcaggagaatcactggaacccaggaagcagaggctgcagtgagctgagatcctgccacagcactccagcccggtcaacagagcgagactccatctcaaaaagagcagaaaaaaaaaaagtgttacttcctagatgaaattgagtttgacctgtttagaaattttcttaatctctgaaataggttgggagataaccaggtattttttgttgttgtccttttccagtggaatttttatactgtgacttggcttccatgacttccatccggcagtttgtgcagaagttcaagatgaagaagattcctctccatgtcctgatcaacaatggtgagtcctggtgaaattgcagcaagccaggggttaatttgaatgcaaacaggaactctagctttcatgcgggagaagtgtctcagcaaaacaggatatccatgggaattattgaacatacctgctatttctagtcagtgcttcatttcacggatagctttggaagagcatcattcttgttagcatgttactttgaaataatggtaaacgcgataacatgttgtatggagttgacacgttgacttgtccacttggactaaagggtatgaggcacatgctaagggttggtgttttcccaaatgttatcttacaaaaccatcaccacattcccctgagagtcattatttgggcactagaagctcattaccatttatctcttgattttaccccctgttcaacattctcacccagataggtggagtcaatatctccccttccccaccttcaatctgcccatctgccaatcttcaacacaaactacccttgaccttgagcccttctttgagcctcgctgagtgcttaaggtcattgcaacgcttactgttgaccttgagcccttctttgggccacgctgagcgcttaagatcattgcaacacttaatgtttctcctcgtaacactgatgcccattactctcatcccctgctgcagtccattttattttttataaaagttaacctgaaccctccacactgaggaggtacagttattgacatctccaaactaagtaaatacatagaactaaaggtctcagaaatacaccaacaaacatgtgtgctagtagaatttaacgcatcactttcacagatggagaccaaatgcaaattcagagaggaaataaatagtgacattaatacagtggatagaacagacgtacgtcaaacagtgagcccataaagacagcacattcctttcaaatacatgaaatatttatcaagttattgacacttcagattgcagacaaaaaaatcagcaaaaggatcttgtgattacccaatgtaattactccattacccacctagaccattaaagattcttaattctgcaaaaccccttgtgctacctaacgtaccattttcataaattctggagattaggatatggacatgtctgtaaggagggagaaagcattattctttgtactaaagttgtaatacctgtctgtttccagctgccaagatgtggtagcttctatctaatttttttttctttttgtcttgatgtgtttcgtgtttttgtataacattaatgggattggaggataggaaagtggatgagatacccacggttccccctcaacccacttgtttaattggaaattattatgctagagtttaaaggagaagcatgggatataaaactatacatagagtgtgatgccaatttatgcataaaaatttgtacagacatagctatgtgtgagtgcatatgtatttgtatatgtatttgatgtatgatgtatatgtatttatgcataaaaatacgtgcagacatagctatgatgtgtgagtgccactcaaatagctacagacaacaccatttccatgtacttagcctggtaagaaacatcgtattatcagtgctagtggctcctgttggaaggtccggaatgattttaactttgtgtgtcttctttggagatcaataacacttttcagatttgccatcctggtgggatctgaagtttctacgcaggcataaatgatttcccagtcagcagccatttggaatcttctgtctcagcactgggtgtggacttcctttgctgaagacctatcagtattagaagtgattagaattatagcattataagtcaccaaatgtggagaccacttagaggcactgtggagatcctacacgacccgacgtctcatttcctcgttctgtgtaacacccttactcattagtaatgggagcactttatcacagagcagttggagatggaaatacatacatgacatggtgcccttgcacagagacacacaaaacagaactgtccatcctcttaggacttttgtgcgactacttccatccatttggtatgggcttgcatccaccagtaagcagaaaaaattaggaatctcaggccgggcgcggtggctcacccctgtaatcccaacactttgggaggctgaggtgagtggatcacctgaggtcaggggttccagaccagcctgaccaatatggtgaaaccctgtctctactaaaaatacaaatattagccaggcgtggtggcgggcatctgtagtcccagctactcaggaggctgaggcaggagaatcgcttgaacctgggaggtggaggctgcagtgagccgagaccacaccattgcactccagcctgagcaacagagcaagactgtttcaaaaaaaaaaaaaaattaggaatgtcagatatgatatgtttctccagcagaatcttactgtgttctggggggagcagaattttactgagcaatgtgtatatgaaccacatctgtgacagtggatacaggctaacaccagttgacacaggctaaccagcgtatactccatcactcaaccaccacgtttaccttttgaaatggctattgcattcctaggattctcctctgttccttttctcaacagattttaaacaaggcacacagggctctcagaaacaaacaaaaatattctggaaactgggacagggttgaatttgaatcaaaagggtcttgttgttggattgtctctgtaccctatctcttctgtagaaaatctcatgcacatattgggtttacttcttcctagacttatctagacctttcttccatgctaagaccttttaccttcgctcaatgcctcagaggcacctcaagccagtaagtccagtgtgaaattcctgagtctatggctgacactggttctagaggagagtatttccttccccagtttttagaagactgtcagcgtttcttcacccatggcctccaacccggccttaaagccagcaatgatagtggctcacgcctgtaacctcagcactttgggaggccgaggcaggtggattacgtgaggtcaggagttcgagaccaacgtggacaacattgtgaaaccctgtctctactaaaaatacaaaattagctgggcatggtggcgcatgcctgtaatcccagctactcgggaggctgaggcaggagaattgcttgaacccgggaggcagaggttgcagtaagctgagatcacaccactgcactccagtctgggcaacaagagcaaaactccatctcaaaacaacaaaaacaacaacaaagccagcaatgagacacctttgaatctctctttcttgttctctctctctccctctcttcccttctctctctttctctctctcatcttgccttctctttttttttatctccttcacttacttttgttcttctgcctgccttgtagaagaaccattgtgattatttggggcccaccaggatcatctcagataatcacctcatctcaagatcttccactaattcacatctacaaaggcccttttgccgtgaaagtcacattttcatgtgttccagagatgaggacatggacattttttcatcttttgagttattactcttccaaattgggaataggttgtgggcatctctggggtcattattgtgtcgaccacatgagaattagtctgtggacatctttagagccattattcagtcttccacatgaggattaggatgtggacatctttggggccattattctgtttcccacatgaggattagaatgtgaacatctttggggctattattctatctaccacatgggaattaacatatggacatctttggggccattgttcggcttccacatggggattaggatgtggacatctttggggccattattctgtcttccacatggggatttggatatggacatcttcggggccattattctgtctcccacatggggattcggatatggacatcttcggggccattattctgtgtaccacatggggattgggatgtggacatctttggggccattattctgtctaccacatggggattaggatgtggacatcttcagggccattattttgtcttccacatgaggattgggatgtggacatctttgggtcattattctgtcttccacatgaggattaggatgtggacatttttggggccattattctgtcttccacctgaggattaggatgtggacatctttggggccattattgtgtctcccacatggggattacagtgtgggcatttttggggtcatgattctgtctcccacatgaataatgtggacctggacatcttgagttgtgcattatttaacctgccatacctacctactctgcccttcacatacttcgcttgcaggaaaaataaaataataagcaagattcttgacctcatagaaatcatactttagcaacggaaacaaacattggaccaataatcattctgtgaaatgttctgccttagaaaacacacctcttgcaatgtgacaacacagtcttgtaaagtacagagaagattgcaccccaagtcacacgcctccctggaattccccagcctgtgctgctcagaacaccatttccaggaggtgataatgagaatccatttgttacaagatgatggcttgaaataacactttgcactttcttccttttatctttttgttctacatctttcaagaggttgctcaggctgtggctttcctggactccctataggtttttgtggctgactaaggttcatcttgtccctggggtcactgttgagaagagctcagttgcagaggatctggatttttttttttttcctctgtgggtacagacagaagcttctagaaaagagctggagacttcgcttttggaggctgtgttgaatacccattgcccactcttcacaagaagacagaaatgcagagaggcagtctcttgttgacaaatcctcttggttctcttggaaatgcaacagaaccatggagcttcgtgaagcccatgggcttggaaaggggcctcccgaggtacccagggtggatggaaagctgcagggataagtgctcctcaagccagaagtagcccagatggcacagtctatgctgagaatggattcatcaccagcctgtgtgctggaggcttgggccagatgaaccttgatttagagaggaagtaaagcattttttgccttggtttgtgcatcagaattcatcttcatggtgtgcaaatgacgaggctggattctatacagtcagcactgagaatggattcagcacaagcccgtgtgctggaggcctgggtctgatgtacctggatttagggaagaagcaaagtatttttctcatttattgcatgccttagtttgtgcatcagaattcatcttcgtggtgtgcaaatgagaaggctggattctacacagtcagcgttgagaatggattcatcaccagctcttgtgctggaggcttgagccagatgtacgttgatttagagaagaagtaaaggatttttctcatttgttgcatgccttggtttatgcatcagaattcatcttcgttgtgtgcaaatgagaaggctggattctatacagtcaacgctgagaatgggttcatcaccagctggtgtgctgaagcttgggccagatgtaccttgacttagagaagaaatcaaggatttttctcgttggtttgtgcatcagaattcttcttcgttgtgtgcaaatgagattgctggattgtatgtttgggatattgctggtgtcaacttatgtaaatagagtttctatttataggcagcctcagggaaggactccagtggtggtacttttagtgtctaagaggctagtagggggtctgcagacccctaaaccagggctgtccaacccccaggtcatagtaccagtccatggcctgttaggacaccggccgcacagcagaaggtgagtggcaagtgaacaagcaaagcttcatctgtatttacagccactccccattgttcacatgactgcctgagctctgcctcctgtcagatcagcagcagcattagattcttataggagcacaaaccctactgtgaactgtgcatgtgagggacttaggttgtgcactccttatgaaaagctaaagcctgatgatctgtgcatgggaaggatctaggttgtgtgctccttatggaatctaattcctgatgatctgtcactgtctcccatcacccccagatgggactgtctagtcacaggaaaacaagctcagggctcccactgattctatatgatggcgacttgtagaattatttcattatatagtacaatgtaataataatacaaataaagtgtacaataaatgtcatgccccggaatcatcccaaaaccatccccacattccacctccaccttctgtcttcagaaaattgtctttcacaaaagtggtccctggtgccaaaaaggttggagactgctgccctaaactatttccccagaaccttccctccaaaactcctgctagtcaaccacgtgcctcaagtctcatggaaaacagccccagctgagctcagccagggtgacttccaaggcaagaaggagctacacttcgtgcttttctttttttattcttagagcaatcaaggttttgcaaacattaaatacttcagacatagaatatctttttcatttgctagtgggttgaaaatagaacctgactgcctctgtctggctgctgtgggaagctcagaggcaacgcgatgatttatcaagcacaagaataaatcaataatagacctcctgcagagccggtatttatggtttattcacttcaaaattgtatttatctagcttcccatccccatgtctgaaaattgatagatttttaataatgcagaggatttatagatttatccttgtcagccatcttcccataactctaatggatgaatttctttctgagataatgaattactaagcattatttttcctaccaccaaagaaatacgtccacgatacagggtgaccctgaaaaataacaatgattcttccctggccagagacctaaagactctgttttttggtacagttcttcattcacccattcattcattcattcattcattcattcaaattcattcattcacttgaatgaattcaaatgagtgaatgaatgaatgaaagaattcaaatgaatgaatgaattcagaggaatgaatgaatgcaaatgaattcaaaggaatgaacaaatgaattcaaatgaattaattctaaggaatgaatgaattctaatgaatgaacaaatgaattcaaaggaacgaatgaattcaaaggactaaatgaattgaaaggaatgtatgaattcaaaggaatgaattcaaaggaatgaatgaatgaattcaaatgagtgaatctgaatgaattcaagggaatgaataaattcaaatgaaggaatgaattcaaatgaatgaacaaatgaagtcaaaggaacgaatgaattcaaaggaatgaataaattcagaggaatgaatgaatgaattcaaaggaatgagtgaattcaaaggaatgagtgaattcaaaggaatgagtgaattcaaaggaatgagtgaattcaaaggaatgagtgaattcaaaggaatgaacgaattcaaaggaatgaatgaatgaattcaaatgagtgaatttaaatgaataaattcaagtgaatgaatgaattcaaaggaacaagtgaattcaaaagaaggaatgaattcaaatgatgcaaatgaatgaatggaatcaaatgaatgaatgaattctaatgagttcattcaaatgagcaaatgggcacagggcacctacaagacccatgagagttaaggaagattcattcggggaagcccaggtgtgcagttctgcatcaacagaagactgaggtgcagtggagccggtccttactgaggacccactttttggtggacggacacctgagcagccatctcctgtctttgtgggcgcctggcattttctatgtgactcgggctccacagtcatctggtctccctcccgggaagacggaaagtgttgcatcgcggcgcatgcattcgtcagcggatccttgagtctgcacaggtgtagaccatttattctgcgtgccttctgtttgcttctcttccagagctgctctcctgtggatagagtagctttctgttccgtagtggtttcctctgcctctcccgatggcgccttctctgaacaggaggcatttggatgttcttttagtgttggtgttggcagcagcatgggatgtggtctgttgtgactctgcggcaggctgttccctgccagagaaggctagatgttcagggcgtccgtcccatagcctccctggactggctccatccttcccaccgccctcccgagattctaggaagtgggttgagaagcagtggtttttcagttactcaaatgcttttctcctctctctctctctttctgtaactctctgtctctctctcctccttctccccgtctctctgtcattctctctttccacctcttcactgtctcacttttcctctcttttgctttttctctctgtctctctctctcctcagtctaccccatccccgcttctactattttgctctcgacctcccttctccctcctccctccctctctccccctctctctccccttctcccttctctctctccctttctccctctctctccctctctctctttctctcttctctctttcttctctctctccccctccctccctcgctttctcccctcttctctctctcccattctccctctccctccctccctctctccttccttccctctctccctctttctcccctcttctctctctccttttctcccattctctctctccctctctccctccctttcccttcttctctccctcccctctttcttctctctcccctctttcttctctctctccctttctgtttccctctcgcacaccctccctcttctccctatctcctttctcttcctgtctctccccttgtctctctatctcctttgtcttcctctgtgtcccacttctctctctttcctccttcccccatctctcctcctctctcctttgccttccttctctccccctttctctctttctctctgtctctttctctgtctctccccttatttcctccctctccttctctcttcctttctcgtttgccctccctctctctccctgttccctctccatctctctctctctttcccccatttcctcctcttccttctctctccctctcgtttgccctccctctctctccccgttccctctccatctctctttctctctctttcccccatttcctcctcttccttctctctccctctcgtttgccctccctctctctccccgttccctctccatctctctttctctctctttcccccatttcctcctcctccttctctctccctctcgtttgccctccctctctctccccgttccctctccatctctctttctctctctttcccccatttcctcctcctccttctctctccctctctcgtttgccctccctctctctccccgttccctctccatctctctctctctttcccccatttcctcctcttccttctctctccctctcgtttgccctccctctctctccccgttccctctccatctctctttctctctctttcccctatttcctccctctcctccttctctctccctctctcgtttgccctccctctctctccccgttccctctccatctctctttctctctctttcccccatttcctcctcctccttctctctccctctcgtttgccctccctctctctccccgttccctctccatctctctttctctctctttcccccatttcctcctcctccttctctctccctctcgtttgccctccctctctctccccgttccctctccatctctctttctctctctttcccccatttcctcctcctccttctctctccctctcgtttgccctccctctctctccccgttccctctccatctctctctctctttcccccatttcctcctcttccttctctctccctctcgtttgccctccctctctctccccgttccctctccatctctctctctctttcccccatttcctcctcttccttctctctccctctcgtttgccctccctctctctccctgttccctctccatctctctttctctctctttcccccatttcctcctcttccttctctctccctctctcgtttgccctccctctctctccccgttccctctccatctctctctctctttcccccatttcctcctcttccttctctctccctctcgtttgccctccctctctctccccgttccctctccatctctctctctctttcccccatttcctcctcttccttctctctccctctcgtttgccctccctctctctccctgttccctctccatctctctttctctctctttcccccatttcctcctcttccttctctctccctctctcgtttgccctccctctctctccccgttccctctccatctctctctctctttcccccatttcctcctcttccttctctctccctctcgtttgccctccctctctctccccgttccctctccatctctctctctctttcccccatttcctcctcttccttctctctccctctcgtttgccctccctctctctccccgttccctctccatctctctttctctctctttcccccatttcctcctcctccttctctctccctctcgtttgccctccctctctctccctgttccctctccatctctctttctctctctttcccccatttcctcctcctccttctctctccctctcgtttgccctccctctctctccctgttccctctccatctctctttctctctctttcccccatttcctcctcctccttctctctccctctcgtttgccctccctctctctccccgttccctctccatctctctttctctctctttcccccatttcctcctcctccttctctctccctctcgtttgccctccctctctctccctgttccctctccatctctctttctctctctttcccccatttcctcctcctccttctctctccctctcgtttgccctccctctctctccctgttccctctccatctctctttctctctctttcccccatttcctcctcctccttctctctccctctcgtttgccctccctctctctccctgttccctctccatctctctttctctctctttcccccatttcctcctcttccttctctctccctctctcgtttgccctccctctctctccccgttccctctccatctctctttctctctctttcccccatttcctcctcctccttctctctccctctcgtttgccctccctctctctccccgttccctctccatctctctttctctctctttcccccatttcctcctcctccttctctctccctctcgtttgccctccctctctctccccgttccctctccatctctctttctctctctttcccccatttcctcctcctccttctctctccctctcgtttgccctccctctctctccccgttccctctccatctctctttctctctctttcccccatttcctcctcctccttctctctccctctctcgtttgccctccctctctctccccgttccctctccatctctctctctctttcccccatttcctcctcttccttctctctccctctcgtttgccctccctctctctccccgttccctctccatctctctttctctctcccccatttcctcctcttccttctctctccctctcgtttgccctccctctctctccccgttccctctccatctctctctctctttcccccatttcctcctcttccttctctctccctctcgtttgccctccctctctctccctgttccctctccatctctctttctctctctttcccccatttcctcctcttccttctctctccctctctcgtttgccctccctctctctccccgttccctctccatctctctctctctttcccccatttcctcctcttccttctctctccctctcgtttgccctccctctctctccccgttccctctccatctctctctctctttcccccatttcctcctcttccttctctctccctctcgtttgccctccctctctctccccgttccctctccatctctctttctctctctttcccccatttcctcctcctccttctctctccctctcgtttgccctccctctctctccctgttccctctccatctctctttctctctctttcccccatttcctcctcctccttctctctccctctcgtttgccctccctctctctccctgttccctctccatctctctttctctctctttcccccatttcctcctcctccttctctctccctctcgtttgccctccctctctctccccgttccctctccatctctctttctctctctttcccccatttcctcctcctccttctctctccctctcgtttgccctccctctctctccctgttccctctccatctctctttctctctctttcccccatttcctcctcctccttctctctccctctcgtttgccctccctctctctccctgttccctctccatctctctttctctctctttcccccatttcctcctcctccttctctctccctctcgtttgccctccctctctctccctgttccctctccatctctctttctctctctttcccccatttcctcctcttccttctctctccctctctcgtttgccctccctctctctccccgttccctctccatctctctttctctctctttcccccatttcctcctcctccttctctctccctctcgtttgccctccctctctctccccgttccctctccatctctctttctctctctttcccccatttcctcctcctccttctctctccctctcgtttgccctccctctctctccccgttccctctccatctctctttctctctctttcccccatttcctcctcctccttctctctccctctcgtttgccctccctctctctccccgttccctctccatctctctttctctctctttcccccatttcctcctcctccttctctctccctctctcgtttgccctccctctctctccccgttccctctccatctctctctctctttcccccatttcctcctcttccttctctctccctctcgtttgccctccctctctctccccgttccctctccatctctctttctctctctttcccccatttcctcctcctccttctctctccctctcgtttgccctccctctctctccccgttccctctccatctctctttctctctctttcccccatttcctcctcctccttctctctccctctctcgtttgccctccctctctctccccgttccctctccatctctctctctctttcccccatttcctcctcttccttctctctccctctcgtttgccctccctctctctccccgttccctctccatctctctttctctctctttcccccatttcctcctcctccttctctctccctctcgtttgccctccctctctctccctgttccctctccatctctctttctctctctttcccccatttcctcctcctccttctctctccctctcgtttgccctccctctctctccccgttccctctccatctctctttctctctctttcccccatttcctcctcctccttctctctccctctcgtttgccctccctctctctccctgttccctctccatctctctttctctctctttcccccatttcctcctcctccttctctctccctctcgtttgccctccctctctctccctgttccctctccatctctctttctctctctttcccccatttcctcctcctccttctctctccctctcgtttgccctccctctctctccctgttccctctccatctctctttctctctctttcccccatttcctcctcttccttctctctccctctctcgtttgccctccctctctctccctgttccctctccatctctctttctctctctttcccctatttcctcccctccttctctctccctctcgtttgccctccctctctctccctgttccctctccatctctctttctctttctttcccccatttcctcctcttccttctctctccctctctcgtttgccctccctctctctccctgttccctctccatctctctttctctctttcccccatttcctcctcttccttctctctccctctctcgtttgccctccctctctctccctgttccctctccatctctctttctctctttcccctatttcctcctcttccttctctctccctctctcgtttgccctccctctctctccctgttccctctccatctctctttctctctttccccctatttcctccctctcctcctctctccctctcgtttgccctccctctctctccctgttccctctccatctctctttctctctcttcccccatttcctcctcttccttctctctccctctctcgtttgccctccctctctctccctgttccctctccatctctctttctctctttcccctatttcctcccctccttctctctccctctcgtttgccctccctctctctccctgttccctctccatctctctttgtctctctttctccctatttcctccctctccttctctcttccttctttgccctccctctctctctcctctctctctctctgattgccctttcatccccatcactctcctttctctggagttctccgcttggagagcggagaactctcccttctcctcccgttcaggatacacctcacctgtgttcactgcttcaggcacaatatgtgattgtgaccctgagcgttcactccccagtaaaatgccattaggtgcacagaccaatgaacgataattgtattgcgtattttccacctttgaattggcagatcaatggacgataattttactgtttattttccacctttgaattggcagatcgatggacgatagttttattctgtattttccacctttcgattcgcagatcaatgaacgatagttctattgtgtattctccacctttgaattggcgaagagacagattccgtgaatgctcctaacgtggacggcacccgatacactgacgtggccacagggttttcttattccttacaaaattcgcaatgaaacatcagtatatttgctgatgattaaaacttgtgcaacaaaatctcagaagtcaccacaaaagaatgtatccatgtagcccaaaaccactggtttcccaaaaattattgaaattttaagaaacaggccgggcgcgatggcccacgcctgtaatcccagcactttgggaggccgacgtggatggatcacgaggtcaggagttcgagaccatcctggccaacacggtgaaatcccgtctctactaaaaatacagaaattagctgggcatagtagcatacacctgtaatcccagctactcaggagcctgaggcaggagaatttctggaacccgggaggcagaggctgcagtgggccgagattgtgccactgcactccagcctagcgacagagtgagactccatctcaaaaataaaattaaattaaaatttttaaaaaaaggcaaattattattttattttatttatttatttccttttttgagacagagccttgctctgtcgcccaggctggagtgcagtggcacaacctcttctcactgcaatctccgcctcccagaaaaaaacaggcaaattaaatctatggtaatggaaattggaattgtagttaccttagaagaatgtgataattaattttggatcaaaaaagggcttaggggtgcagatgtgggaggcggttacctgagaggggagagtgctcgctttggatgattccattgagatttccctcatgatctctgcaccttttttttttttgttttgaaacatagtctcgctgttgtcggccggggctggagtgcagtgcacgatatcagctcactgcaacctctgcctcctgagttccagaaattctcctgcctcagcctcccaagcagctgaaattacaggtgcccgccaccacactcagctaattttttttttttttttgtatttttagtagagacggggtttcaccaagttggccaggctggtctcaaactcctgacctcaggtcatccgcctgcctcggcctcccagagtgctgggattacaggtgtgagtcaccgtgcccagccctgtgcaccttttttatactttcctttgatttaaaagaaaataataacttgacaaaaataaataaatagaattttactgatgccgaaaaaaacatgattatggaaaatttaaaacacatacaaaagcctacaggcatttgaatttgccgtcgattgtctaactagtactcaattctgcatttcggacttccgtcaatccctcctctggggtaccatcatctcttcctaggccatgataatggcctcctaacaggcatctcaggcacccatccaatctctctacctggcaccaatctggtctttcaatgctctgcttacataggaagaggaaaattaatacctaaagccactggcaaagaactcaacaacaaaacaatttctccttcagaatatgtcaggctttcgttccgtaaatatcagcgtttcaggtgggtttgctgcctagaaacgtctccgtgacactgtggtttaaaatacgggtgcgtggccgggcgcggtggctcacacctgggatcccagcactttgggaggctgaggcgggcagatcacttggggtcaggagttcgagaccagactggtcaacatgacaaaaccccatctctactaaaaatacaaaaaaaaaaaaaaaaagtttagccgggtgttgtggtgcacacctgtaatcccagctacttgggaggctgaggcagaagaatcacttcaacccgggaggcggaggttgcagtgagccgagttcaacccactgcaatccagcctgggcaacagagtgagactccatctcaaaaaaaatgaaataaaaaataaaatacggacacactgcactccagcttggttgacagagcgagactctgtctccaaaaaaataataatattagtagggctgggtgcagtggctcacacctgtagtcccagcactttgggaggccaaggcgggaggatcagttgagattaggagttcaagagcagcctggccaacatggtgaaaccccgtctctactaaaaatacaaaaaatagctggccatcggggcaggtgcctgtaatcccatgtactcgggaggctgaggcaggagaatcgcttgaacccaggaggcagaggttgcagtgagccgacatcacaacactgcactccagtctgggtgacacagcaagagtttacctcaaagtaataataataataataaaataggaataaacgtaattactcgcagtagctcactaacgatgaattatcagcatccagggcccctgcgcgtggctgctgcattcaccacggcgcaggaattctcacgcagcttccccgccaggcgagtccctagcacggctcggattcatctggagcacaggtcaccacctgcctgcacagaagcactgtcccctctgctcttgcaaaagataccttccccaacgatgctgttgtcaccaagaatttgctcagagctgcaagccattatcctaagagaaccagcacagaaacagaaaaccaaatactgcatgttctgacttacacctggaaggtacacagcgggtactcatggacacaaagatgggaagagcagaaactcttgactgctagaaggtagggggagggaggcaggggatgaaaaaccacctgttgggtacagtggccatttcctgggtgacaggttcactcacagccccaccctcagtctctaatgtgtattcctctattccgtatgccccttcaatgccagaagcatacccagagcttagtgcccacttacaagtgagaacgtgtatttgcttttctgttcttgagtgactccacgtagaataataacctccagttctatccaagttactgccaatgacacgattccactctttttaatggcttagtagtattccattccattttctttatccagtactccacggaggggtacttaggttgattccgtatgtttgcaattgtgagttgtgctgcaagaaacagacaggtgcaggtattttgttttgtattgttttgtttgattattttattttattgatttatttatttttgagatggagtcttgctctgtcacccaggctggagtgcagtggtgcgatctcggctcactgcaacctccacctcctgggttcaagcaattctggggtttctccatgttgcccaggctgctctcgaactcctgacctcaggtgatctgcccgccttggtctcccaaagtgctgggatgacaggcgtgagccaccatgcctggcctgcaggtgtctttttgatataaggacttcttttcctttgggtagatacccaggagtgggattgctggatcgaacaaatgatctgcttttagttctttgagaggaacatccgtgctgttttctatacagcttgtatgaattcactttctttcggggcacaggaatgtaggcagttctgcctggggggtctcctgtggggctgcagctggggctgactttatctgaaggcttgaccaggttggatgtccaggatagctttctctggtgtcaagaagctggtacagcctgtcacctgggcttagctgggagggccaacaagaacaggtacctggggcctctccagcatgtcaggctgaaggtgctcagtctttttaaaccaaagctggctcctcccagactcagcattcccaagaaccaagcaggggccacgtgaccttattgacccaactttggaagtcacacagtgtttacaccactgtggcattctacaaaagaattaacgagaaagttaatgagcatggccgagattcaagggaaggggcgtagactctagctcccaaggagacgagtgtcaaaagaatttgcaggcctgctttagagccccctgaagctgcctttcaaaaccatgcatgcataagccaggtgttcatgataagctcgtctctcctaagctgggaatttatgacacttcaggcacggattgagctgtgtgtctccagattcttcacatcaaataaaatatgaggaaaatggcatcgtgaaaaagatgtttatagttcatcaaaatgcaaagcttcccgtccacccacagcaacctattctggtgtttttgtttttttgttgttggtttttttttgtttttgagacaaaaatcaacttaggttgattccgtatgtttgcagttgtgagttgtgctgcaagaaacagacaggtgcaggtatgtttttttgtttcgttttgtctcactctttcgcccaggctggagtgcagtggtgtgatctcggctcactgcaacctctgcctcccaggttcaagcgattctcctgcctcagcttcccgagtagctgggattacaggcatgcaccaccacgcccggctaattttgtatttttagtagagacaaggtttctccatgttggccaagctggtctcgaactcctgacctgaactgatctgcccgcttcgccctctgaaagtgctgggaggattacaggcatgacccaccgggccgggctttttttctggataactcctgaggtgaattctgacatacttctcagaagtgttttgttagatgggctttgaggactgtaggagtgttgaatgtttaatacacatgtgtcttgtgactgattgatactggaccctgattgatattggatccctcccagttggtttatactcctgatgttttacaggcataagctcagggaataaattctctgtatcctggaagtttttttgaaagctagatattcacgtaggagggggaagcactgagtctggctggaaagtgtgtgcaggtgagaagcaaggactgcacctgaacagtctgctcatttctccctgaggatttcagcaggccacaggcctggaatggcatggtggtgcctctcccctgccaccattctctgtgagagtgtgtccagaatttattccttcttgtgggttcttggtctcgctgacttcaagaatgaagccgcagaccctcacggtgagtgttagggcttttaaagatggtgcgtcccgagtttgttccttcagatgttcagatgtgcctggagttttttccttctggtgggttcgcagactcgctgacttcaggagtgaagctgcggaccttggcagtgagtcttacagctcatacaggtagtgtagacccaaagagtgagcagcagcaagatttatggtgaagagtgaaacaacaaagtttccacaacgtggaaggggacacaagctggctcaggtggccagcttttattcccttatttggccccgcccacatcctgctgactggtccattttacagagtgctgattggtccattttacagagtgctgattggtccattttacagagtgctgattggtccattttatagagcattgattggtccattttacagagcactgattggtccattttacagactgctgaatggtccattttagagtgctgattggtgcctttacaattctttagctagacaaaaggtctccgggtctccactcgacccaggaagtccaggtggcttcacgtctcaaaagcagcagatctccatccacgtttattttttatttcccccttgctgtacccaaagcactacaaccgcactgtggaggctacagccagaataagacgttggtttttcctcaaggacctcacaattgtcaagcctccactggggccagggacgtgtagagccgcgggacccactgctgagtcttctgtgggccctccgcgcaatggggcatccagtgcggcctgtgcatccacagttttgaaaggcgggttggagaggctgtaaaacaggcctgcaaattcttttcacacttgtctcttcgggagctggagtccctgctccgtctcttgaatctcggctgtcctcattaactgtctcgtaattcctagaatggggcagtggtgacaactctgtaggagttccaaagttgggtcgataaggccacgtggctcctgcttggttctttgggaatgctgagccggcgaggagccagctttggttttgagtgttcataaagtacaactggaaagactgtgtacacaaacacaggcaggtacacaaatgcacacgcatcaaaaatttatagggaaatgggtccatgtaccgaggcacaaataacatacagatattacagtacacacagaagcaagcacatatacaaatgcatgtacctcaaaaaatgtatacacctacggatacacctctacatatacaaacacatagagaaatgctagacctacatatatgtatagatagctccatataagatacacacaaacacaagcacgtgtacaaatgcatatgcatagaaaaagatgtacgctatgcagatgtacatatacatacacaaatacatacagaaacgctagacctatagatatatacatatctccatataaaatacacacacggccgggtgcagtgtctcacgcctgtaatcccagcacttagggaggccgaggtgggcggatcccctgaggtcaggagtttgagagcagcctggccaacatggcaaaaccccgtctctactgaaaatacagaaaaatttagccacgtgtggtggtgggtgcctgtaatcccagctactcgggaggctaaggcaggaaaattgcttgaacctgggaggcggaggttgcagtgaggcgagactgcctcattgcactccagcctggacgacaagagcgaaactcctcctcaaaaaataaataaatacatacatataaaatacacacacacatacaagcacataaacaaatgcatgtacctaggaaaatgtattcatgtacagatacacgtatacatatacaaataagtagagaaatgctaggcctatatatgtgtagatatctccatataaaatacacacaaatacaagcacatatacaaatacatgtacatataaaaaatgtgtgcacttgcagatgcatgtatacatgtacaaatacacagagaaatgctagacctctatatatttgtgtgtagatataaaatacatacacactaatacaagcatatatacaaatgcatatgcataggaaaatatgtacacatgcagatatacatatacaaatatgtagacaaatgctagacctacatatatgtatagatagctccatataaaatacacacaaacacatatacaaatgcatatgcatagaaagatatgtacacatgcagatgcaaacacatatatatacaaatacagaaatagatctacaaatatcaatatagctccatattgaaatacatctttgaacacaaacgtgtccatatgcaaatggataggtgtgtgtgtgtattaatcatacacctcaaatgcatttgcaaatgcaaacgtgcacaaatgcaaaagctatgggattccacagatgaatcaaaatgcatattcatgcgtgcaatacacgtagatgttccaatgtacaaataatgacaaatgctgtgtgtttgtaggtgtatgaacacatgcaaatacttgcgattgtacaattccaaatagaaacatataatatatacatacactgtatgcagatacacatgcaaagatgtaaatgtgtatggacatgtatatacatgtgaataaatgtgtacacatgcaaactcatgcacatgtgcatacaacacatatgtaaaagaaaatatgcacaaatttataggcatttgaaaatgaatctgcatgtaaagacgtgaacacatatgtacatgctaacatatatctctataggcatatatctttgaattatgcatacatgcagttatatacccaagtgtatagctatataaacacatttacaaatgcgtatgcatatatgtatatgaatagacgtgcctgtatttgcgttacgtgtagatagatacagaattccaggtacatatataacatgcctatgtatacacatctacattatccatgtacatacaaatacatatctacattggcattaatatccaagcaaactggtctgctctaagtacaaggcagtatggttcgtgcgtgtttctaggacaagtcacctttgagatcaggcctccacagcaaggacttcagggcaggcgctcagccgggcttggcctgacaggggtgggctgttctgtgtctggtagatagaacatgtcaagcacagaacctgcggtgatgatgatgtctatagaatgatgaccgacagggctgccctgtggtctaggggtgaggacaggccatgtttatactgaggtcggcatttctcaaaggacatctgagcagtttgtttgtgggatactcagtgaagagggggtgccatagcagctatacttgtccagaattctggggggagacaggatctctgttgcccaggctggggtgcagtagcacaatctcggctcactgcaacctccacctcttgggctcaaacaatcctcccgcctcaacctccccgagtagctgggactacaggcacgcaccaccacacccactaattttttgtatttttggtaaagatggagtttcactgtggtgcacagcctggtctcgaactcctgacgtcaagcagtctgccctactcacctacccaaaggctgggattacatgtatgagccatcacacctagccgcccagaataattaattgtccaggggactctgtttggtgacttggatgattctcactctcttgtgtgtgttgctgtgttatcattgtggttattatttttcttttccttttttttttttttgagatggagtctcgctctgtcaccaggctggagtgcagtggcatgatctcagctcactgcaacctccgcctcccaggttcaagcaattctcctgcctcagcctcctgagtagctggaactacaggaccctgccaccaaacctggctaatttttgtatttttactagagacaagggtttcaccatgttgggcaggctggtcttgaagtcctgacctcagatgatccacccgccttggcctcccaaagtgctgggatgacaggcatgaacttctgacctcaggtgatccacccgcctcagcctcccaaagtgctgggatgacaggcgtgagccaccgcgcccggcctgtggttattatttttaaactcaaggcacagaggtgcagagacagaaggcaggaagggacttcagtgatcttctagaatcttctccatcacacctaaagcaggaaacagaggcccaggaggaagacatggccgccagctctacaccccaccctccgatgtcctgggccatttgcgcatctggggaatccatctgtgagatttctccactgtcttccccagtctaactccttctgatattctcttttgtccagctggggtgatgatggtccctcagaggaaaaccagagatggattcgaagaacatttcggcctgaactacctagggcacttcctgctgaccaaccttctcttggatacgctgaaagagtctgggtcccctggccacagtgcgagggtggtcaccgtctcctctgccacccattacgtcgctgagctgaacatggatgaccttcagagcaggtaggtgcaccctgtgaataatcataacagcatctcaggtgggttaaaggttattcatctccctctgtctgtgcggtgtggcgctccctgcatctgctggacgctggtgctctgggaacagtgctccctgcgtctgccgagcactggtgctttggggacagtgctccctgcatctgccggacactggtgctctggggacagtgctccctgcatctgccgagcactggtgctctggggacagtgctccctgcgtctgccgagcactggtgctctgggaacagtgcttcctgcgtctgccgagcactggtgctctgggaacagtgctccctgcatctgctgtacactggtgctctggggacagtgctccctgcatctgccgagcactggtgctctggggacagtgctccctgtgtctgccgagcattggtgctctggggacggtgctccctgtgtctgctgtacaccggtgctctgaggacagtgctccctgcgtctgctggacaccggtgctctggggacagtgctccctgcgtctgccaagcactggtgctctggggacagtgctccctgcatctgctgtacactggtgctctgggtacagtgctccctgtgtctgccgtacactggtgctctgggtacagtgctccctgcgtctgccgagcactggtgctctggggacagtgctccctgcgtctgctgtacactggtgctctgggaacagtgcttcctgcgtctgccgagcactggtgctctgggaacagtgctccctgcatctgctgtacactggtgctctggggacagtgctccctgcatctgccgagcactggtgctctggggacagtgctccctgtgtccgccgagcattggtgctctggggacggtgctccctgtgtctgctgtacactggtgctctgaggacagtgctccctgcgtctgctggacaccggtgctctggggacagtgctccctgcgtctgccaagcactggtgctctggggacaatgctccctgcatctgctatacactggtgctctggggacagtgctccctgcgtctgccgagcactggtgctctgggtacagtgctccctgcgtctgctgtacactggtgctctgggtacagtgctccctgcgtctgctgtacactggtgctctggggacagtgctccctgcatctgctgagcactggtgctctggggacagtgctccctgcatctgctggacactggtgctctggggacagtgctccctgcttctgctggacactggtgctctggggacagtgctccctgcgtctgctggacactggtgctctggggacagtgctccctgcgtctgctgtacactggtgctctggggacagtgctccctgcgtctgctgagcactggtgctctggggacagtgctccctgcgtctgctgagcactggtgctctggggacagtgctccctgcgtctgctgagcactggtgctctggggacagtgctccctgcgtctgctgagcactggtgctctggggacagtgctccctgcgtctgctgagcactggtgctctggggacagtgctccctgcgtctgctggacactggtgctctggggacagtgctccctgcgtctgctgagcactggtgctctggggacagtgctccctgcgtctgctggatactggtgctctggggacagtgctccctgtgtctgctggacactggtgctctggggacagtgctccctgcgtctgctgagcactggtgcttcctgcatctgctgggcacaggtgctctggctacggtgctccctggagtctgctgggcatgggtgctctgggcacagtgcccccgcatttgctgcacattggtgcccggcatagtgctccctgcatctgctgggcatgggtgctctgagaacggtgctccttgcatctcctgagcattgtgctctgggcacggtgctccctgtgtctgctgagcacaggtgctctgggcacggtactccctgtgtctgctgggcacaggtgttctgggcacactgctctctgtgtctactgggcgcacgtgccctggaaatggtgctccctggatctgctgggcacagatgttctgggcacgatgctccctgcatctgctgggcatggtcctctgggaacagtgctccctgcatctggtgggcactggtgctctgggcattgtgctctctgcgtctgctgagcacaggtgctctgggcacagtgctccctgagtctgctggacacaggtgctctgggcacggtgctctctgcgtctgctgagcacaggtgctctgggcacagtgctccctgagtctgctggacacaggtgctctgggcatggtgctccctgcatctgctgggtagaggtgctctgggcacagtgctccctgagtctgctggacacaggtgctctgggcacggtgctccctgagtctgctgggtagaggtgctctgggcacggtgctccctgcttctgctgggtagcggtgctctgggcacactgctacctgtatctgctgggcacatgtgctctggaaatggtgctgcctgcatctgccgggcacaggtgctcctggcgctgtgttgtgggatatgtacatccccagccatttgctgtccttgggcaacttagcaatgtgcgatggtattgttactttattttttagaaggaacaagaaacacagaggtgagacatagaaaaggaaaacggatctatttaaaccttctcttgtgcccccatgggaatgtcaggcactgcatctgcaggtggcattggtgtggactcctgtcgacacgcaatgtactgtctgtccatcagcaggtctctcttgtgaattcctcctaaccccgccttaaggataaaaacgattcctctgtgggaataatcatcttagtttgtttaagctgatataagaaaaaatccagcagtccgggtgtggtggctcacgcctgtcatcccagcactttgggaggctgaggcaggtagatcacgaggtcaggagatcgagaccatcctgaccaacatggtgaaaccccatctctattaaaaatacaaaattagccaggcgtggtggtggacgcctgtaatcccagctactcgggaggctgaggcaggagaatcgcttgaacccgggaggcggaggttgtggtgagccaagatcacgccactgcactccagccggagtaacaacagcaaaattccgtctcaaaaaaaaaaaaaaaaaagaaagaaaaattccatagtttgggtggcttataaataacacacatttatgtctcacggttctggaggctggaagtccaagatcaaagtgtgccagcgtctggcgagaacccgcttcctggttcacacatggcaccttctcactgtgtcatcaagcagtggaaggggcaagggagctctctggggtcccctttataaaggcactgattccatacttgagtctcccccatcgtgacctcatcacctcccaagggcctcacctcctaacaccatctcacgggggatgaggatttccatgtaggaatttggagacagacacagtcagagcacacagtcggactcgcctttgaatttctctgcagccctaagatcacaaagcgttaatgccacactcggaaagaactggctgcttggctgtgccagcatcagactttggggccagcctctgtaatgtacagcagggtgggcgccctccccacccccaggccctggagtaccctcaggactacgaggagggtgagcccaggggcacaggccctgccagctcctaacagtttgcatttccctgcacagcgaggggcaggatgtaacgaagggagggccgtgggggcctcctaggataccttggcccatctgttttgtcgaattgagctcctgtgtctgtgagcctctctgctctgaagggtgtgggatgagggagtcggcctcgatgggatcctgcatgaagtgtgaaccctgccggttgtgggagggaaggagcgaggctggccaggacttcatcttctccgggcagctgaagaagcaccgggctgtgcagggaagggcgggtgagaggaatgcagggagagcagggcctgtggccgggaggggctgcttctccttcatggtgccctgaggaagcaagggcatgtgtgcgtgcctgtgtgtacagctgagatgtgtgtgccaatgtgcacaggtgaggtgtgtaccagtatgcacaggtgaggtgcatgcgtgcccatatgcacaggtgagttgtgtgtacctgtgggcacagatgaggtctttgtgcccgtgggcacacatgagatgtgcatgcctgtgtacacaggtgaggtgcgtgccagtgtgcacagataaggtgcgtgagtgctcgtgtgcacaggtgagtcatgtgcgtgccagtgtgcgcaggtgacgtgtgtatgctggctggggcatttcctgttttcacacccatgcatgacagcacccagaggaagacatgcgtgtttctcaggcttcttctcagctcagggctcactgcaggattgtgtaggcctcctgcctcgggctccatgctgaagggtttgcctggacccactggcaagaacagccctgccatgactggcttccctaactccaggcctgaggctgggctgggtgtgtgggggccagccttccctgatgcccactcggggctccacacacggagcctgctgtatgagagggcctgggagaagggaggagggaacgaggagtcttggcacagccagcagcacttgctgcagacacgactcactgagcaaggcaaggcatgggttggggaacctggggaatgtgagctgcttggcaggcattaccgctcgccaaagacacacaggaacaccccttcctcgtacagcactggtggagggccgcctgtctgttattctgagagctcactttggggttgatactgttgatcaaagcaatctctgttgtatttactcattttttttttcagatggagtctcactctgtctcccaggctggagtgcagtggtgtgatctcggctcactgcaacctccgcctcccgggttcaagcaattctcttgcctcgactcccaagcagctgggactacaggcacccgccaccacgtccagttgatttttgtatttttagtagagacaggattttgccacgttggccaggctggtctcgaactcctgacctcaggtaatcctcccatgtcggcctcccaaagtgcgtggattacaggcatgagccaccgtgcccagccacgatctctgttttgaataatgaagataagcagatcacatccagaacaaccccacccaacagaaatgacagctacttcctagagactttaggtgctacagagcagattcatgcgcttaataagaattgagcctcattatcacctaagaaagctgaggaagcatatattaccaagtgcaattaacaagagagtttttattcctataaaaacacatattaaagaaaggctttgacggtattgcttatatgccattaactattattttattttattttttgaaagagacaaatgtcactctgttgcccaggctggagtgcagtggtgctatcttggctcacggcaacctccgcctcccgggttccaatgattctcccacctcagcctcccgagtagctgggattacaggcatgcaccaccacacccagctaatttttgtatttttagtagaaacagggcttcaccatgttggccaggctgtaatcaaactcctgacctcaagtgatctgcctgccttgacctcacaaagtgctgggattacaggcatgagccaccacacccgaccaccattaactcttatctgaagagttatgtccacatcctaactccaaatatgtataattgagacctaatttagaaataggtctttgcagatggaattaagtgaagatgagatgattagggtagacccttgatccaatatgatgggtggccttacaagaagtagaaaatacctgggcacactggctcatgcctgtcatcccagcactttgggaggccaaggtgagcagatcacctgaggtcaggagttcaagaccagcctgaccaatatgatgaaaccctgtctctactaaaaatacaaaaaattagccgggcgtggtgctgcgcgtctgtaatcccaggtactcgggaggctgaggcaggagaattccttgaacctgggaggtggaggttgcagtgagctgagatcgtgccattgcactccagcctgggcaacaagagcgaaactctgtctcaaaaaaaaaaaaaaaatgaagtagaaaatttggagacagagagacacagagaaggccacatggagatggagatggaggtggagactggagtgatgcggccacacacccagggatgcctggagcccccaggagctgggagaggcaggaaggaccctcccctccaccctcacagataccccagagtaacattcaatcaaacatctaggtgccccatgatccagtcaggttaacacataatattaactattccgaccccactctacatataagaagggccctaaatggaatgacaggtgttcttggaaagagacagaagaggagacacagacacagaggagaaggccacgtggagatggaggcagagactggagtgatgcagccacagggtcagggatgcccggagcccccaggagctgggagaggcaggaagggccctcccctagagcctctggagggaactggatacaattgtagtggattgaatggtggttcacagaaagatctgtccacatcccgaagcccagaacctagaatgagactttatttgaaaataaagaactttgccggtgtaattagttagagatctagagatgagatcatcctggagtagggtaggtcctaaatccactgaccggtatccttctaaaagacagaagaggagacacagacacagaggagaagtccacgtggagacggaggcagagactggagtgatctgaccacggggtcagggactccccgagcccccagaagctgggaaaggcaggaagggttcctgccctagaagaccgtccagagagagcacgaccctgtccactcctgaatttcagacttctggtctccagaaggtatcacttcactggatgaatttctgtgactttgaagcatccagtctgtgctcatttgtttggacaatcccaggaaagtaatacagattgcaaagcagatcaaggaacttcaaagtcaaagggcttgagagccagagccagctcagagccggctctaacattttttgtttatttatttgtattgtattgtttttattttaatttattgtatatatctatatctatatatatatctatatatctatatatatatctatatatatctatatctatctatatatctatatctatatatatctatatctatctatatatctatatctatatctatatatctatctatatattttttttttgagacagagtcttgctctgtcgcccaggctgcaatgcagtggtgcgatctcggctcactgcaacctctacctcctgggttcaagcgattctcctgcctcagcctcctgagtagctgggattacaggcatgcgccatcacgcccagataatttttatatttttagtagagacgggggttcaccatgttggccaggatgatctccatctcctgacctcgtgatcctctcgcctcggcctcccaaagtgctgggattacaggcgtgagccactgcgcccggccacttccccctattttttcgagacttacaattcaacttacactgcttttcttttcctgttctcctcttttgcttcaccagtttgattatgtaaaatgaatattgatgacaggcattcacctgagccatgtttcatttctccatgattcctctgcaggggataatgagagagtgttaacagatgcctcctctgagctttctggaaactgttcttcgttgacggcactgactctttccaaataggcccctttttcatcgttcatagcttaggagtgatctcttaaaggagagaacattgctttgctggggctgccataataaaataccacggacctagtggcttaaacagcagacattgagcctcccacagtcctggaggctggaggtcccagatcaaggtgtgggtgtggctgactcctcctgaggcctctctccttgggttgtagacaccgtcttctccctgtgtcctcacaggatcatccctctgtgtgtgtctgtgtcctcatctcctcctcttatgaggtgtcttagcccatttcaggctgctatcacagaataccatagactgggtagattataaacaacagacattattctctcacagtcctggacgctagaagtttgagatccaggtatgggcagggctggttcctcctgaggcctctctgctggacttgtagacgccatcttctctctgtgtcctcacagggtcgtccctttgtgtgtgtgtgtgtcctcatctcctcttcttatgcaatgccttactccatctcaggctgctatcacagaataccatagactgtgtagcttataacagcagacattgattctcccacagtcctggaggctggaggtctgagatcaaggtgtgagcagggctggttcctcctcaggcctctctcctgggcttggagatgtcatcatcgccctgtgtcctcacttggttgtccctctgtgtgtgtctgtgtcctcatctcctcttcttataaggacctcagtcctattggatcagtacctaccctagtgacctcattttacctgaatcgcatctttaaagaccccatctccggccgggcatggtggctcatgcctgtaatcccagcactttgggaggctgaggcaggtggatcacctgaggtcaggagttcaagaccagcctggacaacacggtgaaaccccgtctctacttaaaaaatacaaaattagccaagcgccatggcaggtgcctataaccccagctactggggaggctgaggcaggagaatcgcttgaacccgggaggcggaggttgcagtgagccaagattgcaccattgcactccagccttggtgacaagaccgaaactctgtctcaaaaaataaataaaataaaaggaccctatctccaaataaggtcatctttctgagttcctcagagttagaacttcataggaatctggggagacgtaattcagtccatgagatacgcccaggtccccttggtagaatagaacacgcctcagccggcgtcttctgtattactgtaggagcccctagatgaccagatggtggtaggacagccaggtattcccagtcaggtgcagttgcctggatgtgtgttccccgaattattgtgcattgggccatctggccgacgaacttcagcttccgtggttagctccgtctccatctccctgatttttctgttcttgtgtcatccctgcgtcacatatgactgaagttcagtaaatatatggtgagtgggccgggcatggtggctcacgcctgtcatcccagcacttcgggaggccgaggcaggtggatcacaaggtcaggagttcaagaccagcctggccaacatggagaaaccccatctctactaaaaatacaaaaattagctgggcgtgggggtgcacacctgtaatccctgctactcggaaggctgaggcaggataattgcttcaactgggactcgaaaggcagaggttgcagtgagccaagatcgcaccactgcactccagcctgggctgcaaagcaagattctgtcttaaaaaagaaaaagaaaaaagaaatgaagatgctcccattctcagaccatcctccagatctcctaaacccgaagtttggagaacaggggttggcaaggagaaggtctttgggggaattctgatgcatgctaaaatatgagaaccacttgaatttaaaatatactgctttttttttttggatgaaagatgtggttcttggcttttgcctgatataatcattgccagtaattagtgttaattgccaagattgatttactggcttggaaaattagcgttcttgtaaaggaataaatcacagtgttgtaacatattccaaaaatccaagagtttttacacatgagagaacatgtctcctcaacttggctgtaccgaatcatccccatggtgaaataaatttcaatagaaagcactttgggaggccgaggcgggcgtatcacctgaggtcaggagttcgagaccagcctggtcaacatggggaaaccccgtctctactaaaaatgcaaaagttagccaggcatggtggcatgtgcctgtaatctcagctgctttggaggctgaagcaggagaattgtttgaacccgggaggtggaggttgcagtgggccaagatcatgctactgcactccagcccagcttgcactccagagcaagactccctctcaaaaaaagaaaaaaaagggcaggcacagtggcttaagtctgtcatcccagcactttgggaggctgagaggggtggatcgcaaggtcaggagatcaagaccatcctggccaacatggtgaaaccccgtctctactaaaatataaaaaattagccaggcatggtggcatgtccctgtagtcccagctactggggaggctgaggcaggagaattgcttgaaccggggaggtggaggttgcaatgagccaagatcgcaccactgcactccagcctggagagaaaaaaaaaaaaaaaagagggacacataccttccaaaatcattttctattctttaagatttctttcctgtgagacccttaaatttgttttgttttattttattttatttgagacagagtttcgcttttgtcacccaggcatcgaggctggagtgcagtggcgcaatctcagctcactacaacctctgcctcgtgggttcaagtgattctcctgtctcagcctcccgggtagctgggactacaggcaccgccaccatgcccacctaatttttgtgttttttttttgtagagctgggttttcaccatgttggtcaggctggtctcgaactcctgacctcgaatgatctgcccacttcgacttcccaatgtgctgggattacaggtgtgacccaccgtgcctggccatgatagattctctacctatttaagaaattctttatttcactctgacgtccctcagtcatggagttgttataggcatgggcgtgcctcactgtgaacatggctgtcttggtttgagtttctcaacttatgtaactttgggtgacttcttcattattttattcctaaccatgaattcacatcccgtgaaatcatccagtatagactaagttgtgtaacgtgttttgagtgtggtatcccatctcgattcggatttcactcaaggtttcacatgttccccctgtgttctgagatatgtcggacagctgacacactcactatgtgtctatgagcgaaagtatcagggtgtttggatgcagctggaattcacaagatacctgcaatgtcctgtgttgttttggttgttttctcttagcggaaaaagtcaaagacctctctttgagatcgacaccatccaggccaatgtggtaaaaacccgtctctactaaaaatacaaaaattagctgggtgtggtgacgggtgactgtagtcccagctactcaggaggctgaggcaggagaatcacttgaacccgggaggtggaagttgcagcaagccaagatcatagcactgcactccagcccggcctgggcaacagagcaagactccctctcaaaaaaaaaaaaagaaaaaaaagggggggggcgtggggcaggcacagtggctcacacctgtaatcccaccactatgggaggcctagggggtggatcacaaggtcaggagatcaagaccatcctggccaatgtggtgaaaccccactgtgctaaaaataccaaaattagctgagtgtggtggcgggcacctgtagtcccagctactcggaaggctaagacaggagaatcacttgaatccgggaggcggagattgcagtgagccgagatcgcaccactgcactccaccctagcaacagagcgagaccctgtttcaaaaaaacaaacaaacaaaaaaaacctctctttattcgcagtattttctgagttcctggtaggcggatcgttatcaagaatattaaatgtagatgatagttatcaagaatattaagcgtagatatcctagaaagaatgtaatggagttgtttgtactgccaaagggaaaattcaatttagacatgaaggattgttataatacttataaatatattgaatgccacccatacttactcattaaaacagtgattgtcatcaggtttaatgagcactggaaaaatagctccagtcaactaggttatgagcagtcgattgagtttccctaattgcattggcaatttgattatgcaacaatgtcctgcaatggaaatacgttgcaatgcaacggattcgtaggaagttaacataaaaactcagttgtccttgcttctacacaagtacctctcaaagtggataaataatcaatgcaaaaactgcctgttgatccatataaaaggacaccgcctacggagactggctgttgggagaccgagatatgacacgtttacatcctacagtatccatcacaataacttataaagggctcctttctttttgtttttttttgagacagagtcttgctttgttgcccaggctggagtgcagggtgtgatctcagctcactgcaagctccgccttccgggttcacgccattctcctgcctcaacctcccgagtagctgggactacaggcgtctgccaccacacccggctaatttttttgtatttttattagagacggggtttcaccctgttagccaggatggtctcgatattctgacctcgtgatccgcccgcctcggcctcccaaagtgctgggattacaggcgtgagccaccgcgcccggtcttataaacactcaaaagtatgttcagtcttcacgatttttaataacaagaagagagtaatgctttaatcagcaaaaaatggagaactcaaatacccttttataaggtccagatttagtagcaggtggcttttgttcagtttcttattcaacaggaaagctcattgaatgattttttgtttcattttgttttttggcagtctccctgtctcacccagactggagtgcagtggcgccatctttgctgattggctcacggccatgtccgcctcccaggctggagtgtggtggcgccatcttggctcactgccatgtccacctcccaggctgcagtgcggccgcgacatcttggctcacggccatgtccgcctcctaggctggagtgccgtggcgccatcttggctcacggccatgtccgcctcccaggctgcagtgcggccacgccatcttggctcaaggccatgtccacctcccaggctgcagtgccgtggcgccatcttggctcacgaccacgtccgcctcctaggctggagtgccgtggcgccatcttggctcaaggccatgtccgcctcccaggccgtgcagtggcgccatcttggctcactgccatatctgcctcccaggccgtgcagtgacgctatcttggcttgctgccatgtgcgcctcccaggctcaaatgatctgctcccacctcagcctcacaattagctgggactacaggtgtgctttaccacacccaggtactttttgtattttttgtagagataaggtcttactatactccccagtctggtcttgaactcctgggctcaagcgacctgcctgccttagtgtcccctaagtgctcagattacatgcgcgagccaccactcccggcctaataccaacgacttttgtcagagtccttagggtttcatttacagaccttaatgggcatttcctcctacgtatttgctttcattctttcccatttctggggtggatatttcttcatccctaacccccaccccagggaatctctcctgaaactacgtgcccctcttggattcatttcttcacctcctgtagagaaatgtattggcttttcgcctgcccccacaccgtatttttaaacaatcttagttctctcttctccacgctactgtgtaaaaccataattacagaaccaacccctccatttactctggaaaaatctgcctttggatgatgcattttctgctttttcaagtaaccattcctcttacccatcaatcaaatgctggagattcagaaccgaatgcttgtagctgatatttaaaaaacgatcatgccagcaggaaagccagtctttgcctctctgcacttagtaactatctgtttcctggactcttctcttcccctggggtgaggagattggagaagtttgccttaaaaagatatcttgacagtaattggaggtttacagtttatcttggatcagagatgggacttcagctctgaactactcaatttccctgtcttaattcttccagtctcttagatttctttttatttatttatttttgagacagagttttgctcttgtcacccaggctggagtgcaatggcgtggtatcagctcactgcaacctctacctcccgggttcaaggattctcctgcctcagcctcccgagtagctgggattacaggcacctgccaccacgccctgctaatttttgtatttttagtagagacggggtttcaccatgttggccaggctagtctcgaactcctggcctcaggtgatccacccacctcagcctcccaaagtgctgggattacagacataagccaccatacccagccaattcttccaatctctttattatgcagtcagcctttccagtcccctcctaccccaccccaacccccaaaaagttatgttttgattgttcattattttgcaaagtctccatggctaaggacccccttgtcaccctttctgtcctgcccttatttatttctaaggcagcagacctgaggtttcttttccagcagaaatcgggtaaacctcaggtctgtttgaaatgcttgttccccagtgccataaagaaatagcacttgaacattaatttcctcagcaaggccattttttttactttctgcagaaagggtacactctccagcagttttgccaggagagtacagcgaacaaaggggacagggtcatttatcacttgatgcgtccgccctactgctgtgtccagtttccagggctggaatgggacctcacattctgtatttgtcccgattggccagcaccttggaactatttaaaagaggcaaaggcagaggagaacaaaggaaggaggaagtaacttgtggaatgctgagaaaggaaaaagcacttttagataaagaagaggaacaggctgtgacgtaatgcttgcttggaccagtataagcatgccagggctgatacttaggttaaattgtgggagctaagagcataaagtacattgatttctttatcacggctagcagatatttaggaatgttagcacaagtctttgaatgaagtttgcttctcagagaagttactatttattcctaattagatggggaggaaagtctttgaacaggaacctttattttttacaggcccgatgtcagattttggcatgtggctttctgctacccatggctgcgtgatgagacagtggctggaggcagaactgagcccctggaggtgttaatgggggagtcacttgtcctcatgcaagcattcaaacatgccttttgcacaacggcaaggcacatctcagaacatgtcagctgcaggctgcgatttcccgggtacgagctttccaagctctgtgatccactctgtctttggttacatgaaggtgggaaaattgctcagttgctaagatcacagtgttggggctcagaaaacaatcccctaaatttttcagaggcattagaaccagagcaactctgccatcttgaataggggctgcgtaacatgaggctgagacctgcttgggctgccttctctggaggtggatgaggcattctaagtcacaggatgacagaggaggtcagcacaagacacaggtcacaaaggccctgctgataaaccaggttgtggtaaagccagccaaatcccaccgaaaccaagatggtgacgactgacctctggtcatcctctctggtcatgatacgctaattctaatgcattagctgataagagacggtttacagatgccatgacatggtctaaaagggggatgaaccttcagctccgggaattggtcacccctgtcccagaaaactcatgagtaatccacccgttgtttagcatatgatagagaaataaccataaaaataggccaccagcagctctcgggatgctccatctatggagtacacattctttattcttctactttcataataaacttgctttcactttactctatggacccactcggagttctttctcacgagatccaagaaccctttcaaacccctgaaaggatcaggtgatccgcccacctctgcctcccaaagttctgctgggattacagatgtgagccactgcacccagccagaaaagactttttgaatcaatgcttaattttttttttttttttttttgagatggagtctcactctgttgcccaggctggagtgcagtggcgtgatctcggctcactgcaatcttcacctcccgggttcaagcgattctcctgcctcagcacccaagtagctgggattacaggcatgcgccaccactcctggctaactttttgtatttttaatagagacggggtttcaccgtgttagccaggatggtctcgatctcctgacctcgtgatctgccagccttggcctcccaaagtcctgggattacagacgtgagccaccatgcctggcccaaggtttatttttttaagatcaatttcaagtagtgatgttactaaaagatattcataggccaggtgcgttggctcacgcttgtaatcccagcactttgggaggccaaggcgggcggttcacttgaagtcaggagttcgagactggcctggccaacacagtgacaccccatctctactgcaaatacaaaaattagctgggcgtgatggtaggcgcctgtagtcccagctacttgggaggctgaggcaggagaatcacttgaacccgggaggtggaggtcgcagtgagctgagattgcgccaccgcactccagcctgggctacagagcgagactctgtctcaaaaaaaaaaaaaaaaaaaaaaaaaaaaggcacaaaaagggctgagcgtggtggctcacatcacgtctgtcattccagcactttgggaggccgaggtgggcagatcacgaggtcaggagatcgagaccatcctggctaacacggtgaaaccccgtctctactaaaaatacaaaaaaaaaaaaaaagccgggcatggtggcaggtgcctgtagtcccagctactcaggaggttaaggcaggagaatggtgtgaacccaggagggggtggttgcagtgagccaggattgtgccactgtactctagcctgggcgacagaacaagactctgtctcaaaaaaaaaaaaaaaaaaagatttatgattttaaagattgagttgcatgttgtgaagttgctctcccaaaagatgtgcaaatgtatgtgcacgcccttcctttggttgtctggccagttttccccatgttcttcacagtggaaatgatgacagtgtgataggagaacagatggagggtcattccctctgattttgcaagctgaaaaatcaacttgcaaaagcagatgaataggagaaaaggcatacaaagtttactcgatggatacatacagcagccttcagagggaagacccaaagatgcaggggaaaccgtctatttttatgcttaggttcaacgacgtctgaacgaaatccgtgtaggaataggattggaggaagagggtgtgatctaaggctgacggtctgagtggggaaacagacaggcctgtctagatttttttggcctctgagcagtgcgccttccttctgggggtggggtgggaccctctctgggaagggggtcgtagaacctacattcaaacaaggcaggtcaaggaatttccttttccttttcttttctttctttttcttttcttttctttttctttttttttttttgagacagagtcttgctcttgtcgccctggctggagtgcaatggcgcaatcttggctcattgcagcctccaccttctgggttcaagcaattttcctgcctcagcctcccgagtagctgggactacaggtgcccgccaccacacttggctaatgtttgtattttcttttttctttttttttttgagacagagtctcgctctgtcgcccaggctggaatgcagtggcgcaatctccactcactgcaagctccgcctcctgggttcacaccattctcctgcctcagcctcccaagtagctaggactacgggcgcccaccaccacacccagttaattttttgtatttttagtagagaccgggtttcaccgtattagccaagatagtctcgatctcctgaccttgtggtctgcccaccttggcctcccagagtgctgggattacagacgtgagccaccgtgcccggcctaatgtttgtattttcagtagaggtgatgtttccctgtgttgggcaggctggtctcgaactcctgatctcaagtgatccacctgccttggcctcccaaagtgccgggattatagccgtgagccactgcacgatgataggaaatttctttatggcgagtttttatatactcagggtgtagggaaacttagagtcctatttatagggtttctggctggccttgggggaaaggtgctttggttttcgggacccaccttggggaagaaggattccagtttccgtggtgcccttggggcgaaatgggtctgagagacaggagggtaggagaaggtcagcaagaaaggtttgcttctgatgctgcttctgaggtcttcattttaggttactgttctctgagccccagcataggcatgcattattggttttgttcatttattttatgaaaaaatgaatacatgaatatagagggtatctaattttttttttttttttttttttgtgagacggagtttcactctatcaccaaggctggagtgcagtggcgcaatctcggctcactgcaagctccgcctcccgggttcacgccattctcctgcctcagcttcccgagtagctgggactacaggcgcccgccaccatgcccgggtaattttttgtttttttagtagagacgaggtttcaccatgttagccaggatggtctcgatctcctgacctcgggatctgcccatctcggcctcccaaagtgctgggattagaggtgtgagccactgcacccagccctaattttttttttatagtttcagggtctgctctgtaattgtaatattctacttttcatctgcaaaatatagtgtatattggacattttataacagggagaggaggtttagaaaccaataccagggccatgtacagtggctcacacctgtaatcccagcactttggaaggccaaggtgggtggatcacttggggtcagaagttccagaccagcctggctaacctgatgaaaccccgtctctactaaaaatgcaaaaattatctgggcatggtggtgtatgcctgtaatcccagctactcaggaggctgaggcaggagaattgcttgaacctaggaggcagaggttgcagtgagctgagatggcgccactgcactccagcctgggtgacagagcaagactccttctcaaacaacaacaacaaaaaccaacatcagtctctgttccccagtggtatcatttatgtttatactgttttctttctgtatttctcatttgctttgatctttttggttttcttttatgtgttttccttaggaaagcattttcatttttcttctccagatccttaggtcaaagtttacttcatttatttcaattttctattcttttattttctttctttttctttctttctttctttctttctttctttctttctttctttctctttctttcttttcttttctttttctttctttcttttctttcttttctttctttctctctttctgtctttctttctttctttttttgacagactttcactctgttgcccaggctggagtacaatggcgtgatctcgtgtcactgcaacctccacctcccgggttcaagtgattctcctgcctcagcctcccaagtagttgggtctacaggcacccgccagcacgtccagctaattttttgtatttttagtagagatggggtttcaccatgttaaccaggatggtctcaaactcatgacctggtgatctgcccacctcagcctcccaaagcgctgggattacaggcatgagccaacgcacccagccctcaatattgtattcttatttaggaacagcttttgttggtaagaggcattggattttcagaagctttttctgaaacgcatatgatgacggatgtctttcttttgatcttttgaatgtgttaaacattcttttaggctttttgatcttatctttagttttttagcataaatatcatgctgatattcaaactatatctgagatggctttgtgaaccctgaaaatttgagacaggtctcagttaatttagagtttgttttgccaaatttaaggacgtgagcctgtgacatagcctcagaaagtcctgatgacgtgtgcaacgtggtcaggtcacagcttgttttttttttgtttgtgtgtttttttgtttttttgttttttttgagatggagtctcactctcttgcccaggctggagtgcagtggtacaatctcagctcactgcaccctttgcctcccaggttcaagcaattatcctgcctcagcctccggagtagctgggactacaggcacatgccaccatgcctggctaattttttaatttttttttttagtagagacagggtttcaccatgttggccagcctggtctcaaactcctgaccttgtgatccgcccgccttggcctcccaaagtgctgagattacaggcatgagccactgcgtctggccatagcttggttttatacattttagggagacaggagacatcaatcaatatatgtaagagctacgttggggtgggtgcggtggctcacgcctgtaatcccagcactttgggaggccgaggcaggcggatcacctgaggtcaggagttcgagaccagcctggccaacatggtgaaaccccatgtctactaaaaatacaaaaaattagccgggcgtggtggcgggcgctggtaatcccagctactcgggaggctgaggcaggagaatggcttgaacccaggaggtagaggttgcagtgagccaagattgtgccactgcactccagcctgggcaatatgagcaaaactctgtctcaaaaaaataagaagtatagtccttgaaaagcagggacaactggaagcagggagggggcttccagctcacaggtaggtgagacacagatggttacattcttttgggtttgtgatgagccttcccaaaggaggtgatcagatatgcatctatctcagtgagcacaggggtgactttgaacagagtgggaggcaggtttgccttcagcaggttccagctggacttttcctttgagcttcccgcttttggggtgcccagatattttctgttcacagcttccatcaggatacatataccatgtggttaattcagaaaattaggccgggcacagtggctcatgcctgtaatcccagcactttgggaggccgaggtgggcagatcacgtggtcaggagatcgagaccatcctagctaacatggtgaaacctcgtctctactaaaaatacaaaaaattagccaggcaggtggcaggcgcctatagtcccagctacttgggaggctgaggcaggagaatgacttgaacccgagaggaggagcttgcagtgagccgagatcacgccactgtactccagctgggttgacagagcaagactctgtctcaaaaataaataaataaaaataaaatttaaaaatatatatatatataaaagaagcaagcgatatgaaccttcagccaccttgaaatgttgttacgataattgtgtagcaaattgatcgcctctgggcatctttggagccccagaggaaagaaaaacattattgctcaaatacttctccttgtcttattgaaaagaactatgaggccaattctaaggctaatgatctgtgcctagcattaaattctaaaaggagtctatggtggttgtgtgccttcaagggacgttatgtaacaccgcaaataacatctctttaaaaagtgtttctaaggcatacatagaaaaagtagaacatatttacaggagcaaagctggaaacatccagttttctgtgtttctggtgattgaggttaccagagagagagagagaggcacgttactcactttaccgcggttatcggatcgatttttatcactatgtcctgtgatactaaaacatttctctaaactgcttgaaccaaggtgcaaagagtttaacatgtgcttagcacactacagagcttgcagtagatgtgaggaaaatttatgatagcttgggaagtttgccaaattgcttgtgtggttgtcttttatgatttgagactcatcaagaagaccacatgtggccaggcgcggtggctcatgcctgtcatcccagcactttgggaggccaaggagggtggatcacccgaggtcaggagttcaagaccagcctggccaacatggtgaaaccctgttcccactaaaaatacaaaaaattagccgggcgtggtgacaggagcctgtaatcccagctactctggaggctgaggcacgagattcgcttgaacccgggaggctgcagcctgggtgacagagtgagaatctgtctcaaaaaaaaaaaaaaaaaaaaaaaaaaaaaaaaaacagggagcatagtggctcctgcctgtaatcccagcactttgggaggctgaagcgggtggataatttgaggtcaggagttcgagagcagcctggccaacatggtaaaacttccatctttgctgaaaatacaaaaaattagcagggtgtggtggcgggcacctgtagtcccagctactggggaggctgaggtaggagaatcacttgaaccgggcaggtggaggttgcagtgagccaagattgcaccactgcactccagcctgggcgacagaggggggactctgtctccaaaataaataaataaataaataaaaaattagtaacataatttaacatatctgaccccaatacaattaagggatgagtttataataaaaaggtgaactagaaaaatccacacgcgttggaaaactggccaacagatggcatgatcacacatgggtctaggggaggtggctgcgtatagacgtggccgtggccgcaggtacagatgctgctgggatgaagcacttaggcgtgaacgccgtcagcctcttacaccttctcctgcttgccccacagtgcctgctactcaccccacgcagcctacgcccagagcaagctggcccttgtcctgttcacctaccacctccagcggctgctggcggctgagggaagccacgtgaccgccaacgtggtggaccccggggtggtcaacacggacgtctacaagcacgtgttctgggccac

SEQ ID NO: 2895 - DNA, 163129 bp, human; identical to SEQ ID NO: 2889

SEQ ID NO: 2896 - DNA, 235951 bp, human; identical to SEQ ID NO: 2890

SEQ ID NO: 2897 - DNA, 281462 bp, human; identical to SEQ ID NO: 2891

SEQ ID NO: 2898 - DNA, 233880 bp, human; identical to SEQ ID NO: 2892

SEQ ID NO: 2899 - DNA, 209087 bp, human; identical to SEQ ID NO: 2893

SEQ ID NO: 2900 - DNA, 257911 bp, human; identical to SEQ ID NO: 2894

SEQ ID NO: 2901 - DNA, 163129 bp, human; identical to SEQ ID NO: 2889

SEQ ID NO: 2902 - DNA, 235951 bp, human; identical to SEQ ID NO: 2890

SEQ ID NO: 2903 - DNA, 281462 bp, human; identical to SEQ ID NO: 2891

SEQ ID NO: 2904 - DNA, 233880 bp, human; identical to SEQ ID NO: 2892

SEQ ID NO: 2905 - DNA, 209087 bp, human; identical to SEQ ID NO: 2893

SEQ ID NO: 2906 - DNA, 257911 bp, human; identical to SEQ ID NO: 2894

SEQ ID NO: 2907 - DNA, 163129 bp, human; identical to SEQ ID NO: 2889

SEQ ID NO: 2908 - DNA, 235951 bp, human; identical to SEQ ID NO: 2890

SEQ ID NO: 2909 - DNA, 281462 bp, human; identical to SEQ ID NO: 2891

SEQ ID NO: 2910 - DNA, 233880 bp, human; identical to SEQ ID NO: 2892

SEQ ID NO: 2911 - DNA, 209087 bp, human; identical to SEQ ID NO: 2893

SEQ ID NO: 2912 - DNA, 257911 bp, human; identical to SEQ ID NO: 2894

SEQ ID NO: 2913 - DNA, 64446 bp, human
tgcctacactggtcccacaggttttcagctgtggagtttgggatctgagcttggagcccatttgtttctggcagttccgctcatattttccacttgaagacatcgcctcccttccttccaagctgggagaccagaagtcaacaacaggagggtggagaggccgggtctcacaatccgcttggctggggagtccactgaggttcttgcatcctgaagcaaaccatggagagctggtggggacttccctgtcttgcgttcctgtgttttctaatgcacgcccgaggtaagaggcattttgctttgagggagatctgcctgggcatggatttttctattcttgctttaagaaactctttccaaaggagttgctatgaagtgaatggggataatttgcccaatgggattagaaaggagactaagagcgatgggtggctgagaggggagggagaagacgggctgctcccatttggaatctgggaattagatccagaagggcaggatgttagctgataccatctagatattcgccatattttcctgttttgatccatgtgtcccaagcgtttaaaaaatgacctatttaactccatgattcaagcatgactgggtgtgtgtggaatgtcagtcatttctttctgattttaaaaattagttctgaccatttccatacagtaaaagtagagttgaaactacttcatcccgtggggcagattaccagagattcgtttgccggaagggttgcatttattcagatttttaaatcttttcctaaacactgtcattcattcttgcaaattaaaaccacctgaattgttcacatcaaaaacttcgatataaacttgcaggctggctgtcccagatccaagattagatttttcagttccgtacgaggacctctttaagaaactccaatgaactcataaagtacaggatttgaacaacggttgagtaagtttctttggtcattttcatgtggcgatttcagagaagggaacacctgggcgcatcttaagagagagaagtatttctgttaggagttaaaacacatcattcagatgtccctgtggcagcatttcctgtttatcctatttaaagacatggacgtcattaagattggagttggttgtttatgggcggaggcggtgtcgggatggatagatcctggtggacatagtctaggatctgcagtgagaattttttattattctgtgctgtcttcagatctcacctagtaagtggacaatgtggccatgcattcattagcttctgtttacagggagatgttcaacagtaaacccacctccccagaaaagtacttccaggagtttgtatcattcacagtaagagccaaaggttaaccatatccccttgggcaaatcaacttctacaaagtgcggatacagacagttcccaacttaccatggtttgacatgatggttcaatttaagatttttcaactttacaacggtgtaaaattggtatgcattcagtacaaacgaaaactgtactttgagtacccatacaacttttcttttttttttttgagatgtcgtgtcgtttcattctgttgcccaggctggagtgcagtgacacaatctgagctcactgcaacctccacctcctacgttcaagcaattctcctgcctcagcatctcaagtagctgggattataggtgcccaccaccacacccagctaatttttctatttttagtagagactgggtttcaccatgttggccaggctggtcttgaatcttgacctctggtgatccaccggcctcccaaagtgctgggattataaatgtgagccaccatgcccggccccatacagccattctgtttttcactttcagtacaatgttcaataaattatgtgaggtatgcaacacctcattataaagttgactgtgtgctagatgatttgtccatccgttggctgatgaaaagtgttctgagcactctgaaggcaggtaaggctaagctatggcgtttggtagggtagttgtattaaatgcacttacaacataaaatattttcttttttttaatgtgttttaatttttttgagggaggggcccactgtgtcacctagactggagtgcggtggttccatcatagctcactgcagtcttcaccccaggggttcgaacaaacctcccacctcagcctccagagtagctgggactacaggcatttgccgctgtgcctgactagtttttaaaactttttgtagagacgggatctcactatgttgtccaggctggacttgaacatctcagctcaaacgatcctcctgccttggcctccccaaatcttgagattacaggcatcagccaccataccctgtcctgcgctaaattctttgactgacggcagcacttcctatgcactaggcatggattaacttagttgattgtccctcagccctatgacgggagtgtcgtgcctgatgtcattttacagatggtgtattagtcagggttctctagagggacagaactaatgcaatagaaatatatatagagagaggagtttattaagtattaactcatatgatcacaaggtcccacaacaggccgtctgcaggctgaggagcaaggagagccagtccaggttccaaaactgaagaacttggagtctgatgttccagcatccaccatgggagaaagatgtaggccagaagactaggccagtgtctcttttcacatttttctgcctgcttatattctagccacagcggcagctgattagatggtgcccacccaaattgagggtgggtccgccccttccagtccactgactcaaatgttaatctcctttggcaacaccctcacagacacacccaggatcaatactttgtatccttcaatccaatcaagttgacattcagtattaaccgtcacagatatgggtaaactgaggcactgaggatttggacgggggcagccggcagcggaatctgagctgtcctgtagctctgtctgggaagactccagtgagcatcccgctctatcccaagccttgtcttctgaaaatcagaatcatccctcctccaagtgttacaggaaaggggtccggatccagacgccaagacggggttcttggatctcgctccataaagaattcagggctagtctgtaaactgaaaacaagtttattaggaaagtaaaggaataaaagaatggctattccgcagagcagctcttagagctactgcttgcccatttttatggttatttcttagtgatatgctaagcaaggcttggattattcatgcctcccctttttagaccatgcagagttcctgacattgccgtggtatttgtaattgtcatggtgctggtgggagggtaacactgaggacaaccagaggccactctcatcaccatctgggttttggtgggttctggccggcttctttactaccacctgttttatcagctaggtctttatgacctgtatcttgtgcagaccttcagtctcatcctgtgactcagaatgccttaatcatctgggaatgcagcccagtaggtttcagccttctattgcccagcccctattcaagatggagtcgctctggttccagtgcctctgacacaagtagcgccccttagggaggttacaggagggactggaaggaaagtgaggtctggatcagggcccttctgtgtaaataagatgatgtacatgcagcagctgggtatgtcctgggtaaaaattagttaaatgcacagacgaccctgtttcatccccagccatcaccagctggaaatggggcacattcccaagatcccaaaaacattctgcaaggctggtgcgatgattgctatgaagtacttaagaaaacagattattgttcaggatcaatagctaatgcatgtggggcttaatgcctctgtgacgggttgatgggtgcagcaaaccaccatggcacatgtttacctatgtaacaaacctgcacgtcctgcacacgtatcccggaacttaaaataaaataaagaagacagaatattgttaatggttaatatgctgtaaatcattatgatgattactaaattatcaatacaaaagaagataatagcaagacggccatattcctaatagaggttgacattttagcagccctacatttccactgtatttaattagtatttgccgtccaatccagaggggcatgaaggagcacgagacaaaatcaggtcttctaacagctgagaagaagctgagaaccagaagtggaaaccccaaagggcagtgtatgaaatgtcatttattgaggggaaaaaaaagaaaatgacagagttcgatagaagaaataagcactagtgtttacataatcagtagggtgactttagtttacaataatctattgtagacttcaaaatagaagagtcggaatggttctaatatgaaggaaagacaaatatttaaggtggatggatatcccaagtaggctgatttgatctttacaaattatataaatgtattaaattattacatgtaccctgaagctatgtacatctgttatgcatcaattaaaaataaattaaaagaaaaggatatatgtccaggatatacaccagctaagacagtctcttccaagtctattgtacattattcccttatcagatttgaaacctgagagttccctgacgccccctcacaggatgtgcaacaggggtgtgtttgatctgtttgaccgccacacactgaaacctcttatgggaggcagaacttgcagacgggcaggtgcagcagctagtgtgagtgtttttgagctctgggccccacggtagcatctagggatgggtgcctgcgacccccgaagccctagtgggcgttttacggtgctcttttagctctgccatccgcacgtggcttaagtgttagccagctcagtgccgtcttggtacccgggttcttgtccagcatccaggaagaatcaggtcacacgaaccagctgaaggatggtaaatgcagaagagtttgttgccagatggagatgactcttagcgggatggttggggagttggaaaggggatggagtgggcagatgatcttcccctggagtttggttgtcctgcggctaatctcttctccaaccatccccagctgaacacctctcagtgttcagatgttccttctcttctctccttctctgctgtgctgctctttggttcctcaccttttctgctcatctgtctgtctgcacatggggtctggggtttggggttatatgggtacaggacaggcaggcatggtgggtcaaaaggcaacatttgggcacaaaaataggaatgcctgtttccatttaggactacaggtttccaggcttgagggcggggcctttgctggggaactgccctcttgtatctagtatcttcaggcctcctgtccgtatcaacatgacttaaaatgtgtgtgcatttgtatagagctgtgtttctatgtaaagactaaaaaagacttatgaaaaagatcactcagagctctgaacagtagcaaatcatatttctgagtacttcctgttgagtaaaggtaagtgaggattgtgccaagtatttttcattacttgctgcattaggttgtcacaggctgtttagtttacttctaaaaattgggatatggggaagttgtgggccgggcacagtggctcatgtttgtaatcccagcagtttgggaggccgagttgggcagatcacttgaggtcaggagtttgagaccagcctggccaacatggcagaacgctgtttctactaaaaatacaaaaattagccaggcatggtggggggtgtctgtaatcccagctattcaggaggctgagacaggagaatcgcttgaacccaggaggcggaggttgcaatcagctgagatcataccactgcactccagcctgggtgacagagtaagactccatctcaaaaaaaaaaaaaaaaaaaaaaaaaggaaaaaaaagttatgatgatcgcctaaggtgagaagccataccacgccagcgtacagaaccccaaaccacgccagcctcatcctacgtctcagttatatttttcttgacttgcttccattctggtgccccctctctccctgccccctccttccctgcaaaggatctagcaaatttgtaggtgtggaaagggaaccacaaatgggtcatttccctgccattgtcacctggagcgtgtagccatttcgtgcagtgattctctgtctttgatgtgcaggtcatcaccttgaagggaggaggtattaaaagcgccacccagtccccacccactgaggtctttattcagcaggtgtgggtcaggcatttgggagctgggagacctgcattttaagaagcaccccaggtgatgcccaagcggagctatgtgcttcttttaagagatgatgactccgtgtgcaaccgtgtggttacctttgcgtggagtctcatggatcactgccacagtggggaggcagctctgtgctctccaattcggtgatgtgtcattcactctatgcaggcccaaggtgacacccccagatacaggtgctgccatccagccattctcaaccagggatcatgtttatccacagggacacttgtcgatatcttgaggctttgcgttgccacactgatagcagggatgctgctggcatctagtgggtggagcccagggatgctggtcaacaccctgcagtgcacaggacgccccacagaaaagaatgatccaacctcatatgtcagtaggactgaggctgaggaatcttgccttagcatgagagatcctgtctgtctgtctgcctatctctagatctatctatcgtctaccattatccatccacctatctgtctctattatatacacctatcatctacctaatctatctgtcaatgattttctgtcatctattatctatctatttatctatctttctacctacttctctatccaactctcatctctattacctatctatgtatctatgtatctatctatgtatctatctatccatccgtctatcaatctatctatttatctagcagtccatcatctatctgtgacattcttctgctacccagggataattgtgttcctcgagtaacacttggcaatgtctggaaacaattttggtagttgcactgggatgggtgttctcgcattcggtgggtggagacaaggcatgttgttcaacaccttacagtgcacaggacagcacccatgacagagagttacgcagccccaagtgtcattagtgctgtagtggagaacctgctgttagttataacttctaaccctgcgaaaggggacaggttggaaatgtcatgctcctgtacgctgtaggaggtatagttgtctggaggtatagttgtctggaggtatagttgtcctgtacagtataggaggtacggtatagttgtctgggcatttctaaatggatcttactgtcagaatgcacttgtaggatcttttccccatagggcatagagccatggcacatataacccagaagctgagcattccatagtttccttcttggagtaggaaggggctgtgcagaaaaagtctatggctgtttggcacctgagtgtgaagacatctggcaaatattggagccaattagcagacaagcacggagtccaagaaatgtctcccctttcttggataacaactgacccttcctgtgagggcccccctcattccagccattttcctctttctcattggcacacagggggtagaaaagtggggttctgcctgcaggtggggctctgccagacacggcaaagctcctggggattcccccgatggatcaggggccagaggcacctaaacctgtgagcgatgtgtgcagccacggtgctgaggctgggaaactctgctgtagtctgtgaatcccaacctctgggaatgcttcagaatcagattctgggctgatctggaatctgcatgtggctggattctggtctgatccaggcatggaggcgtgtgcctgtaatcccagctactcgggaggctgaggtgagagaactgcttgaacctgggaggcagaggttgcagtgagctgagattgtgccattgcactgcagtgagctgagattgcaccactgcactccagcctgggcaacagagcgagactctgtctcagaaaaaaaaaattaaggaagagtattattgagagcgtaggccaggcgcgtgatgttgctgagatgaaactgtctctctagattcccaaaccctggttatctccactgaaccaggctgtccaatggcatccccattgtaattgaccatgttccatggtttaaatctgttgtgagccaaattgtaccctcctcaattttacaaatggaagtcctaacctgcaggacctccaattgtgactgtgtttggagatggggtctttaaagaggtgattcaggctgggtgcggtggctcatgcctgtaatcccagcactttgggaggctgaggctggcagatcatgaggtcaggagatggagatcatcctggctaacacggtgaaaccccatctctactaaaaatacaaaaaaaaaaaaaaaattagctgggcgtgcctgtagtcccagctacttgggaggctgaggcaggagaatcgcttgaacctgggaggtggaggttgcagtgagccgagatcgcactactgcactccagcctgggcgacagagcgaggctctgtctcaaaaaaaaaaaaaaaaaaaaaagaggtgattcaggcaaaatgaggtcactaggttgggccctgatccaacaggactgcagaccttataaaaagacgagatgaagacacagacatgcacacagggacgatcctgtgaggacttagggaaaagatggcatccacaagccaaggagagaggtctcagtaggaaccagccctgcccacaccttgatctcagacttccagcttccaggcctgtgggagaatcaatgtccactgtttaaacagcctggtctgtgggactttgctatggcagcagccacagtggacaaacacatttgtattccaatgaatgagttacctctgtaagggttgaattgtgcgtctccaaaatttatatattgaaggcctaatccctaggacctcagaacatgactgtgtttggtgatggggtctttaaagaggtgagaagggtacaatgagctcaggaggttgtgccctgatccaataggactggggtccttataaaaagagtagataaggacacagacacacacagagggatgaccctgtaaagacacagggagaagagggtgtctacaagtcaagaagagaggcctcaggaggaaccagctctgcccatgccttgatctcagaattccagcctccaggactgtgggagaataaaagtctgtggtttgtaagccacccagcctatggtattctgtgatagcagcctgcaatggactaagacatctcataagaagagcagatgaggacacagacatgcacatagagggatgaccacgtggggacacagggagaagatggtgtctacaagcccaggacagaggcctcaggaggaaacagccttgcccatatcctgatctcaagacgtccagcctccagggctgtgggagaatcaatgtctgttgcttataagccacccagtctatggtatgctgtgacagcagcctgaaatggactaagacacctcataagaagaggagatgaggacacagacgcacacagagggatgaccacgtggggactcagggagaagacggcatctacaagcccaggagagaggactcaggaggaaccggccctgcccacaccttgatctcagacttccagcttccaggactgtgggagaatcaaggttgttgtttaagctgcccagtctttgggattgcattgtaacaactctgggaagccattaccaagtctctgtcctgcaaagtgagatccatggatctgcagccttgacatcccctgggagctgatgagaaacactgtgtcttgggcccagacagacctgctgaagcatagtctgtgtgtcacccatgtcctgagggatccgtgtgcatgccactctgggaagacgggtttataacacaccgtcaaccagtgcctcattgcatggtctgcggtattttcctcgagttttccttgcaccaaagatgtcttgctttttgtgatgaatgatcattccttcctcttcgacgacaaaatacttcgatctctgcagacaccgtctgttgtgttacagacagacactgaggcctgaattctcattaccaatgtctgctctaatagagcttcaatctgcaactgcataatatggtcactgggaagtcaagaacggggccagttggttgaccttctggggagaggctgggctgcttggatgctgagaccgtggagggttcatgggttccgaggagcagatcatgcaccagggcggcctgctcagctctggtgtctgcagccccggtgagcttgagcattagggagtccctggatattcatgttgaggtgtggaggaggagactccagctgtgtttgatttcctgtcctgctggaaatataaacttcttaaccaattagagaacagaatggatttcatcttatccatggggctaaagtagaattcagcccttggcaaacaagccccccgggaataagattccccattggggcagcagccttccttgtcactttctgttgcaacctacggtcctaacctagtcatatgatttaattttttttactctgtgaatcatgccgtcctgggagagagtgagatggagcaaggacaaccctcttaggggcctgccaggcactctccctagcatggaaataaaggaaaaccttgagttccttcaagggaaattccaggcacctcgctggccttgagaagtacatggagcagcttgataagcaagaaggtgattgtagtgtagaacaatagccaaggaagttagagcctcaatatgtttagtttcctgtaaagactaaagataacatccttttttgagatggagtcttgctctgtcacccaggttgcagtgtagtggtgcaatcttggctcagtgcaacctccagcacctcctgggttcaagtgattctcatgcatcagcctcccaagtagctgggactacaggtgcacaccaccacgcccacatttttgtatttttagtagacacagggcttccccatgttggccagtctggtctggaactcctgacctcaggtaatctgcctgccctggcctcccaaagtgctgggattgcgggtgtgagccaccatgcccagccaagataacatcttactatatggccctgagttgattttcaggaacccagacccccaccaaataaaaaatgccatctgctggctcatagacgttgggtaagagaaactgaggcctgaattctcattacaaatgtttgttctaaattccttccctggggcatgtggcggtgggaggggggtggaaggggggtgaggggacgtgctggaggaagtcacaccaatggccacaactaacattgatttctgctgaccccaaatgctcagacaaacttggcctccttaaccaatgacaaatcagagaaactttgaatccacattaagcccctgcttccaggtatcccgcctttttagatcaaagcaatgtatagcctgcatgtattatggctttgcctgtaacctctgcctccttgccattgaaaaccctcagctactggccacccaggaggttgggtcttgaggcatcaaggaggttgcttgatgccctctaaatagctcggaataaacgcctcacttcctcacgctgcaatcccaatggcggtgttcggctttactgcacagggccggtggacctaagttgagttagtgggaggtgttcgaaccagggcaactccaggttgagtaggggctgtgtaaaatgaggccgagagctgccgggctgcattcccggatggtcaaggcattctaaggcacaggatgagataggaggttgacacaagaaacaagtcataaagaccttgctgatgaaacagcttgccgtaaagaagtcggccaaattttaccaaatccaagatggcgatgagagtgacctcgggtggtcctcacttgtgtcttcccaccagcaccatgacagtttacaaatgccacggcaatgtcaggaagttaccctatatggtctaaaaagaggaggcatgaatgggccactccttgtttagcatatcctcaagaaagaaccatacaaatgggcaaccagtggccctcggggctgctccgtctatggaggagccattctttattcctctgcttttctaataaacttgctttcattttatggactcgccgcaaattctttcttgtgcaaggtccaagaaccctgtcctggggtctgattccagacctctttccggtcacaagttcagtcacaagaaccattatcatatgctttctatatatacacataggtattttttaattgctgaactggagtcaaagagaaaccttaggatttgcctgaaggaagtcaagatttgtccttctcggggtccctgtgccagctttgtaaaacctcggaactttcccctctgtgggcttcctcaagctgaggagggctctatgggcttagtacccactaagtggcttcatctgcagcagctgacccaagaaagttgatttaaatgaacccacacttcagaggaaaccagtacaatccgatgtaaagaaataaaaaataggccgggggcggtggctcatgcctgtaattacagcactttgggaggccgaggcgggtgaatcacttcatgccaggagttcaagaccatcctggccaacatggtgaaaccccgtcattactaaaaacacaaaaattacctgggcgtagtggcatgcacctgtagtcccagctactcaggagactgaggcactagaagcgctcgaaccagggaggcaggggttgtagtgagccgagagtgcgccattgcactgcagcctgggcaacatagtgagattctttatccaaaaaaaaaaaaaaaaaaaaaaaaggctaggcacggcggctcatgcctgtaatctccgcactttgggaggccaaggtgggtggatcacgaggtcaggagtttgagaccagcctggccaacatggtgaaaccccatctctactaaaaataaaaaaaattagttgggcatagtagggggcgcctgtaatcccagctactcaggaggctgaggcaggcgggagaatcaattgaacctggggggcagaggttgcagtgaacagagattgcgccattgcactgcagcctgggcaacatagtgaggttctgtatgagagaaagagagaaagagggagggagggaaggaaggaaggaaggaaggaaggaaggaaggaaggaaacaattgcttgaaagggctttgtttcaccagggcacgcagatcaaaggacattggattgaataatgaaacagaagagcctgtctgaatttactaatgtggttgcacgtcccgtaatgattgcagttggctctaattcagttccgtggtgtataaattctgctggcaatagctgtaattggggtcagggatttagatagtctctgtgtgttccttttcattttctgctcagagcctgctgggagctgattttcttctttaaagcgaggtaaataattcagtggggagcagaggttttgctgtgggtccattgctctcctgtgctgcgtggcagctgtgctggtggcagctaatattcagtgggcagtggcctcgacattgcattattattcgagcaatggtactgttctttgctttgcaaaattgctgtttgttatattgactttctggggtcgtggcccctgaagcattactgaaaatcatggacatgaagcagatttattaactggagaaaagacatacaaatgtatttaatgtgtatacacgggagcattcagaatgaagaccccaagttacaaggggagattgtctatatttatgctttggttcatccaagtctggacagctgtgtagaaatagggttggacaaaaagggcctgatccaatgctaatggcctgagtggggaaacccagccaggcctgtgtgtctagattcttcttggcctctctctctctctttttttttgagacggagtctcactctgttgccaggctggagtgcagtggcacagtcttggctcactgcaatctccacctcccaggttcaagcaattctcctgcctcagcctcctgagtagctgggattacaggcacgcaccaccacgctcagctaagttttgtatttttagtagagacggggtttcaccatgttggccaggatggtctcgatctcttgaccttgtgatctgccctcctcggcctcccaaagtgctgggattacaggcgtgagccaccgcacccggcctcttcttggcctctctgaacagtgctccttccttccgggtatggggctgggagcttctctgggatggggggtcttaggacgcccaaacaaggcaggtcagggaatttccttatggccacttttttttttttttttttttttttcaagacagattcttgctctgtcacccaggctggagtgtactggtgtgaactcggctcactgcaagctccgcctcccgggttcacgccattctcctgcctcagcctcccgagtagctgggactacaggcgcccgccaccacacccggctaatttttttgtatttttactagagacggggtttcaccgtgttagccaggatggtctcgatctcctgacctcgtgatccgcctgcctcggcctcccaaagtgctgggattacaggtgtgagccaccgcgcccagcctgtgccactctttatacagataggatagagggaaagttagattcctgtttttaggttttatggctggcttcggggggaaaggcgttcttgtttctgggacccgtcttggggaagagggattctagttccttcggtgccttaggggagaatgggactcagagacatgggggctggagaagttccgagagaaacttctgcttctgaggctgctgctgaggcctgcacttggcggtattgtttcgtaagcctgaaccacgtgcaggtctgaatcaacataaagaatttgggtgggaggcaggggaactccaataagaagcatctttgaatccggcaggggtggaatttgggtcccagaggggtttggtgactgcaggctacagaagaatgcttcaaagtgctgtatcacatggctttgctccgaagggtcccgagcacagctttaccgggggctcatgtgtaacgctcggcccacccatccaccaacaggagccacttaatcgacatctccaggatgccagcaaccgaggaccgttgtcatagtcccagcacaaaatgaggctgctttcttcttgggggtttagggatcccagaccacaaggatttgattaaaagccgctcagttcactaactataagcaaagcaaatcagaaatagatctcctgttcctgccccgtcttatgttcccagtggaaaataaaccccgtgaaagcaatggcgtcatgtgcaacccgaccttggagacagagaccccagagttagcgttgtctacctgggacatctcccagcccaggggtcttactccagacccgtgaggaccccaggcgtggctttgctgcaacttccctggagaggagagaggacagggggccctgcctgggagatagatttgctgcctggcatgcgggactggagactgtctcagtgcccaggccgtctgatgctggccggagtccgcctggtttatgtaacgaggtctggatgtgaccaacaacggcctcgtgtgtgtgagtcacgcgtgcagcaacttctggctgtagtgcaacccctgaaaccaagcaaagcctaaagcccccaggctccacttcctctgtgaccctccccacccccaattcctgtcatctctcagggtcatccggagcatctcaaagctgaaggagcctccgctgcaacctggcctcctgctgcaggatgagacgagctgtctgcagccctcccgtgccacctgcctgttttatgcaacagcatttcagagaggagggactgggaggggagagacaacaccgaggcctttggttatttagggcaacagcagggagtggccgggtgcacagattggaggagattaagtggttgctgaggggatgcctgggattgctgggatgggcggagacataacacagtgaaagatattggtcaacggcgaacacagattggaatgtaaattctcagggtgtgtgcatagccgggacgcttaactttggcgtcctggacaggtgtctcgactggaactgctggcagccttggaggggagatgttgcacagatccaagaggctgacacggttcctgtcccccagcccagtctgagcagcttggaccatgatgatcaagagcgctggaggaggccaggtgcggtggctcacgcctgtaatcccagcactttgggaggccaaggcaggtgggtcacttgaggtcaggagttcgagaccagcctggccaacatggtgaaaccctgtctctactgaaaatacaaaagttagctgggcgtgatggcatgcacctgtaatcccagttactcagacggctgaggcacaagaatcgtttgaacccaggaggtgggagttgcagtgggctgagattgtgccactgcactccagcctaggcgacagagagagacgccatctaaaaacaaaacaaacaaaaagaaaacaacaataaagaaaaaataagaagagagctggatggagcaaagatttgctgggttgttcttaaaggcgagcctgtagtgatcgctggtaacagagaacgtcatctgagagggacgtgggggctcccagagtttgagagaaacggccgtgtgggatttgacctgtgatggcaccgccagctcccagcctccagtctgggcccaggggcagctgctgtgtgcaccctgggctcagagttccccttccctccaaggtttgtgactttgtcctgacttagggattcctgtctggggatgcgtcttctgctccggagaggccctaattgcctccacaaggagcggcaaagcctgcccgggtggcatctgactggagccatgccacagcctatacgaatctatgttggagcccttgaaccttcccccagagcaagcgtcaccgaggcagaccgatttttgggagggagacagacatcagagcgggggagacccagtacctagggctcacctggttcccccaggcttagcctcctccagggcttagtgtttgagtgagagattgtcccccctggacaattctgtagattctgactctgctcctgccttgccctgaacttcccagaacctcagtttcttcctttgggaaatatgcatgctggtcataccaacatccttgggtgggcagatgagactcttgggtgcctggcattactgcaacagaactcaatgcatagtaagtgctgactcaatgtgctcctggctgcatcctctacttcctgataaattctctggtggtgttttctctacaaggctagtactggcaggggcaagtgaggaacaagatcaaggtgtgcatatatgtcagcaagagggacccttcaccctcacaaattctgcagtgtgtttttaatgatgtgtcccaaagatgtgaatgttctcttctctctgctgcagacacattcattagattaactgcttttggatcaggtaggaacctcagcttgtccacacaggttgcttcctgaccctgtatttgtcagtgtaggctagctgctataacaaacagcccccaaagaattaaaagtttatctcttgtttgtgttgcagccaggtgaggtggcaaaggtgtcctatgctccatatagtctctcaggcatccaggaccctcacattgttgtgcttcaccttcttctagggcagcccctctcaacctagactctgtgcgtgtgtggaggggtggggggggcgttggggggcggggatatgcctgtcctaagctgtgagtgggacagtccaggagagaagtctatgtgcttggagagaggcttccttcaaagtttcctggccatgagcaggaatgaagctctgacacaggttgcaacgtgaacgcaactcaagagcatcatgctcaatgaaagaagccaggcacaaaataccacatattgtagaattctatttataagaaatttgcagaacagacaattcatggagacagaaagtggatagtggttgtcaggggctggggaggcgggaggggaactaactgctgaatggggacaggggtcttcttttgggtgatgagtatgctctgggactaggtggaggtggtggttgcatctcccatgtagctcatggtcaggttagttttagtgctctgggcgaccctaggcttgcaggaggaggggagcagcatgaggtgaggaacaagggggattctggcctttccatcatggggtgacttatgccctgtttgctcccaataggtcaaagagactttgatttggcagatgcccttgatgaccctggtaagtgccgatatttcaaggggagccttcccttttcagcttggatctaacagcatcagctgtatagttactttggggttggattgggccagtgttgggaatttcttggtcttgagatctctgttctttgcaggagattgcagacaccttgagacaaacctttacacactctctaaaagtctcagactcatttcttggtaggtctgtgcttctaaacctgtggtttaggaatatgctagtattttattattttattttactttattttgttgagatgggagtctcgttctgatgcccagactggagtgcagtggtgcaatcatagcttaccacatagcctcgacttcctggctcaagtgatcctcccacctcagcctcccaagtagctggaacaacaggtgtgtgcccccatgccaagctaatttttttcttttttcttttttgtagaaacggattctcactatgttgcccaggctggtcttgaacccctgggctcaagaaatccttctaccttggtttctcaaaacactgggattacagacgtgcctcaacatgcctggcccagtttctgcttttcttacacttcagttcatatccctcattgtcccacaccccgatcccaatccatggcctccaatctccccagtttctgcttttcttacacttcagttcatatccctcattgtcccataccccgatcccaatccatggcctccaatctcccctcccagagcacacttcattccgttctcccctcaacttctctggttaccttcactgacggggctgtgagtttttcttctccagggcactgaggacctggaatcttcccattctgtgttttcatcagtccaagttcagctagaacctttctggctgaccagaatgctgaaaatatgtgtcctgggccctgcagaaagtcctgcttgaggcagatagtctgattgagattcaggtgtattcagaccgcggtgggtgggagaaagggaaagatttggtttctgatgcaggcacaatggaaccaaacatttattttgaaagaaaaataaacttttgtgtacacagaggaagaatccattgggctttagcattgggaacaactggttgaccagtgcagttacataatggtgtttgttggaggaagagagaatgataaccagatctgatcctaaaaagccaacaacaagatgataggaactcatctctctcccagttttctgcacacagtgatgtttttgctaataattatcctaaaaggcagatacaaaattgttgtcagtgcaacaggaaaatgtaatgactcaccccaacatggagatgccatttctcccatgaagttagaaaaggtgaaggttgaatcctaccctgtcaaggcagattgaggggtgggggttagaggcaggtgtgtggttgcaaccactttggaagcattgggggattatctccaaaattcagactgagtgtgttgcaccagcgtttggtctggataaagaatgaggcatatctgcaagagaaccctgtgcaatagtgaaggaggggctggctggtaggctcagatacagaacaagacatgttattgatctgaaagatcactgacatgtgacccaggagttccacttctagacagatacccaagagaattgggagcagggactcaaacagttatttgtgtacccatgtttgcagcagcaatattcacaataagccaaaggtggaaacaacccaactgtccatcaggggatgaatgaatgaacagaatgtggtccctccaggcaacagaatatgatttggctgtaaaaaggaagggggttctgatgcgtgctacatgagccttgaaactgtgctcagtgaaacaagccaggcacaaaaggccacagggtgtaggatcccattaatatgaaatgtccagaataggcaaattcagagagacagaaagtggattagcgattgttgggctggaagaggggacaaaagggagggactgctcgtggctatggggtctccttttggggggatgaaactgttctggaactagatacaggtggtgattgtacaatattgtgaatatatgaaacaccattgaattgcacactttaaaatgtcaaattttatatgtgagtttcacattaattttttaaaaatcacataaataaacttattttccactcacctgctactaccttttcattgctcacctagaaggctgccagtgcctgcaaacacatctttgaatgcatcgttttgctaccaagagccccccatgaatgggcaggcatgtgcctgttcatccacagcccttcctcatgggaaggaagccccagtgcagaggaaccacagtcacctgcatggcgactgtggggaattcacttttcactgtctatactgcctgggctttaagaaactctgtgagtgtatcactattttaaaaaatagttataattttacattttaaaaaggagacagagaaaggaaggatgggagagagggagggagggtgggaggaggaaggaagggaaaaggaagagaagaaagaaaagaaggaaacaatgaaaggacagaggaaaacagggagggagggaggaaaaaggatggaaacaaggagggaagaaaaggaagaagagagggaacgatggagggaaggaaggaagaagaaaggagaggagataagaaaagactgaggggaggaaggaagaaggagaggaatgaaggaggaagggaagaaaggaggggggaaggaaagaaagaaaaataggagaagaaaggaagaaagaaaaagaataagggaaggacggagggaaggaaggagagagggagaggagaaaggttggaggggaggaaggaagaaaggagggtggggaggaaggaaagaagaagggggaaaaggagagagggaaggaaggaaggaaggagagaaggaaggaaggagagaaggaaggaaggagagaaggaaggaaggagagaaggaaggaaggagagaaggaaggaaggagagaaggaaggaaggagagaaggaaggaaggagagaaggaaggaaggagagaaggaaggaaggagcgaaggaaggaaggagagaaggaaggaaggagagaaggaaggaaggagagaaggaaggaaggagagaaggaaggaaggagagaaggaaggaaggagagaaggaaggaaggagcgaaggaaggaaggagcgaaggaaggaaggagagaaggaaggaaggagagaaggaaggaaggagagaaggaaggaaggagagaaggaaggaaggaagaagggagggcaggaagggagagggaggtggcaggaaggagaaaaggtgatgagaaaccttctattaaaatacaggacatgcgaaaccatatgccccgtttggaggttcaagctctccttcttgcagtctctgcatccccagtgaatgtccgcaccacacacaaacccgtgttccagccgcctcctaccaaggcaatgctaggctgttatgtaaaccatgctttcaaatacggtgtttcctctgtttggaagaagtctggccattgcacagccctgaagctccaattttcccagccatggccgactccacctcctttgagccatcttcctcaaacctcctcctgccctcgtctgcccatccacactgcacacccaggttcactaagcagggcagtcacaggctgcaccctgagcactcctgacctgatatccacatccatgcaatacatatttgctgaatgaataaatgaatgaatgaaagaaagtgagataagccatcattctggaagctgcaagtctttctccttcttttcttttgcctccccctgcctcaccctccaccgtccagccctgtggtggctctacgggcaggtggctcacttacttgtcttggatgttctcagctactttggccatcctgtgggcatcctcacagcctcaagggtggattgtttttgaatggattttaagggtgttttcttgtcttttttctcaattcaacatggaatttgtgtctatatcatttactttgtatggctttgtcactcccttttcacctttcatcagggcgttcatggcctttcttcatgcttccaatgaatcttcaatgcatattgcatttattttctctctttgttcacagaacccaccaagaagccaaactcaggtgagtgtctcttcagctgggaaaaactgaggcaacgtccttgaactgatgcttacggaggggatggttgaggatgttttacagaactgtggggtatatgaaagagatgcaacaactgtaccagatagcagatattgaaagcaaaatgtggtgattagggaaatgcaaatcacaaccacagtgaagcaccacttcgtccccactgagatggctaaaatctaaaatggaaaataacaagtgttggcaaggatgtgatgaaactggaatgtttgtacagtgctggtgggagtctaaaatggtacagccactgtgaacaaatgctttggtggatcctccaaaagttaaatacaggattactctatgaaccagcaattccactcctaggtatgtactcaaaataattgaaaacacgggttccaagaaaaatgtgtacacaaatgttcagagcagcactattcattatagctaaaagatagaaataactcacatgttaatcagtggaaggaatggataaacaaaatgtggtccattcacacaatggaatattatttagccttgaagaggaatgaagcactgaaaattgctacaaagtggttgagcctcaaaaacattttgcaaagagaaagaagccagacacaaatgatcacataatgtatatttttatgaagatgaaatttcaagaataggtgaatccctagaaccagaagcaatgtcgtgactgccaggggctggaggggaaagagagagtgactgcttgataaattccaggtttctttttgggggaacgaaagcattctggaagtacacagaggtgatggctgcacaacactgtgaatattctaagtgcccctgaattattcacttttaaatggttaattatatgtaaatttgacttcaatttatttatttattttcaattaaaaaggtaacctttggctgggggcggtggctcacacctgtaatcccagcgctttgaaaggccgaggtgggcagatcatctgaggtcaggggttcgagaccaacctggccaacatggtgaaacctggtctctactaaatataaaaaaattagctgggcatgatggcacatgtctgtaatcccagctactcgggaggctgaggcaagagaatcacttgaacccgggaggtggaggttgcagtgagccgagatcatgccactgcactccaacctgggtgacagagtgagattccgtctcaaaaaaaaaaaaaaaaagaaaagaaaagaaaagaaaaagaaataattcccggggccgggcgcagtggctcacgcctgtaatcccagcactttgggaggccaaggcgggtggatcacaaggtcaggagatcgagaccatcctggctaacacggtatgttgtacctgagcgagttagaaaaacgctttgagacaaattaagagtcctttataagccagcgaccgagagacggctaatgcttaatagtctctcggtcctgaggaaggggcttgattaacttttagatcttggtttaggaaggggagggctgggggtctagtgaaaaccattttacagaagtaaagtaggcaaaaagttaaaaggataaatggttgcaggaaagtaaacagttccaggtgcaggggctttaagactattacaaggtgatagacgcggggctttgggcgttactaatcagacgaattcccgggaactgcggatgtagctcgccacagtatcttatcagttaactgcattcttggatgtgctgggagtcagcctgcacgagttcagtccttgaggaaggggctgccagtgaaagagccaaggtggagtctggctggctctcttagctaagggagagtccattcaggtggaaagaaggctaggtgagtaaaggaaaagggagagtctaaaaacaggttagtaaaaaccaggttgggcattacaggtgaaaccccgtctctactaaaaaatacaaaaaaaatttgccaggcatggtggcgggcgcctgtagtctcagctacttgggaggctgaggcaggagaatggcgtgaacccgggaggcggagcttgcagtgagccgagatctcccactgcactccagcctgggcgacagagcgagactccgtctcaacaacaacaacaacaaaaagaaataactcccagacttccagcagactccttgactgccatgagagatgtcaggaagtcaatggacgggtgtttataggttgttcaggaaatgttcactatcaagcaagaattgaaaatgcagctaaattgctgttggagagtgatgatagcataaagatttccaacaagaagctctgcaaattttgctgaaaaatcttccaaatgatgctctgccataagaagaaattcacaccctgaatagcacagcaggatgcgaatagcaatgccagccaaagacattgcaaacaagccggtaaaactaagtgattgttagctgtttaaaaaaataataataactggtgttaacaacaaagtgaaacttaacttctgaagatgaggctaccttcacagagaggataagaaaggaagaactgagtaaaagtagttagatattgctggattttgacattttaaggttaagtgttcctgctaaaaataaaaattgaacatataactcctgaactagtggatgaaaatgaagaatgaagaataaaattaaatacaaaaaaaatgaagagtaaaattaaataccaaaattagccaagtgttgtggtgaatgcctgtagtcccagctactcaggaggctgaggtgggaggatcacttgagccccagaggtggaggttgcagtgagctgagattgcgccactgcacttccgcctgggtggcagagccaggctttgtctcaaaaataaaaaaaaataataaattaaaaacctgaatactaaatggaagttaagaaggaaggaattaaaaaagaagaaaagtaaaataaaatagtaggaatagtgaatccttagttatgttagatgttcagtgatttaataaatctgtaaaaagacggagatgagatgatgcaatttaaaatgtttcggctgggcgcagtggctcacgcctgtaatcccagcactgtaggaagccgaggcgggtggatcacgaggtcaggagatcgagaccatcctggctaacacggtgaaaccccatctctactaaaaatacaaataaaatgtttcatgctatttacgagagaagcatttgcaacaaaatgccaaagagaaggtgaaaatagctggaaaaaaaatgcgcaaagcaaataaccaatagaaagaaagccaagttgggctagcaaaatcagacaaaataaccttcgaggtgcaaacaactttgaggcccaaatagaggttcttcccactaaaagaatgattccctgaatgataatggaatcttgacccagcctgcacctcaggttaagttaaaagtggaaatttaaagatctaagtgtgagattttaaaaagcatttccccagaaataccaggatctgtagatggaaatgttattaagaataaagatgtggagctgggcgtggtggctcacgcctgtaatcccagaactttgggaggctgagactggctgatttcttgagcccaggagtttgagactagcctggacaacatagtgagaccccatctttacaaaaaaattaaaaaaaattagtggacatggtggcatgcacctctagtcccagttactcaggaggctgaggtgggaggatcacctgtgcccaggctgaggctgcagtgagccatgatcacgccactgcactccagcctgcgtgacagagcaagaccctgtctcaaaagaaaagaaaaaaaaagaagaaagaaatgaaaaccgtagctcagagacagagaaactgagcaatgcataggttcagaagggtttgaaacagactgaattgtgtcttggcatatgagagaggtcgcagctataaaacaatgagagaagaaaccaaattccacataggcaggactgagacaattggctgttcttgtggatgatacgtgatcaaatctcaacctcatgcgatacttttttttttttttttgagatggagtctcgctctgtcacccaggctgcagtgcagtggtgtgatctcacctccccgcaaacttctcctcccgggttcaagtaattctcgtgcctcagctgggactacaggcatgtgccaccacgcctggctaatttttgcatttttttagtagagacggggtttcaccaagttggccaggctggtctcgaactcctgacctcaggtgatctgtccacctcggtgtcccaaagtgctgggattacaggtgtgaaccaccacacccagcctcatgtaatacttaaaaatgaactacaggtggattacaaacctgaatataaaagaaaacttttttttttgaaaaatagagggaaatgtcttataacctcagagttaggaggtttttcttagatacaatacaaaaagcataaccacgcccatagtcccagctactcaggaggctgaggcataagaatcacttgagctcgagaggtggaggttgcagtgagccgagatcctgccattgcactccagctgaggctacagagtgagagtataaaaaaaaaaaaaaaaaagcataacctttaaaaatgggttagcctatgtctacatttaaataataataataataataatgttccaacttcaggctctgaaaaaagtcaaaagatgagctgtcaactagaagaggctccttactgctcataccaccagggaaagtttaatatgcaaaatgcagtcatccttcagaattcatgggggattagttttaagacgccttcttccccgcagacaccaaaatccacagctgctgaagtctctgatataaaacgtgcagtacttgcatataatgcaagtatatgttcctgtatatttttatttatttatttggagacagaatctcactctgttgcccaggctggagtgcagtggcgtgatcttggctcactgtaacctccacctcccgggttcaagagattctcctgactcaacctcccaagtagctgggattacaggtatgcgccaccacccccagctaatttttgtatttttggtagagacgggttttaaccatgttgtccaggctggtttcgaactcctgacctcacataatctgcccaccttggcctcccaaagtgctgggattacagggatgagccaccgtgtccagcctctggtatactttaaattatctctaggttactcataactcctgatacgctgtaaatgctatgcaaatagttgttatactatattattttttatttgtattactttttattggattgctatattttattttttgaaatattttcaatacaagactggttggatctatagatgcagaaattctggttatagagcacaaactgtgtatagatagctcctaccaaaacagacggatggtgaaaaaaagaaaagaaaagaaaagaaaaagaaaatggaggagagagactatgaggcgactaaaagaagagggatatgatcattccattcgctgacaagaaaaattcaaagaagagggaattatgcaattgaccagctgatgtgtgttagaaatgctcagggtcacacatattcattgaaagccaatttaagccactatttaaatttaaaccgatttaaacaattgggcttttttttttttttctaaaaaaaaaaaaaagtcaattaggccaggcgaggtggctcacacctgtcatcccggcactttgggaggccgaggtgggtggatcacaaggtcaggagtttgagaccagcctggccaacatggtgaaaccctgtttctactaaaaatacaaaagttagctgggcatggtggtgtgtgcctgaggctgtgagactgaggcaggagaatcacttgaacccaggaggcggaggttgcagggagcggagatcatgccactgcactccagcttgggcgacagaccaagactctgtctcaaaaaaaaaaaagaagaagtatattggttccgtctggaaaggtggagcacttgaagcaaaggcaggaagactggaagcagggagagggttttcaggtcacaaacaggtgagagacaaaacagttgccttcttttgagtttctgattagcctttccaaaggaggcgatcagatacgaatctgcctcagggagcagaggggggactttgaatagaatgggaggcaggttggccctaagcagttcccagctggacttttccctttagcttagtgacttgggggtcccgagatttatgttcccttcacagtgtatgagtgagagcacttggaaactgagagtggaagtgtcgcaggccaggtctcactaacacaggcccccacaacacctgtttcagtattgactgagtggttaaatattaaaagccagtgctgttatacaaaggctggaatgtaacaaaagcccaccgagagtttttcccaggactttcccgggccttaaagcatgacaaaataatgaatgaattcttaacaggacccatttaggattaaacaagttttactgggggtctgcagaaactccccaggcctccacaaacaagtttattggggctttgaaggaactctgcaaacctcctggatttagcaggagacaacatgagggtaatcaccccggcacctggacccattagattaagtcaatttactgaggctcctgaggaagatcctcaggactcagaccttagttatagattaaaagaagttaatcacttatgtctttagataaatgcacacacatatctccacatagcttggaaggtatataagctctggaaaactataattttgagttagtctggtgataatttccaggccttctccctgtaacaggttgcagaaataaaaactctcttcctccccagttcatcggtgtttcattattgggctgtgagaaatagcaacccagttgggtccgggaacagaaggtttggtgttatcttcatcacaggcactggactgtcggtaaatttattccatgacaattcttcctaggtttcttttttatattacttgcttccatcatggcagacagctacactggcttcttgccatgaaaacgaacttctagtaacaaaacggaaacctttttttttaagtttcaggtttcaaggttttacttctatctgcaaagtgatttttaaccagacaatggcaatctataaacacaccgtgggcagcaaatcagaacaaactgcaaggtcgatagtcacgctgatgagcttgtttctgcagcctgctcctaagggaaggacaattttcttttctaacagtgcaatgttgtttcctccacagatatctacccaaagccaaaaccaccttactacccacagcccgagaatcccgacagcggtggaagtaagaatccgcaggcctgaaactctttctcaatctggtttgatgatgtttgcctttttatttactagcaggtttagcctggttgcatttgaaatatgtgtgtaatagctcccttactgggaatgtagtttctttcctcactggggggagcaagaaagtccaacggacagaaacaatcttattttccctttgctttgacatctagaaaccactaaggtgtacttgtaaccacccaactggttcactttgttggctgcctagacagagctgatttatcaagataggggaactgcaatggagaaagagtaattcacgcagagccggctctaagggaggctagagttttattattaatcattcagtctctggaacatctggggatcagggttgttaaggataagttggcaggtaggggcttgggaagtggggagtgctgaccggtcaggttggaaagggaaccatagggggttgaagtgaggttttcttgctgttttctgttcctgggtggatggcggacctggttgagccagattaccgggctgagtggtgtcagctgatccatccagtgcagaggctgcaaaatatctcaagcaccgatcttaggttttacaatagtgatgttacccccaggagaaacttggggaggttcagactcttgcagccagaggctgcacgagccctaaagtgtaatttctaatcttgtagctaattttttggtcctgcaaaggcagactggttcccaggcaagaagggggtctttttgggaaaggggcattcttaattttgtttcagagtgaaaccacgaactgaattcgttcccaaggctagtttggctcacacccaggaaagaacaaggacagcttaaaggttagaagcaagatggagttggttaggtctgacctctttcactgtcatcatttcctcagtcataatttttgcaaaggccgtttgatactcaaaggacactttgcattatcatcacagaaagctaatcaggctgagagacaagtcctttctctcacttgttttcagtgctccaaatacctttggcttaaccattcccaaacccccacgtgtgctgtgcactttatgtgttttagagttggtttctccattttttctaacatttggcagacagtttttttccacagatttattacactcatcattgaaaaatatgcaattcaaaaaagaaagagagtgaacgagagagagaagagtggggaggggggtgggcatggagagagaaagagaaagagaaaagaaaggggaaagaagaaaggaaaagatagattctggccattaaagttatcagcagttcaacaaccttaaaaacttaaatgtttgccaggcagagcagcgtgaagctggctaaatcaagaggggttctggaagcttcctggtagtttgctctggctttaaactttcacagcttaacagcgtgtccattcattgcagacacgcacatccagatggacagaaattatctcctcttacaaggaatcattaaaaacagagaccaagacccaagggaggtgacacccacttgaaaaactacacctcaggccgggcgtgggggctcacgcctggaatcccagcactttgggaggccgaggcgggcagatcacctgaagtcaggagctcgagaccagcctggccaacatggcgaaaccctgtctctaccaaaaatacaaaaattagctgggcatggtggcatgcgcctataatcccagctacttgggaggctaagacacgagaattacttgaatccaggagaggaaggttacagtgagccaagattgtgccactgcactccagccggggaacagaatgagattctgtctcgaaaaaccaaaccaaaccaaaccaaaccaaacaaaacaaaaccccaaaacaccacctcacccttaactgcattagttaagccagctagtctttcttttttccccctctttcatgatgaaaatcccaaataccacccacctttttctcctgctatttcctcctagtcttttaaaaaccattgtcctgcggatcatggctatgttgcaaggcactcatgggaattccacagggaacgtgtttcttgctgaaacatacttgggaaacgcccagttaaacagactgccgtgggcttccctcccagagaattcatcaggacttaaaatgtgtggctgggcatggtgggtcacgtctgtaatcccagtactttggtagaccgaggctggtggatcacctgaggtcaggagttcaaggccagcctggccaacatggtgaaaccccatctctactaaaaatacaaaaattagtcgtggcctgtagtcccagcaactcgagaggctgaggcataagaatcgcttgaacctgggaggcagaggttgtagcaagctgagatggcgccactgcactccaggctgggcaacagagcgagactccgtctcaaaaaaaaaaaaaaaaagaataagaaaaaaaaaacttaaaatgcgagatcctttaagatgggccatcttcagagtgtgaacactcagcccctcccacagcaaagtgattcatgaaccccaataggaggaggagtgggggaagagaggctcaggctggggaggtgaccccccatgactcaagcctcaatctcctgatgcttgtcccaacaaagaggaggcttcctttccgactttggtttttcatgttgtgcttaaatccagccacactgatgcctttaacatggcagtcctgaattattaatcaatactgtgtgaatccaaaatatctgagacaggtctcaatcagtttacaaagtttattttgccaaggttaaggacgtgcccgtgacacagcctcaggaggtcctgatgacaagtgctcaaagttgtcaggacacagcttggttttacacattttagggagacaggagatatcaatcaatatgtataagaagtacattggtttgatctggaaatgcgggacaactggaagcaggggcttccaggtcacaggaagatacgagacaactagttgcattcttctaagtccttgatcggccttttactgaaaactcaatttacatgtgagacagggcaaaggaatagtacttatgcctcagtctggcccagtgaatctgcatttttcatcaacaatagggcagaggaagcaatcagacatgcatttgtctcaggggagcagaggggatgactttctgtcccacacctgtgaagatgagctgttggtgtacattgccagggtgaaattccacagaactgttttagggtaaacaaaacagtttactttcctcagattgtgaggacagtatgtagcttttaaaaaacttaaaaaaatttttttgtagctatcttatttagaaagaaaatgggaggcagatctgactaactttttttttccagcttgacttttcccttggcttaatgattttggggtcccaagatttattttcctttcacaattgaacatcagaacatggagtatttaacacaggaaatgagcaaatttaacgtacacacccaaggaaaaggaaaaatgaagctggttggaagttaattatggatagtgtggtatatgagcagaaattccccttaaccagtgttcttgcccaggctagcccaaatgagcccaggctagcctagattcccaagtgtgtatcttgagaacgaggaagagccctagaaaacaatgtgtaacgtccctccaagatggggtgttctggaacaatccctcagacaacgaaggcaattgttgatgggcaacattgggaagaccccagagatggaatgtcctaggcctttccatgttctctttctcattctccctccattgacttgataggtggctgggggatttataagtatttaccacacaccagccagctttctccggatggctccaggcatgcttggagcccagtggtctctttcccttagaatttgatctggaggaacccaaaattctctctgtgtcctttgaaattcagcacatttttcttggcttccatgagctcctgtggcatttctcaggccaactgttgactctgcttcctatgtctgtgcttgtccctttgagagatgtcagcgttgctcaccgattcttttctctgaccccagcagctcctatccatgttgtctttttttttttttttttcagacagagtctcactgtattgctcaggctggagtgcaatggcacgatggcatgatcttggctcactgcaacctccgcctcctgggttcaagcaattctcctgccttagcctcccgagtaactgggattacaggcgtgcaacaccacacctggctaatttttgtacttttagcagagacagggtttcaccatgttggccaggctggtctcaaactcctgacctcaggtgatctgcccaccttggcctcccaaaatgctgggattacaggtgtgagccactgtgcctgtcctcatgttgtcttgaaagtaacaagacaggcacggattctttttgatgcaagctgttatgggatgaattatgtctccccgcaaattcataggatgaagtcctaacccccagtttcctcagaatgtgactgtctttggagatggggcctttaagaaggagattaatgtaaaatgaggtcactagggtgggtccggatccaataggactagtatcctaataagaagagatgaggacttagacacacacagaggaaagattatatgaagacacagggagaagacggcatctacaagcccaggagagaggccttaggaggaaccagcccagaccatatcttgatctcacactcccagcctccaggactgtgggagaatcaatgtctgttgtttataagccacccagtctatggtgttctgtgacagcaacctgaaatggactaagacacctcataagaaggggagatgaggacgcagacacacacagagggacaatcctgtgaggacacagggagaagatggcatctgcaagcccaggagagaggcctcaggaggaatcagcccagcccacacctggatctcagacttccagcctccaggactgtgggagaatcaatgtctgttgtttataagccacccagtctttggtattctgtgatagcagcctgaaatggactaagacatctcataagaagaggagatgaggacacagacacacacagagggacgaccctgtgaggacacagggagaagatggtgtctacaagccaaggagagaggcctcaggagtaagcccaggaatcaatgcagttggaggttctgtgtgtgaatggaggagggaagctcacagatgaaggcgttttgagggaggactgaccttacagtgaggtacccagagacttcctgaaccaagccacgaatatgcagctcgtgctccgggcagtgccttctggcctggaaaccaaagctcccttgtgtccagtccccactcctctgtttggcccccaagtttccataatcccccacagttgtatcattttagagacctcaaaagagagtctaggctgggcgtggtggctcatgcctgtaatcccagccctttcagaggccgacgtgggtggatcacctgaagtcaggatttcaagaccagcctggccaacatggtgaaaccctgtctctactaaaaatacaaaaattagctgggcatggtggtgtatacctgtaatcccagctacttgggaggctggggccagagaatcgcttgaacccaggaggcggaggttgcagggagccgagattgtgccactgcactccagcctgggcaacaacagcaaaactccttctcaaaaaaaaaaaaaaaaaaagagagtctaggcagggcatggtggtccatgcctgtagtcctagctatactcaggaggctgaggtaggaggatcacttgagcccaggaggtggaggctgcagtgagctatgattcaccactgcactccagcctgggcaacagagcaacaccctgtctcaagagagagagaaagggaaagagagagagactattttgagaagtgaaaaaccagtcattctcagcccagatttccagtgttctgagacgtctgtcctgaggaaggactttgagaacagcatccttgccttttttgtgaattaaagtaatttcactcttgagccaatgtggataagcacttgacaggtactggcagtgccaggtaccaggaatatagaatgggtacagaaaataaagtttctagtccagcgacaaaaaggtgctgaagatacagactcatgtcgtgcaaagagcttgcactgattatttcatttcggcttcttgaatagggtcaaaggacatttaagctgagacaggagggacgagctaattaatgcttttccagatgacaaatggattcttcaaatatttagggagagtgtaaagtgatggacagggaacaggaggggtcatgacagaaggaatgccacctgcaaaagtcctggggcagggctgggcacggtggctcatgcgtgtaatcccaacactttgggaggccaaggtgggcagatcacctgaggtcagaagttcgagaccagcctgggcaacatagtgaaatcccatctctactaaaaatacaaaaattggccaggcgtggtggcacacacctgtaatctcagctactcgggaggctgaggcaggagaattgtttgaacccaggaggcagaggttgccgtgagctgagatcacaccactgcactccagcctgggcgacaaaagcgaaactccgtcttaaaaaaaaaagtcctagggcagaaagctcatggtaaacttgaggaacatgcaaaagtcattgcaaaaagttttaagaaattcaaatgaagccaggctcagtgtggctaatgcctatgatgattccagctctttgggaaggcaagacaggacgattgcttaagaacaggaatttgagaccaacctgggcaacatagcaagaccttgtctctacacaaattttaaaaattagccaactatggtggtatgcacctgtagactgagctacatgggtggctgaggtgggaggattgtttgagcctaggaactcgaggctgcggggagctatgattgcaccactgcactgcagcctgggcaacagagcaagactctgtctcaaaacaacaacaacacaaattcaaatgaaacggtgtaactcaagcaagatggaaatacaacacactatcaaaaggtcagatgtttcatcctaacatttatagaagtgactgacttctgtaaatggtgctggcatctgtagtagccctaaacagggaaaggtcaacaacgcactttctgccctgttaatttcagagagccctggacttcttgcgaaagcaccagtggtgtaagtttttgttttttcattgtaagctctgaggtggtattatgaatattgtctacatgattaataagctccgtaaaagcaatgggcagtaacatcttttctgtactttggcattcttatttatagatggtatctacctgaaagatgtcattatttttctgaaatcatactgttgttttccaacagatatctacccaaggccaaagccacgccctcaaccccagcctggcaattccggcaacagtggaggtaatgagtatttatttatttatttttattttattttattttattttattttactattttatttgattctatgttattttactttattttaccattttatttgattctatgttattttactttattttatttgattctatgttattttactattttattttattatttattttggagacagggtctcgctctgttgccctggccagagtgaagtgatgtaattgcagccttgaactcctgggctcaagcaatcttcctccctcagcctttcaagtagttaggactacagatgtgtaccacctacattgcaccacctatatttcaccacctatattggctatatttcaaattttttgcagagacaggatcttgctgtgttgttcaggctattcttgaactcccggcctcaagcaatcctctgcctcagcctcccaaaatgctgggattacaggcaccagctattgtggcccagcctgataatcagtattaaagtccattttagaagtgtttggggccaggcacagtggctcatgcctgtaatcccagcactttgggaagccgaggtgggcggatcacttgaggtcaggagtttgacaccagcctgagcaatatgatgaaaccctgtctctactaaaaatacaaaaattcgccgggcgtggtggtacatgcctgtaatccagctactcaggaggatgaagcaggagaatcgcttgaacccgcaaagcggaggctgctgtgagttgagatcacgccacagcactccagcctgggagacagagcgagcccctgtctcaaaaggaaaaaaaaaaaaaaaaagaagtgcttcacgcctgtaatcccagcactttgggaggccgaggtctcctcaggcagatcacctgaggtcaggagtttgaaaccagcggccaacatggtgaacccctgtttctactaaaaatacaaaattagctgggcagagtgacgcgtgcctgtaatcccagctactggggaggctgaggcaggagaatcgcttgaacccaggaggcggaggttgccttgagccaagattgtgccaatgcacaatctatctaggtgatagagtgagactctgtctcaaaaaaaggcgggggggtggttggatacaagtattatttaatgacttaaaaattctcatctccatggtgaaagaccaattgcttttgaaatgcacagacattgttttgcgaggagttcagttctactatccaccagcacctggggattacatttagttgatagtaaataaatttaaatgtttttgatgacattgactgaaaaataccatgcacactaagacatttcaagttatgatggaggaaggcaattttttcttgtttttttttttgttggtctgtgttctactcacttattcttccctctgcaagagttatctgcggccactttgcctgtgttcctacagcacttcccatctccgccttggcaattgtgtctcacgaacgtgagacactcaggaaagagatgctggtctgtaaagttggaagagtctcagcgattccattggtggggcaaatgtgtgcagattgaggaagctaagatacactgggtgtcttcctctctccacctgctttaaccattgggagttcccctgattgtgattgtttcaggacgttgcttggatgttgtcatattcctagggttcaaggcactccgtgaaatccaaggaaacaagctttgggtatgtcccagtgccttttcccttgggtcttgcaactgaagaattgtgtttcttccctagaaaaacgaacacacttttgcccactcacccacctcctgcaagtctccaaaaccacagcgttgtatcctagactatgttcccccaggaggtggttcctccctctgcattcccgtactccatactgcttgatatgttcttacatgcaacaccgtgcaattgtgtttagttgattcctgtgaattagaatgagaactctacatgggcatggatttttgcctttcattcactgctgcattccctagtctggaaagctgtgcctggcacacaatgagtcctaggtgaaggtcagtgaagtcattaatgcttgagtcccaacaggcaaacagctggattcatgaatgaaagacttaccgctacatcccttcatcagggtgtatagcttcaactccatttcctggaaagctctacaatagttcttcctcctcaaaaggctctggtcttgtgattcatagcattcgtccaccaagacatgaacaagggatctttatgtcagaggttccctgttcaaagctgttttagaggccaggcgtggtggctcattcaggtaatcccagcactttgggaggccgaagtgggaagaccacttgaggtcaggagttcgagaccagcctggccaacatggtgaaaccccatctccattaaaatacaaaaattagccaggcatggtggcatgtacctgtaatcacaactacttgagaggctgaggcaggagaatcacttgaacctgggaggcggagttcagttggagttgcagtgagccgagatcatgccattgcactccagcctgggtgacagaacgagactccatctcaaaaacagtaaaaataaaaaagctgttttaggaaacatcccttttttattattttttctttgagtcagggacttgcttggttgcctaggctgaaatgcagtggcgggatcacagctcactgcagcctccacctcctgggctcaagcaatcctccgactttagcctcctgaatagctgggactacagacacacagcactccacctggctaattttttcttttttctttttctttttctttctttttctttttctttgtgtgtgtgtgtgtgtgtgtgtgtatgtgtgtgtgttgggacagggtttccctctgttgcccaggctggtcacaaactcctggccttaagtgaccctcctgccttgacctctcaaagtgctgggattacagatgtgagccactgagcccagccctaggaaacagcctcttaagccaagtgcaatgactcttgaactccccagagcctctgtgcatgctacctcgacttcagcttcacagatgtatgcaactgcgggatcaggttaggggcactcacttaccggcagtcccaaagctctggagagtctgtgctgagggaatggtccatgttaaagcaaagcagaacaaccactctgccttttgtattttatacttgttttttttttgaaacagggtctctctgtgtcactcaggctggaatgcagtggtgtgatcatagctaactgcagcctccagttcctgggctcaagtgatcctcctggcagatgggactacaggcgcacaccaccaagcccagataattttttgtatttttttgtagagacagggggtctcactatgttgcccagactggtctccaactcctggcctcaagcaatcctcccgcctccacctcccaaagtgctgggttgcacccggcttgcatttcacacgtttaataaactcaatcagcatgtttcctaccccctagagtgacaatggtgcacattagcatggatttcttatagatcgagaccaaagacctaattacttatctatagaccaatcttggagaggaaaggcagactccaagggttaattcggggtccaggaaccacagaaggaaggtctccttggatctcgtttgagcctgaagtagctcagtctatgacagacaccatcagagggcagaggcacaggtgaacgcagcagtcggaactttgtcagagcagcaaaggacatcttaggaaatgaggcttgcaaagcagccttgggttattgagaaagctctctcagcgtggattctcagggctctgggatcttctctgccttgcaggtgcctctttgttttttgggaggaagcaggtgggtctcatgtgtcagggcagtaaggagcaggaatgaatggatgaaacaaatctgttggggtgggtagcggctgtgctctggggagccaagagagagacagggggatggtgctggtttcagacaagatagttgagcaggaacttgaaagagaaaaggagagtggatcgtggggacctgagaagctggaattctccctggggaatcggccactgccaacgtgagggctggggttaggagcatgcctatggtgatggagaagcctgggggaggtgcctggttgatggggcaagaggagccatctggagagaaggaaaagcctggagtctccttccgggcttgcttaaggactagggaggggcaggacatgagatgatgttggaggattctgagcaggggatgggcctaggtgggaggtggggcagaaggagagctggacgaggacatggtgagaggtgatgttggctcatccaggaaggacggccaggaggaagcagagggaaaggggcatgcaaaggtccagaggcaggagcaacggggaacatccagggaaggagggaagggcaggggatttggagatggggcaccctgagagagggatccaggcagcaggcagacacgacagcctgagcttcaccccagctcacggttggccctgggagggctttgagcagaagaggggcaaacatcagcaatatgaggccacactgcagacgttctgggccctgcacacgcctccttgcaggcaaggcggccagcccacaaggtaatttaattcctggtgcctgtgggcgtcctgcaaagagccagttggcgtcggaacgctcttctccaaaacctgtgccagtgcccccagcgcagacctggtgtgaaggggacctttggagaggtctcatgagcaatgccgcgtgctctgccccacaggttacttcaatgatgtggaccgtgatgacggacgctacccgcccaggcccaggccacggccgcctgcaggtaggtgccgagcctccccagatgcgacacattgaatttgcacagagagggtgggatgagaggcctgaagttggggatgagagagctgaggttggggcagagttggtgacgagcagacgataagctggtgcaggggatgacagagaaggccccatggccgcatcagtggggtttgcggtctgggcatctgtccgcctctccaggctgggggactggatggaaacaaaatgaacaggcagaactggagggtccactgaaacacttgcggtcatttctgtttagacttgtatatgtgtaagtgtgggtgtacatgtccagacacacctttatatatctgcatgcttatcaatcttcatttgtgtgtatatagatgtttatgtatctttatatttgtgtgtatatatgcttttaaatatatataaatgcatctacatatgtaggtatatggtttttttcatgtgtgtatatacatgcttttgtatatatacagtacgtggatacctttctctgtttttatatatgtatatcctgactttatatatatccttatatatatctttacataggtacatgttttatatgtgtatatatatctttatatttatatgcagatatatgctttttatatatatttatgtatatgtatatcgtttaatatatctttttaaaaatatatcttcatgtatatctttaaatacatatacattttatatacattttaatattttatgtgtatgttatataaatatatatctttacatatataattaaatatatgcctttatttatatacatctttatatatgtacatatatacctttacatgtatgtgcctttatttatatatgtatatatttatatatacacttttatatatacatatgtgtatatctttatatgtgtgtataaatgcctttatatacgtacacatatacctttatgtgtatatacttttatatgtgttatgtatgtacacacaactttatatatacatgtgtatatatctttatataggtatataaatgtctttaaatatgtatatacatatcttttgtatttatttatttttttttgagacggagtctcgctctgtcgcccaggctggagagcagtggcacaattttggctcactgcaacctctgcctcccgggttcaagtgatgttctgcctcagcctcctgagtagctgggattacaggcgcctgccagcacgcctggctaacttttgtatttttagtagagacggggtttcaccattttggccaggctggtcctgaactcctgacctcgtgatccacctgcctcagcctctcaaagcgttgggattacaggcgtgagccactgtacctggtctatatgtatatcttctaatgtatctttatatatatctttaatatatctttatatacatgtacattttatatacatttttatattttatgtatgttatataaatatatacatttatacatatataattatatacctttatttatatatctttatatgtacatatatacctatatatgcttttatatatgtatgtgtacatttatatatacacttttatatatgcatatgtatatgtctttatgtgtataaatatcttcataaatatatttatatatctatacataacctttatatatgtataaatatcttatataaatatatattttatgtgtatatatgcattatttgtataaacacatatttgtaaatgtctttccatatatatgcatatatagcttacatatgtttctatactgttatatataggtgtatacctttacatatgtatgcatactgttttatatatgtgtatataggtcccttcatgtatatatgtatatacatttaggtatatgtgtgtgtgtgtgtgtgtgtatatatatatacacctttatatatgtacatttatctttatacacacagacatatataaacacttctaatataaagttttctctgtaattggaggtgaatgtctatcaataatctttcatatagaaatacaagtacagactataggagacagagatgcatacaacattgggctgaagagtgtgatgtttgaggctttattttcaagcatgtgaggtttctggcctgtttagttctgcaattttattttagaagacataaaggacttgtcccagatattttgcaaagctggacctgcatctttcggacaaccagattgcatccagtcatcttttctgccgtgtttacttgcaataaataaagagcgctgtcttaggatttattacaataacaatcaggaataaactaaaaattactagttatttttgaaaggagaagctgagaacatttacgattgagaccatctgctggaaggtcctcctaatccggcgtcggcgtggctgatctcatatcagtttctcggcaggaagcgggtgcgcctgcgtgaatttggagtccccagggtaaatgttagtcccgtgacggcaaagtgtttttgatagctagagctcagtgttggcatgagttttcccacggggaagaggaagctttggtggggccacccttgactctcccctgctggtcactctttggagctctcttggcagtgacacgttcacacgacttgttgccattcccaatgagctggacagaccaacacctgcaggaaaccccacgctcagacacctgaacatccctcaactctaccttctctgtctaacaggaggtggcggcggtggctactccagttatggcaactccgacaacacgcacggtacccctacatctgggcatgcgatggtgggtggagggtgggaggggtcatctttctagggctcccgcttgcactctgccctgggccttctacctggagtctttggtgagtagggtgctgtgtgctggtgcctggtcttctgagaacctgtctgtgctgggctgttctgcttctgttccccaggagggtgggtgcagccacacatacacacacgcatacacacatgcacacacacacacacacacacacccctttaggtaaaagtaaacagagcaaagaactatacaactaattagagaaagagagcatccaacaaactggagagcatccaacaaattctttaggggcgcagctcgcttacttcaagcagaatagaaaacactttcaatggctgggcgcggtggctcatgcctgtaatcccagcactttgggaggctgaggtgggaggattgcttgagcccaggagtttgagaccagcctggacaacatggaaaaaccctgtctctacaaaaaatacatatatgcaaaaattagccaggcgtggtggcatgtgcctgtagttccagctactcaggaggcagaggtaggaggatcacttgagcccaggaggtcgaggcttcagtgagcagacagagataagatcgtgccactgcactccagcttgggtgacagactgagatcctgtctcaaagaaaaagaaaagaaaagaaaagaaaaaaagcaagagaactcttttggtcggtgcttatgcccagagtgaaagccgtgttctacagaagccataaacaggctcttggcttggttgagtttttctcatggagaccaggggaccttgaaaccctcagatcctctccggtttggaaaacgactgaagcaaaatgtcatcactgagaaagaaaacaataacaaaacactctgtaggttgattttaaaccatcatctccgttttaacattttccctttgttaagagttttgtacaccttcaatgaattgagtaaccatcttttcttttttttttttttttttttgagacagagtttcacttgttgcccaggctggagtgcagtggtgtgatctctgctcactgcaaccttggcctcccgggttcaagtgattctcctgcctcagcctcccaagtagctgggattacaagcatgtgccactacacagggctaatttttgtttttttagtagagacagggtttcaccatgttggtcagattggtcttgaactcttgacctcaggtgatccatctgcctcagcctcccaaagtgctgggattacaggcatgagccactacacctggctaatttttgtatttttagtacagatggggtttcaccttgttggtcaggctggtcttgaactcctgacctcaggtgatccgccctcttcagcctcccatagtgctgggattacagacgtgagccaccatgcccggccttgagtaaccatctttttggttaaaactaatatgtgccaagagctctggtaatgtgggaagtacttttttttctttttctttctttttttttttttaagatatggtctcattaggctttgtgagagccaaggctgttggccccctaagttttctctgaatcactgacatgaggcagcttaattaacaggagaaaaagcgtataaatttattgagtggatatacacgcaaaccttcagaaccaagactcaaccaccaatgggatgcaaaagcttatagaccatcttttttaactttgatgttaggttcaggggtccttgtgtagggttgttacataggtaaattgtttgtcaccggggtttggtgtacacattatgtcatcacccaggcaataagcatagtacctgataggtagtttttccatcctcactctactcccaccctctgccctcaagtaggccctggtgtctggtgttcccttctttgtgtccatgttgtcaatcgagaaaaatgacgagacgagcgtaaaagatttatttgccaaagttaaggttaagggcgcgccccaggagacaggtctgtggccttctccgaagatgattttgaaggctgcaaatttaaaggggaaagggtgggggtagggaaaaagagttattcatgcttttgtctggctcagtgaatctgtgtttttttacataagatggcatagacaaatggggcagagggaaaatgcagggaatctgcatgttgcataagataatctggacaaaatggggcaggggagcaatcacatatgatttgtgtctgctgggcgggggtgactgcaaagctgtcgatttgcatattgtcatggtgaaatcttcacagctcactaggattttccttgtgggcaaaatatgggggagacgtgtagcttttcatcttgtagccattttatttaggaaccaaaagggggaggcaggtttgtgtgacccagttcccagcttgacttttccctttgactaaatgagttcaggatcacaaaatttaatttcctttcacaatgcgtactccgtgtttagctcccacttgtaaatgagaacacatggtatttggttttctgttcctgcattagtttgctcaggagaatggccaccagctcgatccatgttgctgcaaaggacatgatcttgttcttttttatggctgtgtatatgggccacattgtatatgggccacatttcccttatccagtctaccattgatgggaacctaggctgattccatgtctttactatttgagtttgctatttgttgttctttgcaggaagaatgtgggctcagagcatggccccaaataggtgacgttggtaaagcaggtttaacgggtggcaagccaggtgatgagagggagacaggaagaggcctgcttagcaagggggtccttgttatgcagatgaaggttcccaggtagcagcgctcagagacgaccatggtaaatgtttcttttcagacctgtaaaggtgtcagagtctccgtttctctctcctacatccaggaaaagcttagaaagggaaggcctggctgcaacagcaaagatcctctacagatgccaatttccccacctcagtctgctggccctggagcggcaatttcaaaataaggcaaagcaatatattttggagtaaaatattttgatgtccgtcatcttcgttacctcggaagcgagtgttgtcatcagatccatttaacaaaatgaaagcaatgcatgacgctcgactgtccacttcaaaggagcaatagctgtggccctataggtagcccatcctcagaactcactccctatgacacagacaagcttcaggatgggagggggctcatgacaaagtgctcattacctggggtcaagaactgtctacttttggccgggcatggtggcccacgcctgtaatcccagcactttaggaggccaaggtgggtggatcccttgagttcaggagttcaagaccagcctgggcaaaatagtgaaaccctgtctctacaagaaaatacaaaaattagctgggcatggaagtgtgcgcctgtggtcccagctactcgggaggtgtaagtgaccctggaagtttgaggctgcagtgaaccgtgatagcaccactaccttccagcctgggccatggagtgagaccctgtctcaaaaaaaaaaaaaaaaaaaaaaaggacactaaaaaagaattgaccaccttcaactcaacgtactatgagatgagttccttccaccatctttctggaactagctaaggggttccccttacctactacctaggtagacctgatttattaagacgggaatcgcaatagagaaagagtttaattcacacagagctgactgaacgggagcatgtgaagcagctatgctgtctggggtacatacctggggttcattgttgcacgctgagaaagaattcaggacacagacacatgtggttgggttaaggagttgaaagtttaatagaagaaaggagagaggagagcagctccttgcaagagagagagggagagagagaaagagagagagagaaagagaagcatctgaaaaagttgggaggttgtggaccgcagcagcttttgtaggcaggctggaggaggtggtgtctgatttacatagggcttacagactggttcgatcaggtatgacttctacatagtgcgtggggaaggctggtggccccaccctaattttgttatgtaaatgggctttccagttggtcagtgccatcttgtctgctacttactgtacatggggctgacaaagaggagggaagatgaagctgccatcttgaacgtgtctaggccctagttcctgccggcattcacccatgtaagctcctagctggcttgtctatgtctgcagctcaactttattttttattttttatttttttttgagacggagtctcgctctgtcgcccaggctggagtgcagtggcgtcatctcggctcactgcaagctccgcctcccgggttcacgccattctcctgcctcagcctcccgagtagctgggactacaggcgcccgccaccacgcctggcaattttttctatttttagtagagacggggtttcaccgtgttagccaggatgatctcgatctcctgacctcgtgatccgcccgcctcggcctcccaaagtgctgggattacaggcgtgagccaccgcgcccggccacagctcaactttacaggctgctctttgttagaaaatgatttggggctgcttttcattaaaaagaaaagccttaccaaggactcccatacccttgctatgtgcctaagtaattaactaattccttcttaactcctatatcaactggaggttttgcttttttttctttaaacagggtttcattttgttacccaggctggactgcagtggtgaaatcatagctcactgcagcctcaacctcttgggctcaagcgatcctcccgcctcagcctcctgtgtagctaggaccacaggtgtatgccaccacacctgcctaatttttaaaaaatttttgtagagatggggtctcactatattgctcaggctggtcttcaactcctggcctcaagtgtttctccgacctcagcctcccaaagagctgggattacgggcatgagccactgcacctagccaagactggagttttatgactcaaatcagcttcccccaaaatttggacactgggctttttaacgtgtaatttggctggtaggagacccgggcgtggggagtgctgagtggttggttggaggtggaatgacagaggacggacatgggttctttttgttgtcttctgttcttgtgtgggacggcagagctcgctgagccgcattaccagtctgggtggcgccggctggtgcatctcaatgaagggtttaaaaaatgtctcaacttcaaccttaggttttacaatagtgatgccatccctaggagcaactgaagaggtttggaatcttgtggcctccggctgcatggctcctaacctattaatataatttctaatcttgtgactaatttgttagtctttcaaaggcagtctgatccccggggaagaagggagtttgtttcagaaaagggctgttatctttgtttgaatgttaagctggaacttcctcctatggttatctgagtctgtgttcaggaatgaactagggctgttcgagggctacaggcacgatgcagtcggttaggtcagatctctttcactgtcgtaattttctcactgttataatttttgcaaaggcggtttcaatttaactgaaaatgtcaggcaaagaccaaatttaatatttttacagaaagccactgggagtagttttttattgttttattatttatttatttagagacagagtctcactctgttgcccaggctggagtgcagtggtgcaatcatagctcactgcagcctcaaactcctgggctcaagcgatcctcccacctcagcctcccgaggagctggggctacaggcacacaccatcatacccagctaaatttttaagaaattttttgtagagatggggtctcaccgttgtaactgcccaatgggtttaccttgccccctgcctaaacagggccgatttatcaagacagaggaattgtaatggagaaagagtaattcatgcagagccagctgtgcccgagaccagagttttattattactcaaatcagtctccccaggcattcagggtccagagtttttaaagataatttggcgggtaggggcttgggaagtggggagggctgattggtcaggttgcagagggaaccataggggggtgaagtgaggttttcttgctgttttctgttcctgggtggatggcggaactggttgagccagattaccgggctggctggtgtcagctgatccatccagtgcagaggctgcaaaatgtctcaaacaccgcgcttacgttttacaatagtgatgttacccccaggagcaatttgcagaggttcagactcttgagccagaggctgcacgacccctaaaccataatttttcttttcttttcttctttttttgtttttttcgagacagagtatcactctgttgcccaggcttgagtgcagtggtgtgatctcggctcactgcatcctctgcctccctggttcaagcaattctcctgcctcagcctccccagtaactgggactacgggcacatgtcaccatgcccggctaattttcatatttttaccagagacggggtttcaccatattgttccggccggtctcgaactcctgacctgaggcgatccaccctcatcggcctcccaaagtgctgggattataggcttgagccactgcgcccagccctaaactataatttttaatcttgtagctaatttgttagtcctacaaagtccaactggtccccaggcaagaaggaggtgttttcaggaaaaggctgtgatcagttttgtttcagagtgaaaccatgaactgaattccttcccaaagttagttgggcctatgcccaggaatgaacaaggacagcttaagggttagaagcaagatagagtcggttaggtctggcctctttcactgtcatcatttcctcagttacaatttttgcaaaggtggtttcgccacgttgcccaggctggtcttgaactgggctcaagcgatcctcctaccttggcctccataagtgctgggattacaggcctgcaccaccacatccggcccaccttggagcgtgttatataaagcgagccgtccccacacccctacagcctacgaatgagccttttcaccccatgcacgattctctgaaactgctctctgtaaggagctattcgggacacgttcttttgttctctggcatactcatcaggtagaaagaagtgattcagcaagcggctcccctgagagccctgatcgtttcctgttttcctgtgaagttagtctcgggaggtctgcgctgtgccatttttgggggaccattatctggctcccgaatggatcaaagcttactggtcagggggctgctgtatccctggggcaaaactgccagaaaatagcaggtagccctgtggtccttggcagggccagggcccggtggaagcagcagctgggccaagaacatcaggcgtgcatgaggcacagcccagttttgggagcatgacgcttgttttcgaggatgcctgtgctccccttcctgcctggacccctgctctccagccccggcagagcgaggctgtgagtcagcgctcggattagcatcagcatggaggtgccggctgggatgcaagccgccgccatgggatgagtcacgcggcttctccccgaatccccaaaggaggcagagcgtgttaggcttgttctggcttcatgcagagcactgaggggtgagggctgaccgtggctggccgcggagggaagcccaaagtctggcctccctgcggagactggggagaaaatgttgcgctcgtcgtttttaaatactgggggacaagtttcccttgtctgctaaggctgccattgtaaattacaagagtcaggagggctgaagcaaaagggatttcttctcccacagtcctggaggctggaagtctgagatcaaggtgtgagcagggctggttcctcctgaagcctctctccttggctcgtcgacatcatcatctccctgtgtcctcacagggtcgtccctctgtgtgtgtctgtgttccaatctcctctccttatgaggtgtcttagtccatttcaggctgctatcacagaatactatagactgggtggcttagaaacagcagacattgattctctcaccgtcctagaggctggaggtccaagatcaaggtgtgagcagggctggttcctcctgaggcctccctccttggcttgtagacaccatcttctccctgtgtcctcacagggtcgtccctctgtgtgtgtctgtgtcctcatctcctcttcttataaggtctgtagtcctattggattagggcccaccctagtgatctcgttttattttaatcacctctctaaggacgttgtgttcaaatacagtcacagtctgatgccctgggggttaggactgcgacctgtgaatttggagggggatatagttcagcccatagaacccactatccacataagtcattccacttcaaaatcagcacaaagcattagttttaaaaatctcaaatctgtatttttaaaaattgctcttaacacattagaaaaatatagaaaaactttttttgctgtttttctgagacaaaatctcactctgtagcccagcctggagtgcagggacgtgatcatagatcattgcagcctccacctcctgggctcaagcaatcttttgcctcagtcgtctcccaagtagtagctgagactacaggtgcacatcaccacacccagctattttttttttttaagtagaaacggggtctcactatgtttctcaggctgggctccaaatgagctcaagtggtcttaccgccttagcctcccaaagtggtaggattacaggtgggagccaccacacccaacctggaggaactctttttttttaaaattttaaataaattactatttgtggcctgcgttttcatcctattctctttttttttaaccaacatttgctggcatttttttttatgccgaagaaaacacctttgcccatctatgtcaggcctccagaccctcagggatgtacatctaatgcaccttcagccaccggtgtaaacagtaaacaggggccagatggcgcctgtgcaccttccctggccttgggagagcattggaatctctgcagcttttaagagcatcttgcttcaggtttgctgacctgcttgcttctgtaagatcatgcagacttcctgagcaatatctagcatttcatggtctcttttctatcctgcaggaagagggggctatagactcaactctcgttatggaaatacttatggtaaaggaattatgtcttacagaatatgtgaggcaaaactgtccatttgcaaataactaacacactgtctgcactgatgggaagctgatgctttcatccagtgcacaaccaactggccgttcgagtctctcatttgcattttccttggtcatccatgctggggggagatgttgtgcatgccctgaggacttcatttcttcaaaggaactatggcccacttacaggtgttactgggtgcatgtgtgtgcacgtgtgtgtgtatacatatgtgttcacacacaggtatgcttgtgtgtattgtgtgtgcatgcatgtgtacatgtgcatgtggattttgtaatcatgtgcataagtgcatgtggatttcatgtgcatgtgtgcaagtgtctgtgcacacatgtggattgagcacatgcatgtttgtgtatgtgcacagatgtgttggcatgtacttgtggattttgcatgtgtgcatgcttgtgcttgggttgcatgtgcattgcatgtttcccatgtgtgtccattcacatgcatacatttaggggtgtgcaagcacatgtgtgcatgtggatagatgcaggagtgtgcatctgggtgtgctcgtgtggtatgtgcatactgcacgaatatatcatgtgcatctgtgcatgtggattgtgtgtatacatgcgtgtgtacaggcatgcacacacacacatgaatgtgtttgtgtgtgcatatttgtgtgtacatgcatgtgtttatgcatacaggtgtaaacatgtgcacacatcggtgtgtgcatgtgcacacatgtgtacatgtgtatgtttaggcgaattgtgctttatatgtgcttttgttgcctgtgtgtgtggtatgtgcatgtgtgtgtatgtggggatgtgtgggatgtgcatgtgtgtggatgtgcacattgcattgtgcttctgtgttgcatttgtatttacatgttgcacatgtgtgtaaatgcatgtgtgtgtgcacgtgtgtatgcgtgcttgtctgcctgtgtgttgcacgtttgttgcatgctgcatgtgtgtatgcatgtgcacacacatttgtgcatgtcagtgtgtgttgcatgtgcttgtgtatgaatggcgtgcgtgtgtgcatgtgtgtccatggggttgtcagcctgtgtgtgttttgcatgcgcatgtatgtagactctccaatcctgaaattaaagctgcatctccctctccctggtattatccccattctgctaatgaccattagacatggcatacacattcacattcctcctccttatgctgcttggctgtccccctccccccacaagaatgtaaattccctgaaaacagggatctgtgtgctgtgttcacagtcgcatcctcaacagtgcccggcaatataaggccctccataagctctgctgaataaacacgaacatccttttccgcttacaggtggagatcaccattcaacgtatggcaatccagaaggtaactgattgactcacccggtcccaacctttaataagagcacactctcctagatcagtgctgggaggagctgtgtgggcttctgtttcccaacctcatgactttcacggagcactcatactttgtatgtatataaagtagctcctgaataaaaatatctgaccttcagcacaggaccaatcagagttcagagaaaggagaggcaagcattggttttcactgcagaagatgccccttagctctcaaagcaaggctgtgaatgagtgctgagactattacatttctcccagtaccaccattactcccctttctttgaccagcactaacttgaaacccaagaaggacaggagaaaggaaggtatgaacactctgcccaaagaagccatcagagtgcactgtcaatcccgtctcaggtcaaaggagggagaacttgaagcccagaaggctgactttgtgtcctgtattgttgggagaacaggttccccattccctaagggtcatattcttagagatttgggctgacacctgcttgagtttaagttgagagtaaacgcactcaaccccaaggctcttgtgagttttcaattatgggggaggagaaagtgattgaaggtgacctctacctttcaatgatcatgcagagtactagtatcaatatttttggggtatgttggcatccttagaaaaatttatggtttcacctttttccctctgtggtgtaaagtgaggtccagagatggaaagggcaaggcaaataaacaagtaattgcagtcaaatctgatgaataatttcctggaacatatgggatcctgtagcaaggcagaagggatactcctagactaggttaggtgagggaggtagggtttcctggagagaacaatatccaagccaatcccccaaaatatgggtgggaggtgcccaggagaagagtgaggtgtcagggaagatggtgcactaggtagagctggatacacacgtggggacaccggaaattgtgtagccaggatgtggaatgcaacgggaaccagggaaggatgcaatggtgaccaggaaagacctccaggttagcagaggtggagtctgcacttcatagaaccttcatgggaaggagcctgcccctgttgatatgtaggtgaagaatggacctgagggggctcactaagacccagggagacaccctttcagaccagttcagtactccctggaaatgatgacaggctgaattaaagcctgggcaaaggaggcaaagagaagcagtcagcttggatgaccacttggtaatgacaattgattgtacttgattgatttgtaagagatgagagagaggaaaaggtatgtatcagtcagctatgctgtgtcacaaaaaaccccaaaacttagtagctggaaataacaaccatttattatgttcgtgattatgtgagtcagcaatttgggctgacaccattctagtggtcctcctggtctcttctgaactccctctcttgtgtgcagtcaactgtaggtgtggccagcgctttgaccatgtttcctgggtcttcttatgtatctgggactttaggtggaatggctcatctcagcttcatgtgggctctcacatccctccaggaagccaggccaggcttcatcacatggtgaccagacagggtaccaagagcatgaagagaagcgtgcctgggcttagagccaccatgccttcacttgtgtgacattctgttggctaaagcctggattttcagaatgaagatgcagctccacctctggatggggaacactgtgaaatcatactgtggagcgtgttcatgtagggaggggaagaatagagggctgtctctcccaggaggcagggtgtggcgggcggcagcatcagccgtagagcaggttcttgcgttcagtgacaacactcttccccccagcatggcagcctcattcgtggagcagtcttgtgtccctcacctatgccatgccatgtattggcccaggtgttcaaccctgtctgaagaaagccatgcatggaaagggtggctatttcaaatggaaacggtgatttcttccttttttccctttggaagtgttgatttttgtcacatcaagctccttcttgttctttgtgcaggagtgccaaagctctggagcaatttgccatcgaggcattgaggatgcttgtgtctagtgtgtgcttgggtctagagttccagcatgcctttgaaagcaagcctatctggcagtttttagtggaacaatatttttgcatgagtgggcattctacatctaaaaaggcacaaaatagttttgacatgtgcctgtcatcccaactactcaggaggcggaggcaggaggatcacttgagcccaggagttcaggacgagcttaggcggcatagtgagaccccatctctaaaaaaataaatcaggccaggcgcggtggctcccctctgtaatcccaacactttgggaggctgaggcgagtggatcacctgaggtcaagagttcgagaccagcctggccaacatggtgaaaccccatctctactaaaaatgcaaaaattagttgggcatggtggcatacacctgtagtcccagctattcgggaggctgaggcaggagaatcgcttgaacccgggagaaggaggttgcagtgaactgagatcacgccactgtattccagactgggcgacagagcaacattccgtctcaaaaaataataagaaataaataaataaataaataaataaaattaattaaaaggcatacatgaattgacttcaacaaacaaacaaaaatgccaagtgcctcgtctgtgcaaatcctggccttggatgtcttcagtggtaaaatgtggttgacaagcttggctctttgtgaaaacagaattacttcctaaggtttttttttctttttttttaaattaagtttctcttttttttctgtgaatacaagggtgggaagggacgtgatggagaagttactagatagatgcaaaagttattgcagtttttgtcattactttcaatggcaaaaaccgcaataacttttggaccaacctaatatttaagcagttttcctgcagccatgtttttttctcggatgagcttgctttttctccactcctgcaggcaatatggtagcaaaaatcgtgtctcccatcgtatccgtggtggtggtgacactgctgggagcagcagccagttatttcaaactaaacaataggagaaattgtttcaggacccatggtaagtttggctctaaacattgttttgcttgttactaagcctgatttaaaaaaaaaaattactttcagatgtctgtcactagcaaggttatttctggttaagttcaatatacataacttgcctaataatgtgattttttaaaatttatttttattctttttgagacagagttacactgtgttgcccaggctggactgcagtggcaggacctcggctcactgcaacctctacctcctgggttcaagagattctcttgcctcagcctcccgaacagctgggactacaggcatgcaccaccacgcctggctaatttttgtatttttagtagagatggggtttcaccatgttggccaggctggtcttgaactcctgacctcaagtgagctgcccgccttggcctcccaaagttctgagattacaggcgtgagccaccgtgcctggccaacaattgggttttcatggtcaggtgtgagctgtaccttcctctaaaccttgttacaatgaggctggcacattatctgtctaatgtaaaagaggaggagaaaaaaaggaaagaaaaagaaacaaacaaacaaaaattaccaacctacattgcaagactataagcatgacggttggtttaactacctgttctgttttgtattcagtgaaattttcgtcacaggcgagtcaggaaaaatacctgggttgaatgtgaatgttttgcccagaaccccacccgcaaagaaaactaccgaaacactgaattataagcctctctgaaattccgaaggtgcgctcagaccataggggagaggaaagatctgctgtggcttcctggttcaatgccggctccacactcctgggtttgaagaatcacttgggatttgagagcagaggatgccctaaagaaatctctgaaacaacagtcagggattgttttatagcctaaagagtgactcagatctttaactgggtgtctctggaggcttggtttaaacctcaggccacccacgtcagaatctgtctggagtttgcccagggccctctaactcataccttctttgtgtccccgaaggaaaccagaaaggggtgcccattcctacggtgtttgctttaggatttgcatttggcctcaaaaatcctaaaaccttcccatgcgctccctctgctggtgaatgggcagtatcaaccgttagctaatgaacctccgtttggggtgagcctccgtctacattacgccccgtcctgaaattttaggaggaaactgagtttctgaaaaactgccttattttcctggcaacctgagagcagattcttgggttcagtgacaacactctttcacccaacatggcagccatcattaacgaacaccacgtgttaacttcagtagcttttgtggcagtgatttgtaagcctttgttaaccaagggctgaaactgagtaagcagagagaggcacccatctccacaagcacaaaatgtaagggcggggtacaggggtcccccacaaactcaataatcaaggcaaatatattttagtgcaatattttagaaggaaaatcattggaatgggggccagttgagtttctgaaataggtgtagttttaaaaacgtggatgatgcctgccccatttatctgaggtggaaggaagcacgtttttgctaaagaggtataatgtcttgaagctctttcatgccttttggctgcctggtaagtatttttgtctactttctccattgtacttcgatgataccctcaccaggtattcccaagcaccaagtttatcttcccctcccttaaagttcctgagatcagaaaggaggatgtagacagagtgagctgatgttagggagatctcttcaagggtgagcagtgacatttatgtggatcctgggcctatatcacctcgctggctgtaaagcctttatactatctaggaaatatgtgcatgacagcaaatacgtatgggtttggtatcaaatggggctcagagctctgcgaacttgactctaaagttccaggctgctgctaatggtacccagctgtccacctctccttagttaggtcattaattttctctgtctcctaaaggatgacgtacatggtatactaaccatatccatggtgatgtggtgcagtgcacaacctgtggaactgtgtacctgctgaggccatacactgaagcttgcacactttgtagagaaagagttgtagtaacagagctacacagatagaagcagatgtctgtcacttgatgtggacttttaagaatcatactttgcttttattttataaagtggagcaaatgacaacatcacttcagaagttataaagaccaacaaggccatattcgaaaaaagaagttcctacaaatattagttttaaccaaaaaggaagttactcaattcatttaagatcatcaaaatccttaacaaatggcaaaatgtcaaaaacaatgttttcaaaacgaatatttgtttccagatatgattttaacagtttttaaatattttctatttttaatttttcctgctttattgaggtatagttgacaaataaacattgtatatatttaagatgtacaacttcatttctgcatcatttatttgttctaatctatctccttctgccgaatgtaaagcaggtgtcatgtagacagcacatagtctgatcttggttttcttttttttaaaatagatttttcattcttctagctttattaaagtatgatagacaaacattgtatatatttaagatgtgcaacttcatttctgcttcatttttttctgttctaatcttccttctcctaaatctagagcaagagtctcttgtaacagcatagaattggatcttggttttctttttctctgtttaataagacttttttttttgcccccacaatgacatttgtttctaatcttcctttcagaaccagaaaatgtctgaagatgttaagatcccctgattactttgagaaaaacaactaaaacaagaaccgtgtttatcactgttgtggagatttccttttattcttgacacaatttgatgacctaaagtgtgttttcttctgtgtaaagtacatgagctgcctcactaagcattcccaactcattgaatgtgatgtggttataaagataagttaggcagctagaccctgcgttctaaaaaaggattgcttgcaatgttggtttggctattcatttgcacaaagagactgtggctctctgttgtgagatcttcagctacctcatggtgcaataacacacacacgcttaaccatgttgatggcacaaagcggtgagcagtagggaggtagaatatcttggtggggaggggatgttatcagcttctgggagatgaagaatattgttgaggttccaaagatgctggacctgtgctaaattcttcagtgatatgaaaaaatcattgagcattcattattgcgaatgaagtggggatgcattatttctgacacccacaagcagggtttgatcatcctttcagctttgagatatctgcacataaaattattattacctgaagaaaataaggctgcattttgaaatgttaagtgcaaaatgactgatgttaaaaccatctgggggaaatcttgggatgctttttcctaggaaatcatatggttgtgatatgttttggcgcataggagacagaaatagtgattatcaggcgttgagcctttttgtagtatttttagtctttgatactctgtaagtgctagttcctaaggcaccaacattgcattccttggtttatactttttctattcatcagggtaggaagtcttaaatccttaggcatccaagaagtatactagctttttgcttctcttttagaaatacttgtggggagagaaaaaaggatggtttgggcatattggtatagtttgagtaaactaaggttaatgttcatataacatttagactttgccataaatatcagaaccaaagatcaagacattcatgtacagtctggaatgtatatatggggcccataaaaattcccagtatgcatgttttatgctcaccattatgaattggggtcttcaaagagagaaggttgaaagtggaaagcacttgaaagggctccccggtttgtaaaatatctttaatcattcacattaggtacctcggagttgcgggtctcaaatgtggattcatgcatcatttgtgcagtttgaagatagtccatatttcctatttcagtattaggtcctgcaacacttttcaattcttgtagaaggtttttttcaggagtggtgatgtctgatgctcaattactattttccctataagagtttcagcatgagcttaattaaattcttgtgaaaaaacctgtgtttttagttacacacacacacacacacacacctacttaaatggaatctaaacatttttagcctttaatccattccattttctaaaactgtcataaactatttttaatcattttaaataaatgtaaaagaaaaataactggatttgattattgaatagtttttttctatatttcacaaataaattgtatgaaatgactgtagaagtggccccaaaattatgaaccttcgtagctgtgaatatgatgccataaatctcttttaaagctcaagatagactatgaacatatgaaatacatagttacctaatcatgagactaaattcacctgggtgacaaggctaacgttcaagctacttaagatgaaaatatttgaatcatgattgcttgggggaacctctctttgaggggtcatgaggaccacctgctgggcattctgttttcatgctgagaaggtgagaattgaacagatgagaaaagccttgataaaacgtcatctccatgtaatttagagaaggataaccttgactgtacagctgacccttgaacaacacagggctgaactgcacatgtccacctgtatgtgagtttgcttctggctctgccattactgagacagcaggaccaaccctccatctactcaatgggaagatgataaggatgaagacctttatggtgatccgcttccacttaataaatagtaaattcatt

SEQ ID NO: 2914 - DNA, 62350 bp, human
caacaacaggagggtggagaggccgggtctcacaatccgcttggctggggagtccactgaggttcttgcatcctgaagcaaaccatggagagctggtggggacttccctgtcttgcgttcctgtgttttctaatgcacgcccgaggtaagaggcattttgctttgagggagatctgcctgggcatggatttttctattcttgctttaagaaactctttccaaaggagttgctatgaagtgaatggggataatttgcccaatgggattagaaaggagactaagagcgatgggtggctgagaggggagggagaagacgggctgctcccatttggaatctgggaattagatccagaagggcaggatgttagctgataccatctagatattcgccatattttcctgttttgatccatgtgtcccaagcgtttaaaaaatgacctatttaactccatgattcaagcatgactgggtgtgtgtggaatgtcagtcatttctttctgattttaaaaattagttctgaccatttccatacagtaaaagtagagttgaaactacttcatcccgtggggcagattaccagagattcgtttgccggaagggttgcatttattcagatttttaaatcttttcctaaacactgtcattcattcttgcaaattaaaaccacctgaattgttcacatcaaaaacttcgatataaacttgcaggctggctgtcccagatccaagattagatttttcagttccgtacgaggacctctttaagaaactccaatgaactcataaagtacaggatttgaacaacggttgagtaagtttctttggtcattttcatgtggcgatttcagagaagggaacacctgggcgcatcttaagagagagaagtatttctgttaggagttaaaacacatcattcagatgtccctgtggcagcatttcctgtttatcctatttaaagacatggacgtcattaagattggagttggttgtttatgggcggaggcggtgtcgggatggatagatcctggtggacatagtctaggatctgcagtgagaattttttattattctgtgctgtcttcagatctcacctagtaagtggacaatgtggccatgcattcattagcttctgtttacagggagatgttcaacagtaaacccacctccccagaaaagtacttccaggagtttgtatcattcacagtaagagccaaaggttaaccatatccccttgggcaaatcaacttctacaaagtgcggatacagacagttcccaacttaccatggtttgacatgatggttcaatttaagatttttcaactttacaacggtgtaaaattggtatgcattcagtacaaacgaaaactgtactttgagtacccatacaacttttcttttttttttttgagatgtcgtgtcgtttcattctgttgcccaggctggagtgcagtgacacaatctgagctcactgcaacctccacctcctacgttcaagcaattctcctgcctcagcatctcaagtagctgggattataggtgcccaccaccacacccagctaatttttctatttttagtagagactgggtttcaccatgttggccaggctggtcttgaatcttgacctctggtgatccaccggcctcccaaagtgctgggattataaatgtgagccaccatgcccggccccatacagccattctgtttttcactttcagtacaatgttcaataaattatgtgaggtatgcaacacctcattataaagttgactgtgtgctagatgatttgtccatccgttggctgatgaaaagtgttctgagcactctgaaggcaggtaaggctaagctatggcgtttggtagggtagttgtattaaatgcacttacaacataaaatattttcttttttttaatgtgttttaatttttttgagggaggggcccactgtgtcacctagactggagtgcggtggttccatcatagctcactgcagtcttcaccccaggggttcgaacaaacctcccacctcagcctccagagtagctgggactacaggcatttgccgctgtgcctgactagtttttaaaactttttgtagagacgggatctcactatgttgtccaggctggacttgaacatctcagctcaaacgatcctcctgccttggcctccccaaatcttgagattacaggcatcagccaccataccctgtcctgcgctaaattctttgactgacggcagcacttcctatgcactaggcatggattaacttagttgattgtccctcagccctatgacgggagtgtcgtgcctgatgtcattttacagatggtgtattagtcagggttctctagagggacagaactaatgcaatagaaatatatatagagagaggagtttattaagtattaactcatatgatcacaaggtcccacaacaggccgtctgcaggctgaggagcaaggagagccagtccaggttccaaaactgaagaacttggagtctgatgttccagcatccaccatgggagaaagatgtaggccagaagactaggccagtgtctcttttcacatttttctgcctgcttatattctagccacagcggcagctgattagatggtgcccacccaaattgagggtgggtccgccccttccagtccactgactcaaatgttaatctcctttggcaacaccctcacagacacacccaggatcaatactttgtatccttcaatccaatcaagttgacattcagtattaaccgtcacagatatgggtaaactgaggcactgaggatttggacgggggcagccggcagcggaatctgagctgtcctgtagctctgtctgggaagactccagtgagcatcccgctctatcccaagccttgtcttctgaaaatcagaatcatccctcctccaagtgttacaggaaaggggtccggatccagacgccaagacggggttcttggatctcgctccataaagaattcagggctagtctgtaaactgaaaacaagtttattaggaaagtaaaggaataaaagaatggctattccgcagagcagctcttagagctactgcttgcccatttttatggttatttcttagtgatatgctaagcaaggcttggattattcatgcctcccctttttagaccatgcagagttcctgacattgccgtggtatttgtaattgtcatggtgctggtgggagggtaacactgaggacaaccagaggccactctcatcaccatctgggttttggtgggttctggccggcttctttactaccacctgttttatcagctaggtctttatgacctgtatcttgtgcagaccttcagtctcatcctgtgactcagaatgccttaatcatctgggaatgcagcccagtaggtttcagccttctattgcccagcccctattcaagatggagtcgctctggttccagtgcctctgacacaagtagcgccccttagggaggttacaggagggactggaaggaaagtgaggtctggatcagggcccttctgtgtaaataagatgatgtacatgcagcagctgggtatgtcctgggtaaaaattagttaaatgcacagacgaccctgtttcatccccagccatcaccagctggaaatggggcacattcccaagatcccaaaaacattctgcaaggctggtgcgatgattgctatgaagtacttaagaaaacagattattgttcaggatcaatagctaatgcatgtggggcttaatgcctctgtgacgggttgatgggtgcagcaaaccaccatggcacatgtttacctatgtaacaaacctgcacgtcctgcacacgtatcccggaacttaaaataaaataaagaagacagaatattgttaatggttaatatgctgtaaatcattatgatgattactaaattatcaatacaaaagaagataatagcaagacggccatattcctaatagaggttgacattttagcagccctacatttccactgtatttaattagtatttgccgtccaatccagaggggcatgaaggagcacgagacaaaatcaggtcttctaacagctgagaagaagctgagaaccagaagtggaaaccccaaagggcagtgtatgaaatgtcatttattgaggggaaaaaaaagaaaatgacagagttcgatagaagaaataagcactagtgtttacataatcagtagggtgactttagtttacaataatctattgtagacttcaaaatagaagagtcggaatggttctaatatgaaggaaagacaaatatttaaggtggatggatatcccaagtaggctgatttgatctttacaaattatataaatgtattaaattattacatgtaccctgaagctatgtacatctgttatgcatcaattaaaaataaattaaaagaaaaggatatatgtccaggatatacaccagctaagacagtctcttccaagtctattgtacattattcccttatcagatttgaaacctgagagttccctgacgccccctcacaggatgtgcaacaggggtgtgtttgatctgtttgaccgccacacactgaaacctcttatgggaggcagaacttgcagacgggcaggtgcagcagctagtgtgagtgtttttgagctctgggccccacggtagcatctagggatgggtgcctgcgacccccgaagccctagtgggcgttttacggtgctcttttagctctgccatccgcacgtggcttaagtgttagccagctcagtgccgtcttggtacccgggttcttgtccagcatccaggaagaatcaggtcacacgaaccagctgaaggatggtaaatgcagaagagtttgttgccagatggagatgactcttagcgggatggttggggagttggaaaggggatggagtgggcagatgatcttcccctggagtttggttgtcctgcggctaatctcttctccaaccatccccagctgaacacctctcagtgttcagatgttccttctcttctctccttctctgctgtgctgctctttggttcctcaccttttctgctcatctgtctgtctgcacatggggtctggggtttggggttatatgggtacaggacaggcaggcatggtgggtcaaaaggcaacatttgggcacaaaaataggaatgcctgtttccatttaggactacaggtttccaggcttgagggcggggcctttgctggggaactgccctcttgtatctagtatcttcaggcctcctgtccgtatcaacatgacttaaaatgtgtgtgcatttgtatagagctgtgtttctatgtaaagactaaaaaagacttatgaaaaagatcactcagagctctgaacagtagcaaatcatatttctgagtacttcctgttgagtaaaggtaagtgaggattgtgccaagtatttttcattacttgctgcattaggttgtcacaggctgtttagtttacttctaaaaattgggatatggggaagttgtgggccgggcacagtggctcatgtttgtaatcccagcagtttgggaggccgagttgggcagatcacttgaggtcaggagtttgagaccagcctggccaacatggcagaacgctgtttctactaaaaatacaaaaattagccaggcatggtggggggtgtctgtaatcccagctattcaggaggctgagacaggagaatcgcttgaacccaggaggcggaggttgcaatcagctgagatcataccactgcactccagcctgggtgacagagtaagactccatctcaaaaaaaaaaaaaaaaaaaaaaaaaggaaaaaaaagttatgatgatcgcctaaggtgagaagccataccacgccagcgtacagaaccccaaaccacgccagcctcatcctacgtctcagttatatttttcttgacttgcttccattctggtgccccctctctccctgccccctccttccctgcaaaggatctagcaaatttgtaggtgtggaaagggaaccacaaatgggtcatttccctgccattgtcacctggagcgtgtagccatttcgtgcagtgattctctgtctttgatgtgcaggtcatcaccttgaagggaggaggtattaaaagcgccacccagtccccacccactgaggtctttattcagcaggtgtgggtcaggcatttgggagctgggagacctgcattttaagaagcaccccaggtgatgcccaagcggagctatgtgcttcttttaagagatgatgactccgtgtgcaaccgtgtggttacctttgcgtggagtctcatggatcactgccacagtggggaggcagctctgtgctctccaattcggtgatgtgtcattcactctatgcaggcccaaggtgacacccccagatacaggtgctgccatccagccattctcaaccagggatcatgtttatccacagggacacttgtcgatatcttgaggctttgcgttgccacactgatagcagggatgctgctggcatctagtgggtggagcccagggatgctggtcaacaccctgcagtgcacaggacgccccacagaaaagaatgatccaacctcatatgtcagtaggactgaggctgaggaatcttgccttagcatgagagatcctgtctgtctgtctgcctatctctagatctatctatcgtctaccattatccatccacctatctgtctctattatatacacctatcatctacctaatctatctgtcaatgattttctgtcatctattatctatctatttatctatctttctacctacttctctatccaactctcatctctattacctatctatgtatctatgtatctatctatgtatctatctatccatccgtctatcaatctatctatttatctagcagtccatcatctatctgtgacattcttctgctacccagggataattgtgttcctcgagtaacacttggcaatgtctggaaacaattttggtagttgcactgggatgggtgttctcgcattcggtgggtggagacaaggcatgttgttcaacaccttacagtgcacaggacagcacccatgacagagagttacgcagccccaagtgtcattagtgctgtagtggagaacctgctgttagttataacttctaaccctgcgaaaggggacaggttggaaatgtcatgctcctgtacgctgtaggaggtatagttgtctggaggtatagttgtctggaggtatagttgtcctgtacagtataggaggtacggtatagttgtctgggcatttctaaatggatcttactgtcagaatgcacttgtaggatcttttccccatagggcatagagccatggcacatataacccagaagctgagcattccatagtttccttcttggagtaggaaggggctgtgcagaaaaagtctatggctgtttggcacctgagtgtgaagacatctggcaaatattggagccaattagcagacaagcacggagtccaagaaatgtctcccctttcttggataacaactgacccttcctgtgagggcccccctcattccagccattttcctctttctcattggcacacagggggtagaaaagtggggttctgcctgcaggtggggctctgccagacacggcaaagctcctggggattcccccgatggatcaggggccagaggcacctaaacctgtgagcgatgtgtgcagccacggtgctgaggctgggaaactctgctgtagtctgtgaatcccaacctctgggaatgcttcagaatcagattctgggctgatctggaatctgcatgtggctggattctggtctgatccaggcatggaggcgtgtgcctgtaatcccagctactcgggaggctgaggtgagagaactgcttgaacctgggaggcagaggttgcagtgagctgagattgtgccattgcactgcagtgagctgagattgcaccactgcactccagcctgggcaacagagcgagactctgtctcagaaaaaaaaaattaaggaagagtattattgagagcgtaggccaggcgcgtgatgttgctgagatgaaactgtctctctagattcccaaaccctggttatctccactgaaccaggctgtccaatggcatccccattgtaattgaccatgttccatggtttaaatctgttgtgagccaaattgtaccctcctcaattttacaaatggaagtcctaacctgcaggacctccaattgtgactgtgtttggagatggggtctttaaagaggtgattcaggctgggtgcggtggctcatgcctgtaatcccagcactttgggaggctgaggctggcagatcatgaggtcaggagatggagatcatcctggctaacacggtgaaaccccatctctactaaaaatacaaaaaaaaaaaaaaaattagctgggcgtgcctgtagtcccagctacttgggaggctgaggcaggagaatcgcttgaacctgggaggtggaggttgcagtgagccgagatcgcactactgcactccagcctgggcgacagagcgaggctctgtctcaaaaaaaaaaaaaaaaaaaaaagaggtgattcaggcaaaatgaggtcactaggttgggccctgatccaacaggactgcagaccttataaaaagacgagatgaagacacagacatgcacacagggacgatcctgtgaggacttagggaaaagatggcatccacaagccaaggagagaggtctcagtaggaaccagccctgcccacaccttgatctcagacttccagcttccaggcctgtgggagaatcaatgtccactgtttaaacagcctggtctgtgggactttgctatggcagcagccacagtggacaaacacatttgtattccaatgaatgagttacctctgtaagggttgaattgtgcgtctccaaaatttatatattgaaggcctaatccctaggacctcagaacatgactgtgtttggtgatggggtctttaaagaggtgagaagggtacaatgagctcaggaggttgtgccctgatccaataggactggggtccttataaaaagagtagataaggacacagacacacacagagggatgaccctgtaaagacacagggagaagagggtgtctacaagtcaagaagagaggcctcaggaggaaccagctctgcccatgccttgatctcagaattccagcctccaggactgtgggagaataaaagtctgtggtttgtaagccacccagcctatggtattctgtgatagcagcctgcaatggactaagacatctcataagaagagcagatgaggacacagacatgcacatagagggatgaccacgtggggacacagggagaagatggtgtctacaagcccaggacagaggcctcaggaggaaacagccttgcccatatcctgatctcaagacgtccagcctccagggctgtgggagaatcaatgtctgttgcttataagccacccagtctatggtatgctgtgacagcagcctgaaatggactaagacacctcataagaagaggagatgaggacacagacgcacacagagggatgaccacgtggggactcagggagaagacggcatctacaagcccaggagagaggactcaggaggaaccggccctgcccacaccttgatctcagacttccagcttccaggactgtgggagaatcaaggttgttgtttaagctgcccagtctttgggattgcattgtaacaactctgggaagccattaccaagtctctgtcctgcaaagtgagatccatggatctgcagccttgacatcccctgggagctgatgagaaacactgtgtcttgggcccagacagacctgctgaagcatagtctgtgtgtcacccatgtcctgagggatccgtgtgcatgccactctgggaagacgggtttataacacaccgtcaaccagtgcctcattgcatggtctgcggtattttcctcgagttttccttgcaccaaagatgtcttgctttttgtgatgaatgatcattccttcctcttcgacgacaaaatacttcgatctctgcagacaccgtctgttgtgttacagacagacactgaggcctgaattctcattaccaatgtctgctctaatagagcttcaatctgcaactgcataatatggtcactgggaagtcaagaacggggccagttggttgaccttctggggagaggctgggctgcttggatgctgagaccgtggagggttcatgggttccgaggagcagatcatgcaccagggcggcctgctcagctctggtgtctgcagccccggtgagcttgagcattagggagtccctggatattcatgttgaggtgtggaggaggagactccagctgtgtttgatttcctgtcctgctggaaatataaacttcttaaccaattagagaacagaatggatttcatcttatccatggggctaaagtagaattcagcccttggcaaacaagccccccgggaataagattccccattggggcagcagccttccttgtcactttctgttgcaacctacggtcctaacctagtcatatgatttaattttttttactctgtgaatcatgccgtcctgggagagagtgagatggagcaaggacaaccctcttaggggcctgccaggcactctccctagcatggaaataaaggaaaaccttgagttccttcaagggaaattccaggcacctcgctggccttgagaagtacatggagcagcttgataagcaagaaggtgattgtagtgtagaacaatagccaaggaagttagagcctcaatatgtttagtttcctgtaaagactaaagataacatccttttttgagatggagtcttgctctgtcacccaggttgcagtgtagtggtgcaatcttggctcagtgcaacctccagcacctcctgggttcaagtgattctcatgcatcagcctcccaagtagctgggactacaggtgcacaccaccacgcccacatttttgtatttttagtagacacagggcttccccatgttggccagtctggtctggaactcctgacctcaggtaatctgcctgccctggcctcccaaagtgctgggattgcgggtgtgagccaccatgcccagccaagataacatcttactatatggccctgagttgattttcaggaacccagacccccaccaaataaaaaatgccatctgctggctcatagacgttgggtaagagaaactgaggcctgaattctcattacaaatgtttgttctaaattccttccctggggcatgtggcggtgggaggggggtggaaggggggtgaggggacgtgctggaggaagtcacaccaatggccacaactaacattgatttctgctgaccccaaatgctcagacaaacttggcctccttaaccaatgacaaatcagagaaactttgaatccacattaagcccctgcttccaggtatcccgcctttttagatcaaagcaatgtatagcctgcatgtattatggctttgcctgtaacctctgcctccttgccattgaaaaccctcagctactggccacccaggaggttgggtcttgaggcatcaaggaggttgcttgatgccctctaaatagctcggaataaacgcctcacttcctcacgctgcaatcccaatggcggtgttcggctttactgcacagggccggtggacctaagttgagttagtgggaggtgttcgaaccagggcaactccaggttgagtaggggctgtgtaaaatgaggccgagagctgccgggctgcattcccggatggtcaaggcattctaaggcacaggatgagataggaggttgacacaagaaacaagtcataaagaccttgctgatgaaacagcttgccgtaaagaagtcggccaaattttaccaaatccaagatggcgatgagagtgacctcgggtggtcctcacttgtgtcttcccaccagcaccatgacagtttacaaatgccacggcaatgtcaggaagttaccctatatggtctaaaaagaggaggcatgaatgggccactccttgtttagcatatcctcaagaaagaaccatacaaatgggcaaccagtggccctcggggctgctccgtctatggaggagccattctttattcctctgcttttctaataaacttgctttcattttatggactcgccgcaaattctttcttgtgcaaggtccaagaaccctgtcctggggtctgattccagacctctttccggtcacaagttcagtcacaagaaccattatcatatgctttctatatatacacataggtattttttaattgctgaactggagtcaaagagaaaccttaggatttgcctgaaggaagtcaagatttgtccttctcggggtccctgtgccagctttgtaaaacctcggaactttcccctctgtgggcttcctcaagctgaggagggctctatgggcttagtacccactaagtggcttcatctgcagcagctgacccaagaaagttgatttaaatgaacccacacttcagaggaaaccagtacaatccgatgtaaagaaataaaaaataggccgggggcggtggctcatgcctgtaattacagcactttgggaggccgaggcgggtgaatcacttcatgccaggagttcaagaccatcctggccaacatggtgaaaccccgtcattactaaaaacacaaaaattacctgggcgtagtggcatgcacctgtagtcccagctactcaggagactgaggcactagaagcgctcgaaccagggaggcaggggttgtagtgagccgagagtgcgccattgcactgcagcctgggcaacatagtgagattctttatccaaaaaaaaaaaaaaaaaaaaaaaaggctaggcacggcggctcatgcctgtaatctccgcactttgggaggccaaggtgggtggatcacgaggtcaggagtttgagaccagcctggccaacatggtgaaaccccatctctactaaaaataaaaaaaattagttgggcatagtagggggcgcctgtaatcccagctactcaggaggctgaggcaggcgggagaatcaattgaacctggggggcagaggttgcagtgaacagagattgcgccattgcactgcagcctgggcaacatagtgaggttctgtatgagagaaagagagaaagagggagggagggaaggaaggaaggaaggaaggaaggaaggaaggaaggaaacaattgcttgaaagggctttgtttcaccagggcacgcagatcaaaggacattggattgaataatgaaacagaagagcctgtctgaatttactaatgtggttgcacgtcccgtaatgattgcagttggctctaattcagttccgtggtgtataaattctgctggcaatagctgtaattggggtcagggatttagatagtctctgtgtgttccttttcattttctgctcagagcctgctgggagctgattttcttctttaaagcgaggtaaataattcagtggggagcagaggttttgctgtgggtccattgctctcctgtgctgcgtggcagctgtgctggtggcagctaatattcagtgggcagtggcctcgacattgcattattattcgagcaatggtactgttctttgctttgcaaaattgctgtttgttatattgactttctggggtcgtggcccctgaagcattactgaaaatcatggacatgaagcagatttattaactggagaaaagacatacaaatgtatttaatgtgtatacacgggagcattcagaatgaagaccccaagttacaaggggagattgtctatatttatgctttggttcatccaagtctggacagctgtgtagaaatagggttggacaaaaagggcctgatccaatgctaatggcctgagtggggaaacccagccaggcctgtgtgtctagattcttcttggcctctctctctctctttttttttgagacggagtctcactctgttgccaggctggagtgcagtggcacagtcttggctcactgcaatctccacctcccaggttcaagcaattctcctgcctcagcctcctgagtagctgggattacaggcacgcaccaccacgctcagctaagttttgtatttttagtagagacggggtttcaccatgttggccaggatggtctcgatctcttgaccttgtgatctgccctcctcggcctcccaaagtgctgggattacaggcgtgagccaccgcacccggcctcttcttggcctctctgaacagtgctccttccttccgggtatggggctgggagcttctctgggatggggggtcttaggacgcccaaacaaggcaggtcagggaatttccttatggccacttttttttttttttttttttttttcaagacagattcttgctctgtcacccaggctggagtgtactggtgtgaactcggctcactgcaagctccgcctcccgggttcacgccattctcctgcctcagcctcccgagtagctgggactacaggcgcccgccaccacacccggctaatttttttgtatttttactagagacggggtttcaccgtgttagccaggatggtctcgatctcctgacctcgtgatccgcctgcctcggcctcccaaagtgctgggattacaggtgtgagccaccgcgcccagcctgtgccactctttatacagataggatagagggaaagttagattcctgtttttaggttttatggctggcttcggggggaaaggcgttcttgtttctgggacccgtcttggggaagagggattctagttccttcggtgccttaggggagaatgggactcagagacatgggggctggagaagttccgagagaaacttctgcttctgaggctgctgctgaggcctgcacttggcggtattgtttcgtaagcctgaaccacgtgcaggtctgaatcaacataaagaatttgggtgggaggcaggggaactccaataagaagcatctttgaatccggcaggggtggaatttgggtcccagaggggtttggtgactgcaggctacagaagaatgcttcaaagtgctgtatcacatggctttgctccgaagggtcccgagcacagctttaccgggggctcatgtgtaacgctcggcccacccatccaccaacaggagccacttaatcgacatctccaggatgccagcaaccgaggaccgttgtcatagtcccagcacaaaatgaggctgctttcttcttgggggtttagggatcccagaccacaaggatttgattaaaagccgctcagttcactaactataagcaaagcaaatcagaaatagatctcctgttcctgccccgtcttatgttcccagtggaaaataaaccccgtgaaagcaatggcgtcatgtgcaacccgaccttggagacagagaccccagagttagcgttgtctacctgggacatctcccagcccaggggtcttactccagacccgtgaggaccccaggcgtggctttgctgcaacttccctggagaggagagaggacagggggccctgcctgggagatagatttgctgcctggcatgcgggactggagactgtctcagtgcccaggccgtctgatgctggccggagtccgcctggtttatgtaacgaggtctggatgtgaccaacaacggcctcgtgtgtgtgagtcacgcgtgcagcaacttctggctgtagtgcaacccctgaaaccaagcaaagcctaaagcccccaggctccacttcctctgtgaccctccccacccccaattcctgtcatctctcagggtcatccggagcatctcaaagctgaaggagcctccgctgcaacctggcctcctgctgcaggatgagacgagctgtctgcagccctcccgtgccacctgcctgttttatgcaacagcatttcagagaggagggactgggaggggagagacaacaccgaggcctttggttatttagggcaacagcagggagtggccgggtgcacagattggaggagattaagtggttgctgaggggatgcctgggattgctgggatgggcggagacataacacagtgaaagatattggtcaacggcgaacacagattggaatgtaaattctcagggtgtgtgcatagccgggacgcttaactttggcgtcctggacaggtgtctcgactggaactgctggcagccttggaggggagatgttgcacagatccaagaggctgacacggttcctgtcccccagcccagtctgagcagcttggaccatgatgatcaagagcgctggaggaggccaggtgcggtggctcacgcctgtaatcccagcactttgggaggccaaggcaggtgggtcacttgaggtcaggagttcgagaccagcctggccaacatggtgaaaccctgtctctactgaaaatacaaaagttagctgggcgtgatggcatgcacctgtaatcccagttactcagacggctgaggcacaagaatcgtttgaacccaggaggtgggagttgcagtgggctgagattgtgccactgcactccagcctaggcgacagagagagacgccatctaaaaacaaaacaaacaaaaagaaaacaacaataaagaaaaaataagaagagagctggatggagcaaagatttgctgggttgttcttaaaggcgagcctgtagtgatcgctggtaacagagaacgtcatctgagagggacgtgggggctcccagagtttgagagaaacggccgtgtgggatttgacctgtgatggcaccgccagctcccagcctccagtctgggcccaggggcagctgctgtgtgcaccctgggctcagagttccccttccctccaaggtttgtgactttgtcctgacttagggattcctgtctggggatgcgtcttctgctccggagaggccctaattgcctccacaaggagcggcaaagcctgcccgggtggcatctgactggagccatgccacagcctatacgaatctatgttggagcccttgaaccttcccccagagcaagcgtcaccgaggcagaccgatttttgggagggagacagacatcagagcgggggagacccagtacctagggctcacctggttcccccaggcttagcctcctccagggcttagtgtttgagtgagagattgtcccccctggacaattctgtagattctgactctgctcctgccttgccctgaacttcccagaacctcagtttcttcctttgggaaatatgcatgctggtcataccaacatccttgggtgggcagatgagactcttgggtgcctggcattactgcaacagaactcaatgcatagtaagtgctgactcaatgtgctcctggctgcatcctctacttcctgataaattctctggtggtgttttctctacaaggctagtactggcaggggcaagtgaggaacaagatcaaggtgtgcatatatgtcagcaagagggacccttcaccctcacaaattctgcagtgtgtttttaatgatgtgtcccaaagatgtgaatgttctcttctctctgctgcagacacattcattagattaactgcttttggatcaggtaggaacctcagcttgtccacacaggttgcttcctgaccctgtatttgtcagtgtaggctagctgctataacaaacagcccccaaagaattaaaagtttatctcttgtttgtgttgcagccaggtgaggtggcaaaggtgtcctatgctccatatagtctctcaggcatccaggaccctcacattgttgtgcttcaccttcttctagggcagcccctctcaacctagactctgtgcgtgtgtggaggggtggggggggcgttggggggcggggatatgcctgtcctaagctgtgagtgggacagtccaggagagaagtctatgtgcttggagagaggcttccttcaaagtttcctggccatgagcaggaatgaagctctgacacaggttgcaacgtgaacgcaactcaagagcatcatgctcaatgaaagaagccaggcacaaaataccacatattgtagaattctatttataagaaatttgcagaacagacaattcatggagacagaaagtggatagtggttgtcaggggctggggaggcgggaggggaactaactgctgaatggggacaggggtcttcttttgggtgatgagtatgctctgggactaggtggaggtggtggttgcatctcccatgtagctcatggtcaggttagttttagtgctctgggcgaccctaggcttgcaggaggaggggagcagcatgaggtgaggaacaagggggattctggcctttccatcatggggtgacttatgccctgtttgctcccaataggtcaaagagactttgatttggcagatgcccttgatgaccctggtaagtgccgatatttcaaggggagccttcccttttcagcttggatctaacagcatcagctgtatagttactttggggttggattgggccagtgttgggaatttcttggtcttgagatctctgttctttgcaggagattgcagacaccttgagacaaacctttacacactctctaaaagtctcagactcatttcttggtaggtctgtgcttctaaacctgtggtttaggaatatgctagtattttattattttattttactttattttgttgagatgggagtctcgttctgatgcccagactggagtgcagtggtgcaatcatagcttaccacatagcctcgacttcctggctcaagtgatcctcccacctcagcctcccaagtagctggaacaacaggtgtgtgcccccatgccaagctaatttttttcttttttcttttttgtagaaacggattctcactatgttgcccaggctggtcttgaacccctgggctcaagaaatccttctaccttggtttctcaaaacactgggattacagacgtgcctcaacatgcctggcccagtttctgcttttcttacacttcagttcatatccctcattgtcccacaccccgatcccaatccatggcctccaatctccccagtttctgcttttcttacacttcagttcatatccctcattgtcccataccccgatcccaatccatggcctccaatctcccctcccagagcacacttcattccgttctcccctcaacttctctggttaccttcactgacggggctgtgagtttttcttctccagggcactgaggacctggaatcttcccattctgtgttttcatcagtccaagttcagctagaacctttctggctgaccagaatgctgaaaatatgtgtcctgggccctgcagaaagtcctgcttgaggcagatagtctgattgagattcaggtgtattcagaccgcggtgggtgggagaaagggaaagatttggtttctgatgcaggcacaatggaaccaaacatttattttgaaagaaaaataaacttttgtgtacacagaggaagaatccattgggctttagcattgggaacaactggttgaccagtgcagttacataatggtgtttgttggaggaagagagaatgataaccagatctgatcctaaaaagccaacaacaagatgataggaactcatctctctcccagttttctgcacacagtgatgtttttgctaataattatcctaaaaggcagatacaaaattgttgtcagtgcaacaggaaaatgtaatgactcaccccaacatggagatgccatttctcccatgaagttagaaaaggtgaaggttgaatcctaccctgtcaaggcagattgaggggtgggggttagaggcaggtgtgtggttgcaaccactttggaagcattgggggattatctccaaaattcagactgagtgtgttgcaccagcgtttggtctggataaagaatgaggcatatctgcaagagaaccctgtgcaatagtgaaggaggggctggctggtaggctcagatacagaacaagacatgttattgatctgaaagatcactgacatgtgacccaggagttccacttctagacagatacccaagagaattgggagcagggactcaaacagttatttgtgtacccatgtttgcagcagcaatattcacaataagccaaaggtggaaacaacccaactgtccatcaggggatgaatgaatgaacagaatgtggtccctccaggcaacagaatatgatttggctgtaaaaaggaagggggttctgatgcgtgctacatgagccttgaaactgtgctcagtgaaacaagccaggcacaaaaggccacagggtgtaggatcccattaatatgaaatgtccagaataggcaaattcagagagacagaaagtggattagcgattgttgggctggaagaggggacaaaagggagggactgctcgtggctatggggtctccttttggggggatgaaactgttctggaactagatacaggtggtgattgtacaatattgtgaatatatgaaacaccattgaattgcacactttaaaatgtcaaattttatatgtgagtttcacattaattttttaaaaatcacataaataaacttattttccactcacctgctactaccttttcattgctcacctagaaggctgccagtgcctgcaaacacatctttgaatgcatcgttttgctaccaagagccccccatgaatgggcaggcatgtgcctgttcatccacagcccttcctcatgggaaggaagccccagtgcagaggaaccacagtcacctgcatggcgactgtggggaattcacttttcactgtctatactgcctgggctttaagaaactctgtgagtgtatcactattttaaaaaatagttataattttacattttaaaaaggagacagagaaaggaaggatgggagagagggagggagggtgggaggaggaaggaagggaaaaggaagagaagaaagaaaagaaggaaacaatgaaaggacagaggaaaacagggagggagggaggaaaaaggatggaaacaaggagggaagaaaaggaagaagagagggaacgatggagggaaggaaggaagaagaaaggagaggagataagaaaagactgaggggaggaaggaagaaggagaggaatgaaggaggaagggaagaaaggaggggggaaggaaagaaagaaaaataggagaagaaaggaagaaagaaaaagaataagggaaggacggagggaaggaaggagagagggagaggagaaaggttggaggggaggaaggaagaaaggagggtggggaggaaggaaagaagaagggggaaaaggagagagggaaggaaggaaggaaggagagaaggaaggaaggagagaaggaaggaaggagagaaggaaggaaggagagaaggaaggaaggagagaaggaaggaaggagagaaggaaggaaggagagaaggaaggaaggagagaaggaaggaaggagagaaggaaggaaggagcgaaggaaggaaggagagaaggaaggaaggagagaaggaaggaaggagagaaggaaggaaggagagaaggaaggaaggagagaaggaaggaaggagagaaggaaggaaggagcgaaggaaggaaggagcgaaggaaggaaggagagaaggaaggaaggagagaaggaaggaaggagagaaggaaggaaggagagaaggaaggaaggaagaagggagggcaggaagggagagggaggtggcaggaaggagaaaaggtgatgagaaaccttctattaaaatacaggacatgcgaaaccatatgccccgtttggaggttcaagctctccttcttgcagtctctgcatccccagtgaatgtccgcaccacacacaaacccgtgttccagccgcctcctaccaaggcaatgctaggctgttatgtaaaccatgctttcaaatacggtgtttcctctgtttggaagaagtctggccattgcacagccctgaagctccaattttcccagccatggccgactccacctcctttgagccatcttcctcaaacctcctcctgccctcgtctgcccatccacactgcacacccaggttcactaagcagggcagtcacaggctgcaccctgagcactcctgacctgatatccacatccatgcaatacatatttgctgaatgaataaatgaatgaatgaaagaaagtgagataagccatcattctggaagctgcaagtctttctccttcttttcttttgcctccccctgcctcaccctccaccgtccagccctgtggtggctctacgggcaggtggctcacttacttgtcttggatgttctcagctactttggccatcctgtgggcatcctcacagcctcaagggtggattgtttttgaatggattttaagggtgttttcttgtcttttttctcaattcaacatggaatttgtgtctatatcatttactttgtatggctttgtcactcccttttcacctttcatcagggcgttcatggcctttcttcatgcttccaatgaatcttcaatgcatattgcatttattttctctctttgttcacagaacccaccaagaagccaaactcaggtgagtgtctcttcagctgggaaaaactgaggcaacgtccttgaactgatgcttacggaggggatggttgaggatgttttacagaactgtggggtatatgaaagagatgcaacaactgtaccagatagcagatattgaaagcaaaatgtggtgattagggaaatgcaaatcacaaccacagtgaagcaccacttcgtccccactgagatggctaaaatctaaaatggaaaataacaagtgttggcaaggatgtgatgaaactggaatgtttgtacagtgctggtgggagtctaaaatggtacagccactgtgaacaaatgctttggtggatcctccaaaagttaaatacaggattactctatgaaccagcaattccactcctaggtatgtactcaaaataattgaaaacacgggttccaagaaaaatgtgtacacaaatgttcagagcagcactattcattatagctaaaagatagaaataactcacatgttaatcagtggaaggaatggataaacaaaatgtggtccattcacacaatggaatattatttagccttgaagaggaatgaagcactgaaaattgctacaaagtggttgagcctcaaaaacattttgcaaagagaaagaagccagacacaaatgatcacataatgtatatttttatgaagatgaaatttcaagaataggtgaatccctagaaccagaagcaatgtcgtgactgccaggggctggaggggaaagagagagtgactgcttgataaattccaggtttctttttgggggaacgaaagcattctggaagtacacagaggtgatggctgcacaacactgtgaatattctaagtgcccctgaattattcacttttaaatggttaattatatgtaaatttgacttcaatttatttatttattttcaattaaaaaggtaacctttggctgggggcggtggctcacacctgtaatcccagcgctttgaaaggccgaggtgggcagatcatctgaggtcaggggttcgagaccaacctggccaacatggtgaaacctggtctctactaaatataaaaaaattagctgggcatgatggcacatgtctgtaatcccagctactcgggaggctgaggcaagagaatcacttgaacccgggaggtggaggttgcagtgagccgagatcatgccactgcactccaacctgggtgacagagtgagattccgtctcaaaaaaaaaaaaaaaaagaaaagaaaagaaaagaaaaagaaataattcccggggccgggcgcagtggctcacgcctgtaatcccagcactttgggaggccaaggcgggtggatcacaaggtcaggagatcgagaccatcctggctaacacggtatgttgtacctgagcgagttagaaaaacgctttgagacaaattaagagtcctttataagccagcgaccgagagacggctaatgcttaatagtctctcggtcctgaggaaggggcttgattaacttttagatcttggtttaggaaggggagggctgggggtctagtgaaaaccattttacagaagtaaagtaggcaaaaagttaaaaggataaatggttgcaggaaagtaaacagttccaggtgcaggggctttaagactattacaaggtgatagacgcggggctttgggcgttactaatcagacgaattcccgggaactgcggatgtagctcgccacagtatcttatcagttaactgcattcttggatgtgctgggagtcagcctgcacgagttcagtccttgaggaaggggctgccagtgaaagagccaaggtggagtctggctggctctcttagctaagggagagtccattcaggtggaaagaaggctaggtgagtaaaggaaaagggagagtctaaaaacaggttagtaaaaaccaggttgggcattacaggtgaaaccccgtctctactaaaaaatacaaaaaaaatttgccaggcatggtggcgggcgcctgtagtctcagctacttgggaggctgaggcaggagaatggcgtgaacccgggaggcggagcttgcagtgagccgagatctcccactgcactccagcctgggcgacagagcgagactccgtctcaacaacaacaacaacaaaaagaaataactcccagacttccagcagactccttgactgccatgagagatgtcaggaagtcaatggacgggtgtttataggttgttcaggaaatgttcactatcaagcaagaattgaaaatgcagctaaattgctgttggagagtgatgatagcataaagatttccaacaagaagctctgcaaattttgctgaaaaatcttccaaatgatgctctgccataagaagaaattcacaccctgaatagcacagcaggatgcgaatagcaatgccagccaaagacattgcaaacaagccggtaaaactaagtgattgttagctgtttaaaaaaataataataactggtgttaacaacaaagtgaaacttaacttctgaagatgaggctaccttcacagagaggataagaaaggaagaactgagtaaaagtagttagatattgctggattttgacattttaaggttaagtgttcctgctaaaaataaaaattgaacatataactcctgaactagtggatgaaaatgaagaatgaagaataaaattaaatacaaaaaaaatgaagagtaaaattaaataccaaaattagccaagtgttgtggtgaatgcctgtagtcccagctactcaggaggctgaggtgggaggatcacttgagccccagaggtggaggttgcagtgagctgagattgcgccactgcacttccgcctgggtggcagagccaggctttgtctcaaaaataaaaaaaaataataaattaaaaacctgaatactaaatggaagttaagaaggaaggaattaaaaaagaagaaaagtaaaataaaatagtaggaatagtgaatccttagttatgttagatgttcagtgatttaataaatctgtaaaaagacggagatgagatgatgcaatttaaaatgtttcggctgggcgcagtggctcacgcctgtaatcccagcactgtaggaagccgaggcgggtggatcacgaggtcaggagatcgagaccatcctggctaacacggtgaaaccccatctctactaaaaatacaaataaaatgtttcatgctatttacgagagaagcatttgcaacaaaatgccaaagagaaggtgaaaatagctggaaaaaaaatgcgcaaagcaaataaccaatagaaagaaagccaagttgggctagcaaaatcagacaaaataaccttcgaggtgcaaacaactttgaggcccaaatagaggttcttcccactaaaagaatgattccctgaatgataatggaatcttgacccagcctgcacctcaggttaagttaaaagtggaaatttaaagatctaagtgtgagattttaaaaagcatttccccagaaataccaggatctgtagatggaaatgttattaagaataaagatgtggagctgggcgtggtggctcacgcctgtaatcccagaactttgggaggctgagactggctgatttcttgagcccaggagtttgagactagcctggacaacatagtgagaccccatctttacaaaaaaattaaaaaaaattagtggacatggtggcatgcacctctagtcccagttactcaggaggctgaggtgggaggatcacctgtgcccaggctgaggctgcagtgagccatgatcacgccactgcactccagcctgcgtgacagagcaagaccctgtctcaaaagaaaagaaaaaaaaagaagaaagaaatgaaaaccgtagctcagagacagagaaactgagcaatgcataggttcagaagggtttgaaacagactgaattgtgtcttggcatatgagagaggtcgcagctataaaacaatgagagaagaaaccaaattccacataggcaggactgagacaattggctgttcttgtggatgatacgtgatcaaatctcaacctcatgcgatacttttttttttttttttgagatggagtctcgctctgtcacccaggctgcagtgcagtggtgtgatctcacctccccgcaaacttctcctcccgggttcaagtaattctcgtgcctcagctgggactacaggcatgtgccaccacgcctggctaatttttgcatttttttagtagagacggggtttcaccaagttggccaggctggtctcgaactcctgacctcaggtgatctgtccacctcggtgtcccaaagtgctgggattacaggtgtgaaccaccacacccagcctcatgtaatacttaaaaatgaactacaggtggattacaaacctgaatataaaagaaaacttttttttttgaaaaatagagggaaatgtcttataacctcagagttaggaggtttttcttagatacaatacaaaaagcataaccacgcccatagtcccagctactcaggaggctgaggcataagaatcacttgagctcgagaggtggaggttgcagtgagccgagatcctgccattgcactccagctgaggctacagagtgagagtataaaaaaaaaaaaaaaaaagcataacctttaaaaatgggttagcctatgtctacatttaaataataataataataataatgttccaacttcaggctctgaaaaaagtcaaaagatgagctgtcaactagaagaggctccttactgctcataccaccagggaaagtttaatatgcaaaatgcagtcatccttcagaattcatgggggattagttttaagacgccttcttccccgcagacaccaaaatccacagctgctgaagtctctgatataaaacgtgcagtacttgcatataatgcaagtatatgttcctgtatatttttatttatttatttggagacagaatctcactctgttgcccaggctggagtgcagtggcgtgatcttggctcactgtaacctccacctcccgggttcaagagattctcctgactcaacctcccaagtagctgggattacaggtatgcgccaccacccccagctaatttttgtatttttggtagagacgggttttaaccatgttgtccaggctggtttcgaactcctgacctcacataatctgcccaccttggcctcccaaagtgctgggattacagggatgagccaccgtgtccagcctctggtatactttaaattatctctaggttactcataactcctgatacgctgtaaatgctatgcaaatagttgttatactatattattttttatttgtattactttttattggattgctatattttattttttgaaatattttcaatacaagactggttggatctatagatgcagaaattctggttatagagcacaaactgtgtatagatagctcctaccaaaacagacggatggtgaaaaaaagaaaagaaaagaaaagaaaaagaaaatggaggagagagactatgaggcgactaaaagaagagggatatgatcattccattcgctgacaagaaaaattcaaagaagagggaattatgcaattgaccagctgatgtgtgttagaaatgctcagggtcacacatattcattgaaagccaatttaagccactatttaaatttaaaccgatttaaacaattgggcttttttttttttttctaaaaaaaaaaaaaagtcaattaggccaggcgaggtggctcacacctgtcatcccggcactttgggaggccgaggtgggtggatcacaaggtcaggagtttgagaccagcctggccaacatggtgaaaccctgtttctactaaaaatacaaaagttagctgggcatggtggtgtgtgcctgaggctgtgagactgaggcaggagaatcacttgaacccaggaggcggaggttgcagggagcggagatcatgccactgcactccagcttgggcgacagaccaagactctgtctcaaaaaaaaaaaagaagaagtatattggttccgtctggaaaggtggagcacttgaagcaaaggcaggaagactggaagcagggagagggttttcaggtcacaaacaggtgagagacaaaacagttgccttcttttgagtttctgattagcctttccaaaggaggcgatcagatacgaatctgcctcagggagcagaggggggactttgaatagaatgggaggcaggttggccctaagcagttcccagctggacttttccctttagcttagtgacttgggggtcccgagatttatgttcccttcacagtgtatgagtgagagcacttggaaactgagagtggaagtgtcgcaggccaggtctcactaacacaggcccccacaacacctgtttcagtattgactgagtggttaaatattaaaagccagtgctgttatacaaaggctggaatgtaacaaaagcccaccgagagtttttcccaggactttcccgggccttaaagcatgacaaaataatgaatgaattcttaacaggacccatttaggattaaacaagttttactgggggtctgcagaaactccccaggcctccacaaacaagtttattggggctttgaaggaactctgcaaacctcctggatttagcaggagacaacatgagggtaatcaccccggcacctggacccattagattaagtcaatttactgaggctcctgaggaagatcctcaggactcagaccttagttatagattaaaagaagttaatcacttatgtctttagataaatgcacacacatatctccacatagcttggaaggtatataagctctggaaaactataattttgagttagtctggtgataatttccaggccttctccctgtaacaggttgcagaaataaaaactctcttcctccccagttcatcggtgtttcattattgggctgtgagaaatagcaacccagttgggtccgggaacagaaggtttggtgttatcttcatcacaggcactggactgtcggtaaatttattccatgacaattcttcctaggtttcttttttatattacttgcttccatcatggcagacagctacactggcttcttgccatgaaaacgaacttctagtaacaaaacggaaacctttttttttaagtttcaggtttcaaggttttacttctatctgcaaagtgatttttaaccagacaatggcaatctataaacacaccgtgggcagcaaatcagaacaaactgcaaggtcgatagtcacgctgatgagcttgtttctgcagcctgctcctaagggaaggacaattttcttttctaacagtgcaatgttgtttcctccacagatatctacccaaagccaaaaccaccttactacccacagcccgagaatcccgacagcggtggaagtaagaatccgcaggcctgaaactctttctcaatctggtttgatgatgtttgcctttttatttactagcaggtttagcctggttgcatttgaaatatgtgtgtaatagctcccttactgggaatgtagtttctttcctcactggggggagcaagaaagtccaacggacagaaacaatcttattttccctttgctttgacatctagaaaccactaaggtgtacttgtaaccacccaactggttcactttgttggctgcctagacagagctgatttatcaagataggggaactgcaatggagaaagagtaattcacgcagagccggctctaagggaggctagagttttattattaatcattcagtctctggaacatctggggatcagggttgttaaggataagttggcaggtaggggcttgggaagtggggagtgctgaccggtcaggttggaaagggaaccatagggggttgaagtgaggttttcttgctgttttctgttcctgggtggatggcggacctggttgagccagattaccgggctgagtggtgtcagctgatccatccagtgcagaggctgcaaaatatctcaagcaccgatcttaggttttacaatagtgatgttacccccaggagaaacttggggaggttcagactcttgcagccagaggctgcacgagccctaaagtgtaatttctaatcttgtagctaattttttggtcctgcaaaggcagactggttcccaggcaagaagggggtctttttgggaaaggggcattcttaattttgtttcagagtgaaaccacgaactgaattcgttcccaaggctagtttggctcacacccaggaaagaacaaggacagcttaaaggttagaagcaagatggagttggttaggtctgacctctttcactgtcatcatttcctcagtcataatttttgcaaaggccgtttgatactcaaaggacactttgcattatcatcacagaaagctaatcaggctgagagacaagtcctttctctcacttgttttcagtgctccaaatacctttggcttaaccattcccaaacccccacgtgtgctgtgcactttatgtgttttagagttggtttctccattttttctaacatttggcagacagtttttttccacagatttattacactcatcattgaaaaatatgcaattcaaaaaagaaagagagtgaacgagagagagaagagtggggaggggggtgggcatggagagagaaagagaaagagaaaagaaaggggaaagaagaaaggaaaagatagattctggccattaaagttatcagcagttcaacaaccttaaaaacttaaatgtttgccaggcagagcagcgtgaagctggctaaatcaagaggggttctggaagcttcctggtagtttgctctggctttaaactttcacagcttaacagcgtgtccattcattgcagacacgcacatccagatggacagaaattatctcctcttacaaggaatcattaaaaacagagaccaagacccaagggaggtgacacccacttgaaaaactacacctcaggccgggcgtgggggctcacgcctggaatcccagcactttgggaggccgaggcgggcagatcacctgaagtcaggagctcgagaccagcctggccaacatggcgaaaccctgtctctaccaaaaatacaaaaattagctgggcatggtggcatgcgcctataatcccagctacttgggaggctaagacacgagaattacttgaatccaggagaggaaggttacagtgagccaagattgtgccactgcactccagccggggaacagaatgagattctgtctcgaaaaaccaaaccaaaccaaaccaaaccaaacaaaacaaaaccccaaaacaccacctcacccttaactgcattagttaagccagctagtctttcttttttccccctctttcatgatgaaaatcccaaataccacccacctttttctcctgctatttcctcctagtcttttaaaaaccattgtcctgcggatcatggctatgttgcaaggcactcatgggaattccacagggaacgtgtttcttgctgaaacatacttgggaaacgcccagttaaacagactgccgtgggcttccctcccagagaattcatcaggacttaaaatgtgtggctgggcatggtgggtcacgtctgtaatcccagtactttggtagaccgaggctggtggatcacctgaggtcaggagttcaaggccagcctggccaacatggtgaaaccccatctctactaaaaatacaaaaattagtcgtggcctgtagtcccagcaactcgagaggctgaggcataagaatcgcttgaacctgggaggcagaggttgtagcaagctgagatggcgccactgcactccaggctgggcaacagagcgagactccgtctcaaaaaaaaaaaaaaaaagaataagaaaaaaaaaacttaaaatgcgagatcctttaagatgggccatcttcagagtgtgaacactcagcccctcccacagcaaagtgattcatgaaccccaataggaggaggagtgggggaagagaggctcaggctggggaggtgaccccccatgactcaagcctcaatctcctgatgcttgtcccaacaaagaggaggcttcctttccgactttggtttttcatgttgtgcttaaatccagccacactgatgcctttaacatggcagtcctgaattattaatcaatactgtgtgaatccaaaatatctgagacaggtctcaatcagtttacaaagtttattttgccaaggttaaggacgtgcccgtgacacagcctcaggaggtcctgatgacaagtgctcaaagttgtcaggacacagcttggttttacacattttagggagacaggagatatcaatcaatatgtataagaagtacattggtttgatctggaaatgcgggacaactggaagcaggggcttccaggtcacaggaagatacgagacaactagttgcattcttctaagtccttgatcggccttttactgaaaactcaatttacatgtgagacagggcaaaggaatagtacttatgcctcagtctggcccagtgaatctgcatttttcatcaacaatagggcagaggaagcaatcagacatgcatttgtctcaggggagcagaggggatgactttctgtcccacacctgtgaagatgagctgttggtgtacattgccagggtgaaattccacagaactgttttagggtaaacaaaacagtttactttcctcagattgtgaggacagtatgtagcttttaaaaaacttaaaaaaatttttttgtagctatcttatttagaaagaaaatgggaggcagatctgactaactttttttttccagcttgacttttcccttggcttaatgattttggggtcccaagatttattttcctttcacaattgaacatcagaacatggagtatttaacacaggaaatgagcaaatttaacgtacacacccaaggaaaaggaaaaatgaagctggttggaagttaattatggatagtgtggtatatgagcagaaattccccttaaccagtgttcttgcccaggctagcccaaatgagcccaggctagcctagattcccaagtgtgtatcttgagaacgaggaagagccctagaaaacaatgtgtaacgtccctccaagatggggtgttctggaacaatccctcagacaacgaaggcaattgttgatgggcaacattgggaagaccccagagatggaatgtcctaggcctttccatgttctctttctcattctccctccattgacttgataggtggctgggggatttataagtatttaccacacaccagccagctttctccggatggctccaggcatgcttggagcccagtggtctctttcccttagaatttgatctggaggaacccaaaattctctctgtgtcctttgaaattcagcacatttttcttggcttccatgagctcctgtggcatttctcaggccaactgttgactctgcttcctatgtctgtgcttgtccctttgagagatgtcagcgttgctcaccgattcttttctctgaccccagcagctcctatccatgttgtctttttttttttttttttcagacagagtctcactgtattgctcaggctggagtgcaatggcacgatggcatgatcttggctcactgcaacctccgcctcctgggttcaagcaattctcctgccttagcctcccgagtaactgggattacaggcgtgcaacaccacacctggctaatttttgtacttttagcagagacagggtttcaccatgttggccaggctggtctcaaactcctgacctcaggtgatctgcccaccttggcctcccaaaatgctgggattacaggtgtgagccactgtgcctgtcctcatgttgtcttgaaagtaacaagacaggcacggattctttttgatgcaagctgttatgggatgaattatgtctccccgcaaattcataggatgaagtcctaacccccagtttcctcagaatgtgactgtctttggagatggggcctttaagaaggagattaatgtaaaatgaggtcactagggtgggtccggatccaataggactagtatcctaataagaagagatgaggacttagacacacacagaggaaagattatatgaagacacagggagaagacggcatctacaagcccaggagagaggccttaggaggaaccagcccagaccatatcttgatctcacactcccagcctccaggactgtgggagaatcaatgtctgttgtttataagccacccagtctatggtgttctgtgacagcaacctgaaatggactaagacacctcataagaaggggagatgaggacgcagacacacacagagggacaatcctgtgaggacacagggagaagatggcatctgcaagcccaggagagaggcctcaggaggaatcagcccagcccacacctggatctcagacttccagcctccaggactgtgggagaatcaatgtctgttgtttataagccacccagtctttggtattctgtgatagcagcctgaaatggactaagacatctcataagaagaggagatgaggacacagacacacacagagggacgaccctgtgaggacacagggagaagatggtgtctacaagccaaggagagaggcctcaggagtaagcccaggaatcaatgcagttggaggttctgtgtgtgaatggaggagggaagctcacagatgaaggcgttttgagggaggactgaccttacagtgaggtacccagagacttcctgaaccaagccacgaatatgcagctcgtgctccgggcagtgccttctggcctggaaaccaaagctcccttgtgtccagtccccactcctctgtttggcccccaagtttccataatcccccacagttgtatcattttagagacctcaaaagagagtctaggctgggcgtggtggctcatgcctgtaatcccagccctttcagaggccgacgtgggtggatcacctgaagtcaggatttcaagaccagcctggccaacatggtgaaaccctgtctctactaaaaatacaaaaattagctgggcatggtggtgtatacctgtaatcccagctacttgggaggctggggccagagaatcgcttgaacccaggaggcggaggttgcagggagccgagattgtgccactgcactccagcctgggcaacaacagcaaaactccttctcaaaaaaaaaaaaaaaaaaagagagtctaggcagggcatggtggtccatgcctgtagtcctagctatactcaggaggctgaggtaggaggatcacttgagcccaggaggtggaggctgcagtgagctatgattcaccactgcactccagcctgggcaacagagcaacaccctgtctcaagagagagagaaagggaaagagagagagactattttgagaagtgaaaaaccagtcattctcagcccagatttccagtgttctgagacgtctgtcctgaggaaggactttgagaacagcatccttgccttttttgtgaattaaagtaatttcactcttgagccaatgtggataagcacttgacaggtactggcagtgccaggtaccaggaatatagaatgggtacagaaaataaagtttctagtccagcgacaaaaaggtgctgaagatacagactcatgtcgtgcaaagagcttgcactgattatttcatttcggcttcttgaatagggtcaaaggacatttaagctgagacaggagggacgagctaattaatgcttttccagatgacaaatggattcttcaaatatttagggagagtgtaaagtgatggacagggaacaggaggggtcatgacagaaggaatgccacctgcaaaagtcctggggcagggctgggcacggtggctcatgcgtgtaatcccaacactttgggaggccaaggtgggcagatcacctgaggtcagaagttcgagaccagcctgggcaacatagtgaaatcccatctctactaaaaatacaaaaattggccaggcgtggtggcacacacctgtaatctcagctactcgggaggctgaggcaggagaattgtttgaacccaggaggcagaggttgccgtgagctgagatcacaccactgcactccagcctgggcgacaaaagcgaaactccgtcttaaaaaaaaaagtcctagggcagaaagctcatggtaaacttgaggaacatgcaaaagtcattgcaaaaagttttaagaaattcaaatgaagccaggctcagtgtggctaatgcctatgatgattccagctctttgggaaggcaagacaggacgattgcttaagaacaggaatttgagaccaacctgggcaacatagcaagaccttgtctctacacaaattttaaaaattagccaactatggtggtatgcacctgtagactgagctacatgggtggctgaggtgggaggattgtttgagcctaggaactcgaggctgcggggagctatgattgcaccactgcactgcagcctgggcaacagagcaagactctgtctcaaaacaacaacaacacaaattcaaatgaaacggtgtaactcaagcaagatggaaatacaacacactatcaaaaggtcagatgtttcatcctaacatttatagaagtgactgacttctgtaaatggtgctggcatctgtagtagccctaaacagggaaaggtcaacaacgcactttctgccctgttaatttcagagagccctggacttcttgcgaaagcaccagtggtgtaagtttttgttttttcattgtaagctctgaggtggtattatgaatattgtctacatgattaataagctccgtaaaagcaatgggcagtaacatcttttctgtactttggcattcttatttatagatggtatctacctgaaagatgtcattatttttctgaaatcatactgttgttttccaacagatatctacccaaggccaaagccacgccctcaaccccagcctggcaattccggcaacagtggaggtaatgagtatttatttatttatttttattttattttattttattttattttactattttatttgattctatgttattttactttattttaccattttatttgattctatgttattttactttattttatttgattctatgttattttactattttattttattatttattttggagacagggtctcgctctgttgccctggccagagtgaagtgatgtaattgcagccttgaactcctgggctcaagcaatcttcctccctcagcctttcaagtagttaggactacagatgtgtaccacctacattgcaccacctatatttcaccacctatattggctatatttcaaattttttgcagagacaggatcttgctgtgttgttcaggctattcttgaactcccggcctcaagcaatcctctgcctcagcctcccaaaatgctgggattacaggcaccagctattgtggcccagcctgataatcagtattaaagtccattttagaagtgtttggggccaggcacagtggctcatgcctgtaatcccagcactttgggaagccgaggtgggcggatcacttgaggtcaggagtttgacaccagcctgagcaatatgatgaaaccctgtctctactaaaaatacaaaaattcgccgggcgtggtggtacatgcctgtaatccagctactcaggaggatgaagcaggagaatcgcttgaacccgcaaagcggaggctgctgtgagttgagatcacgccacagcactccagcctgggagacagagcgagcccctgtctcaaaaggaaaaaaaaaaaaaaaaagaagtgcttcacgcctgtaatcccagcactttgggaggccgaggtctcctcaggcagatcacctgaggtcaggagtttgaaaccagcggccaacatggtgaacccctgtttctactaaaaatacaaaattagctgggcagagtgacgcgtgcctgtaatcccagctactggggaggctgaggcaggagaatcgcttgaacccaggaggcggaggttgccttgagccaagattgtgccaatgcacaatctatctaggtgatagagtgagactctgtctcaaaaaaaggcgggggggtggttggatacaagtattatttaatgacttaaaaattctcatctccatggtgaaagaccaattgcttttgaaatgcacagacattgttttgcgaggagttcagttctactatccaccagcacctggggattacatttagttgatagtaaataaatttaaatgtttttgatgacattgactgaaaaataccatgcacactaagacatttcaagttatgatggaggaaggcaattttttcttgtttttttttttgttggtctgtgttctactcacttattcttccctctgcaagagttatctgcggccactttgcctgtgttcctacagcacttcccatctccgccttggcaattgtgtctcacgaacgtgagacactcaggaaagagatgctggtctgtaaagttggaagagtctcagcgattccattggtggggcaaatgtgtgcagattgaggaagctaagatacactgggtgtcttcctctctccacctgctttaaccattgggagttcccctgattgtgattgtttcaggacgttgcttggatgttgtcatattcctagggttcaaggcactccgtgaaatccaaggaaacaagctttgggtatgtcccagtgccttttcccttgggtcttgcaactgaagaattgtgtttcttccctagaaaaacgaacacacttttgcccactcacccacctcctgcaagtctccaaaaccacagcgttgtatcctagactatgttcccccaggaggtggttcctccctctgcattcccgtactccatactgcttgatatgttcttacatgcaacaccgtgcaattgtgtttagttgattcctgtgaattagaatgagaactctacatgggcatggatttttgcctttcattcactgctgcattccctagtctggaaagctgtgcctggcacacaatgagtcctaggtgaaggtcagtgaagtcattaatgcttgagtcccaacaggcaaacagctggattcatgaatgaaagacttaccgctacatcccttcatcagggtgtatagcttcaactccatttcctggaaagctctacaatagttcttcctcctcaaaaggctctggtcttgtgattcatagcattcgtccaccaagacatgaacaagggatctttatgtcagaggttccctgttcaaagctgttttagaggccaggcgtggtggctcattcaggtaatcccagcactttgggaggccgaagtgggaagaccacttgaggtcaggagttcgagaccagcctggccaacatggtgaaaccccatctccattaaaatacaaaaattagccaggcatggtggcatgtacctgtaatcacaactacttgagaggctgaggcaggagaatcacttgaacctgggaggcggagttcagttggagttgcagtgagccgagatcatgccattgcactccagcctgggtgacagaacgagactccatctcaaaaacagtaaaaataaaaaagctgttttaggaaacatcccttttttattattttttctttgagtcagggacttgcttggttgcctaggctgaaatgcagtggcgggatcacagctcactgcagcctccacctcctgggctcaagcaatcctccgactttagcctcctgaatagctgggactacagacacacagcactccacctggctaattttttcttttttctttttctttttctttctttttctttttctttgtgtgtgtgtgtgtgtgtgtgtgtatgtgtgtgtgttgggacagggtttccctctgttgcccaggctggtcacaaactcctggccttaagtgaccctcctgccttgacctctcaaagtgctgggattacagatgtgagccactgagcccagccctaggaaacagcctcttaagccaagtgcaatgactcttgaactccccagagcctctgtgcatgctacctcgacttcagcttcacagatgtatgcaactgcgggatcaggttaggggcactcacttaccggcagtcccaaagctctggagagtctgtgctgagggaatggtccatgttaaagcaaagcagaacaaccactctgccttttgtattttatacttgttttttttttgaaacagggtctctctgtgtcactcaggctggaatgcagtggtgtgatcatagctaactgcagcctccagttcctgggctcaagtgatcctcctggcagatgggactacaggcgcacaccaccaagcccagataattttttgtatttttttgtagagacagggggtctcactatgttgcccagactggtctccaactcctggcctcaagcaatcctcccgcctccacctcccaaagtgctgggttgcacccggcttgcatttcacacgtttaataaactcaatcagcatgtttcctaccccctagagtgacaatggtgcacattagcatggatttcttatagatcgagaccaaagacctaattacttatctatagaccaatcttggagaggaaaggcagactccaagggttaattcggggtccaggaaccacagaaggaaggtctccttggatctcgtttgagcctgaagtagctcagtctatgacagacaccatcagagggcagaggcacaggtgaacgcagcagtcggaactttgtcagagcagcaaaggacatcttaggaaatgaggcttgcaaagcagccttgggttattgagaaagctctctcagcgtggattctcagggctctgggatcttctctgccttgcaggtgcctctttgttttttgggaggaagcaggtgggtctcatgtgtcagggcagtaaggagcaggaatgaatggatgaaacaaatctgttggggtgggtagcggctgtgctctggggagccaagagagagacagggggatggtgctggtttcagacaagatagttgagcaggaacttgaaagagaaaaggagagtggatcgtggggacctgagaagctggaattctccctggggaatcggccactgccaacgtgagggctggggttaggagcatgcctatggtgatggagaagcctgggggaggtgcctggttgatggggcaagaggagccatctggagagaaggaaaagcctggagtctccttccgggcttgcttaaggactagggaggggcaggacatgagatgatgttggaggattctgagcaggggatgggcctaggtgggaggtggggcagaaggagagctggacgaggacatggtgagaggtgatgttggctcatccaggaaggacggccaggaggaagcagagggaaaggggcatgcaaaggtccagaggcaggagcaacggggaacatccagggaaggagggaagggcaggggatttggagatggggcaccctgagagagggatccaggcagcaggcagacacgacagcctgagcttcaccccagctcacggttggccctgggagggctttgagcagaagaggggcaaacatcagcaatatgaggccacactgcagacgttctgggccctgcacacgcctccttgcaggcaaggcggccagcccacaaggtaatttaattcctggtgcctgtgggcgtcctgcaaagagccagttggcgtcggaacgctcttctccaaaacctgtgccagtgcccccagcgcagacctggtgtgaaggggacctttggagaggtctcatgagcaatgccgcgtgctctgccccacaggttacttcaatgatgtggaccgtgatgacggacgctacccgcccaggcccaggccacggccgcctgcaggtaggtgccgagcctccccagatgcgacacattgaatttgcacagagagggtgggatgagaggcctgaagttggggatgagagagctgaggttggggcagagttggtgacgagcagacgataagctggtgcaggggatgacagagaaggccccatggccgcatcagtggggtttgcggtctgggcatctgtccgcctctccaggctgggggactggatggaaacaaaatgaacaggcagaactggagggtccactgaaacacttgcggtcatttctgtttagacttgtatatgtgtaagtgtgggtgtacatgtccagacacacctttatatatctgcatgcttatcaatcttcatttgtgtgtatatagatgtttatgtatctttatatttgtgtgtatatatgcttttaaatatatataaatgcatctacatatgtaggtatatggtttttttcatgtgtgtatatacatgcttttgtatatatacagtacgtggatacctttctctgtttttatatatgtatatcctgactttatatatatccttatatatatctttacataggtacatgttttatatgtgtatatatatctttatatttatatgcagatatatgctttttatatatatttatgtatatgtatatcgtttaatatatctttttaaaaatatatcttcatgtatatctttaaatacatatacattttatatacattttaatattttatgtgtatgttatataaatatatatctttacatatataattaaatatatgcctttatttatatacatctttatatatgtacatatatacctttacatgtatgtgcctttatttatatatgtatatatttatatatacacttttatatatacatatgtgtatatctttatatgtgtgtataaatgcctttatatacgtacacatatacctttatgtgtatatacttttatatgtgttatgtatgtacacacaactttatatatacatgtgtatatatctttatataggtatataaatgtctttaaatatgtatatacatatcttttgtatttatttatttttttttgagacggagtctcgctctgtcgcccaggctggagagcagtggcacaattttggctcactgcaacctctgcctcccgggttcaagtgatgttctgcctcagcctcctgagtagctgggattacaggcgcctgccagcacgcctggctaacttttgtatttttagtagagacggggtttcaccattttggccaggctggtcctgaactcctgacctcgtgatccacctgcctcagcctctcaaagcgttgggattacaggcgtgagccactgtacctggtctatatgtatatcttctaatgtatctttatatatatctttaatatatctttatatacatgtacattttatatacatttttatattttatgtatgttatataaatatatacatttatacatatataattatatacctttatttatatatctttatatgtacatatatacctatatatgcttttatatatgtatgtgtacatttatatatacacttttatatatgcatatgtatatgtctttatgtgtataaatatcttcataaatatatttatatatctatacataacctttatatatgtataaatatcttatataaatatatattttatgtgtatatatgcattatttgtataaacacatatttgtaaatgtctttccatatatatgcatatatagcttacatatgtttctatactgttatatataggtgtatacctttacatatgtatgcatactgttttatatatgtgtatataggtcccttcatgtatatatgtatatacatttaggtatatgtgtgtgtgtgtgtgtgtgtatatatatatacacctttatatatgtacatttatctttatacacacagacatatataaacacttctaatataaagttttctctgtaattggaggtgaatgtctatcaataatctttcatatagaaatacaagtacagactataggagacagagatgcatacaacattgggctgaagagtgtgatgtttgaggctttattttcaagcatgtgaggtttctggcctgtttagttctgcaattttattttagaagacataaaggacttgtcccagatattttgcaaagctggacctgcatctttcggacaaccagattgcatccagtcatcttttctgccgtgtttacttgcaataaataaagagcgctgtcttaggatttattacaataacaatcaggaataaactaaaaattactagttatttttgaaaggagaagctgagaacatttacgattgagaccatctgctggaaggtcctcctaatccggcgtcggcgtggctgatctcatatcagtttctcggcaggaagcgggtgcgcctgcgtgaatttggagtccccagggtaaatgttagtcccgtgacggcaaagtgtttttgatagctagagctcagtgttggcatgagttttcccacggggaagaggaagctttggtggggccacccttgactctcccctgctggtcactctttggagctctcttggcagtgacacgttcacacgacttgttgccattcccaatgagctggacagaccaacacctgcaggaaaccccacgctcagacacctgaacatccctcaactctaccttctctgtctaacaggaggtggcggcggtggctactccagttatggcaactccgacaacacgcacggtacccctacatctgggcatgcgatggtgggtggagggtgggaggggtcatctttctagggctcccgcttgcactctgccctgggccttctacctggagtctttggtgagtagggtgctgtgtgctggtgcctggtcttctgagaacctgtctgtgctgggctgttctgcttctgttccccaggagggtgggtgcagccacacatacacacacgcatacacacatgcacacacacacacacacacacacccctttaggtaaaagtaaacagagcaaagaactatacaactaattagagaaagagagcatccaacaaactggagagcatccaacaaattctttaggggcgcagctcgcttacttcaagcagaatagaaaacactttcaatggctgggcgcggtggctcatgcctgtaatcccagcactttgggaggctgaggtgggaggattgcttgagcccaggagtttgagaccagcctggacaacatggaaaaaccctgtctctacaaaaaatacatatatgcaaaaattagccaggcgtggtggcatgtgcctgtagttccagctactcaggaggcagaggtaggaggatcacttgagcccaggaggtcgaggcttcagtgagcagacagagataagatcgtgccactgcactccagcttgggtgacagactgagatcctgtctcaaagaaaaagaaaagaaaagaaaagaaaaaaagcaagagaactcttttggtcggtgcttatgcccagagtgaaagccgtgttctacagaagccataaacaggctcttggcttggttgagtttttctcatggagaccaggggaccttgaaaccctcagatcctctccggtttggaaaacgactgaagcaaaatgtcatcactgagaaagaaaacaataacaaaacactctgtaggttgattttaaaccatcatctccgttttaacattttccctttgttaagagttttgtacaccttcaatgaattgagtaaccatcttttcttttttttttttttttttttgagacagagtttcacttgttgcccaggctggagtgcagtggtgtgatctctgctcactgcaaccttggcctcccgggttcaagtgattctcctgcctcagcctcccaagtagctgggattacaagcatgtgccactacacagggctaatttttgtttttttagtagagacagggtttcaccatgttggtcagattggtcttgaactcttgacctcaggtgatccatctgcctcagcctcccaaagtgctgggattacaggcatgagccactacacctggctaatttttgtatttttagtacagatggggtttcaccttgttggtcaggctggtcttgaactcctgacctcaggtgatccgccctcttcagcctcccatagtgctgggattacagacgtgagccaccatgcccggccttgagtaaccatctttttggttaaaactaatatgtgccaagagctctggtaatgtgggaagtacttttttttctttttctttctttttttttttttaagatatggtctcattaggctttgtgagagccaaggctgttggccccctaagttttctctgaatcactgacatgaggcagcttaattaacaggagaaaaagcgtataaatttattgagtggatatacacgcaaaccttcagaaccaagactcaaccaccaatgggatgcaaaagcttatagaccatcttttttaactttgatgttaggttcaggggtccttgtgtagggttgttacataggtaaattgtttgtcaccggggtttggtgtacacattatgtcatcacccaggcaataagcatagtacctgataggtagtttttccatcctcactctactcccaccctctgccctcaagtaggccctggtgtctggtgttcccttctttgtgtccatgttgtcaatcgagaaaaatgacgagacgagcgtaaaagatttatttgccaaagttaaggttaagggcgcgccccaggagacaggtctgtggccttctccgaagatgattttgaaggctgcaaatttaaaggggaaagggtgggggtagggaaaaagagttattcatgcttttgtctggctcagtgaatctgtgtttttttacataagatggcatagacaaatggggcagagggaaaatgcagggaatctgcatgttgcataagataatctggacaaaatggggcaggggagcaatcacatatgatttgtgtctgctgggcgggggtgactgcaaagctgtcgatttgcatattgtcatggtgaaatcttcacagctcactaggattttccttgtgggcaaaatatgggggagacgtgtagcttttcatcttgtagccattttatttaggaaccaaaagggggaggcaggtttgtgtgacccagttcccagcttgacttttccctttgactaaatgagttcaggatcacaaaatttaatttcctttcacaatgcgtactccgtgtttagctcccacttgtaaatgagaacacatggtatttggttttctgttcctgcattagtttgctcaggagaatggccaccagctcgatccatgttgctgcaaaggacatgatcttgttcttttttatggctgtgtatatgggccacattgtatatgggccacatttcccttatccagtctaccattgatgggaacctaggctgattccatgtctttactatttgagtttgctatttgttgttctttgcaggaagaatgtgggctcagagcatggccccaaataggtgacgttggtaaagcaggtttaacgggtggcaagccaggtgatgagagggagacaggaagaggcctgcttagcaagggggtccttgttatgcagatgaaggttcccaggtagcagcgctcagagacgaccatggtaaatgtttcttttcagacctgtaaaggtgtcagagtctccgtttctctctcctacatccaggaaaagcttagaaagggaaggcctggctgcaacagcaaagatcctctacagatgccaatttccccacctcagtctgctggccctggagcggcaatttcaaaataaggcaaagcaatatattttggagtaaaatattttgatgtccgtcatcttcgttacctcggaagcgagtgttgtcatcagatccatttaacaaaatgaaagcaatgcatgacgctcgactgtccacttcaaaggagcaatagctgtggccctataggtagcccatcctcagaactcactccctatgacacagacaagcttcaggatgggagggggctcatgacaaagtgctcattacctggggtcaagaactgtctacttttggccgggcatggtggcccacgcctgtaatcccagcactttaggaggccaaggtgggtggatcccttgagttcaggagttcaagaccagcctgggcaaaatagtgaaaccctgtctctacaagaaaatacaaaaattagctgggcatggaagtgtgcgcctgtggtcccagctactcgggaggtgtaagtgaccctggaagtttgaggctgcagtgaaccgtgatagcaccactaccttccagcctgggccatggagtgagaccctgtctcaaaaaaaaaaaaaaaaaaaaaaaggacactaaaaaagaattgaccaccttcaactcaacgtactatgagatgagttccttccaccatctttctggaactagctaaggggttccccttacctactacctaggtagacctgatttattaagacgggaatcgcaatagagaaagagtttaattcacacagagctgactgaacgggagcatgtgaagcagctatgctgtctggggtacatacctggggttcattgttgcacgctgagaaagaattcaggacacagacacatgtggttgggttaaggagttgaaagtttaatagaagaaaggagagaggagagcagctccttgcaagagagagagggagagagagaaagagagagagagaaagagaagcatctgaaaaagttgggaggttgtggaccgcagcagcttttgtaggcaggctggaggaggtggtgtctgatttacatagggcttacagactggttcgatcaggtatgacttctacatagtgcgtggggaaggctggtggccccaccctaattttgttatgtaaatgggctttccagttggtcagtgccatcttgtctgctacttactgtacatggggctgacaaagaggagggaagatgaagctgccatcttgaacgtgtctaggccctagttcctgccggcattcacccatgtaagctcctagctggcttgtctatgtctgcagctcaactttattttttattttttatttttttttgagacggagtctcgctctgtcgcccaggctggagtgcagtggcgtcatctcggctcactgcaagctccgcctcccgggttcacgccattctcctgcctcagcctcccgagtagctgggactacaggcgcccgccaccacgcctggcaattttttctatttttagtagagacggggtttcaccgtgttagccaggatgatctcgatctcctgacctcgtgatccgcccgcctcggcctcccaaagtgctgggattacaggcgtgagccaccgcgcccggccacagctcaactttacaggctgctctttgttagaaaatgatttggggctgcttttcattaaaaagaaaagccttaccaaggactcccatacccttgctatgtgcctaagtaattaactaattccttcttaactcctatatcaactggaggttttgcttttttttctttaaacagggtttcattttgttacccaggctggactgcagtggtgaaatcatagctcactgcagcctcaacctcttgggctcaagcgatcctcccgcctcagcctcctgtgtagctaggaccacaggtgtatgccaccacacctgcctaatttttaaaaaatttttgtagagatggggtctcactatattgctcaggctggtcttcaactcctggcctcaagtgtttctccgacctcagcctcccaaagagctgggattacgggcatgagccactgcacctagccaagactggagttttatgactcaaatcagcttcccccaaaatttggacactgggctttttaacgtgtaatttggctggtaggagacccgggcgtggggagtgctgagtggttggttggaggtggaatgacagaggacggacatgggttctttttgttgtcttctgttcttgtgtgggacggcagagctcgctgagccgcattaccagtctgggtggcgccggctggtgcatctcaatgaagggtttaaaaaatgtctcaacttcaaccttaggttttacaatagtgatgccatccctaggagcaactgaagaggtttggaatcttgtggcctccggctgcatggctcctaacctattaatataatttctaatcttgtgactaatttgttagtctttcaaaggcagtctgatccccggggaagaagggagtttgtttcagaaaagggctgttatctttgtttgaatgttaagctggaacttcctcctatggttatctgagtctgtgttcaggaatgaactagggctgttcgagggctacaggcacgatgcagtcggttaggtcagatctctttcactgtcgtaattttctcactgttataatttttgcaaaggcggtttcaatttaactgaaaatgtcaggcaaagaccaaatttaatatttttacagaaagccactgggagtagttttttattgttttattatttatttatttagagacagagtctcactctgttgcccaggctggagtgcagtggtgcaatcatagctcactgcagcctcaaactcctgggctcaagcgatcctcccacctcagcctcccgaggagctggggctacaggcacacaccatcatacccagctaaatttttaagaaattttttgtagagatggggtctcaccgttgtaactgcccaatgggtttaccttgccccctgcctaaacagggccgatttatcaagacagaggaattgtaatggagaaagagtaattcatgcagagccagctgtgcccgagaccagagttttattattactcaaatcagtctccccaggcattcagggtccagagtttttaaagataatttggcgggtaggggcttgggaagtggggagggctgattggtcaggttgcagagggaaccataggggggtgaagtgaggttttcttgctgttttctgttcctgggtggatggcggaactggttgagccagattaccgggctggctggtgtcagctgatccatccagtgcagaggctgcaaaatgtctcaaacaccgcgcttacgttttacaatagtgatgttacccccaggagcaatttgcagaggttcagactcttgagccagaggctgcacgacccctaaaccataatttttcttttcttttcttctttttttgtttttttcgagacagagtatcactctgttgcccaggcttgagtgcagtggtgtgatctcggctcactgcatcctctgcctccctggttcaagcaattctcctgcctcagcctccccagtaactgggactacgggcacatgtcaccatgcccggctaattttcatatttttaccagagacggggtttcaccatattgttccggccggtctcgaactcctgacctgaggcgatccaccctcatcggcctcccaaagtgctgggattataggcttgagccactgcgcccagccctaaactataatttttaatcttgtagctaatttgttagtcctacaaagtccaactggtccccaggcaagaaggaggtgttttcaggaaaaggctgtgatcagttttgtttcagagtgaaaccatgaactgaattccttcccaaagttagttgggcctatgcccaggaatgaacaaggacagcttaagggttagaagcaagatagagtcggttaggtctggcctctttcactgtcatcatttcctcagttacaatttttgcaaaggtggtttcgccacgttgcccaggctggtcttgaactgggctcaagcgatcctcctaccttggcctccataagtgctgggattacaggcctgcaccaccacatccggcccaccttggagcgtgttatataaagcgagccgtccccacacccctacagcctacgaatgagccttttcaccccatgcacgattctctgaaactgctctctgtaaggagctattcgggacacgttcttttgttctctggcatactcatcaggtagaaagaagtgattcagcaagcggctcccctgagagccctgatcgtttcctgttttcctgtgaagttagtctcgggaggtctgcgctgtgccatttttgggggaccattatctggctcccgaatggatcaaagcttactggtcagggggctgctgtatccctggggcaaaactgccagaaaatagcaggtagccctgtggtccttggcagggccagggcccggtggaagcagcagctgggccaagaacatcaggcgtgcatgaggcacagcccagttttgggagcatgacgcttgttttcgaggatgcctgtgctccccttcctgcctggacccctgctctccagccccggcagagcgaggctgtgagtcagcgctcggattagcatcagcatggaggtgccggctgggatgcaagccgccgccatgggatgagtcacgcggcttctccccgaatccccaaaggaggcagagcgtgttaggcttgttctggcttcatgcagagcactgaggggtgagggctgaccgtggctggccgcggagggaagcccaaagtctggcctccctgcggagactggggagaaaatgttgcgctcgtcgtttttaaatactgggggacaagtttcccttgtctgctaaggctgccattgtaaattacaagagtcaggagggctgaagcaaaagggatttcttctcccacagtcctggaggctggaagtctgagatcaaggtgtgagcagggctggttcctcctgaagcctctctccttggctcgtcgacatcatcatctccctgtgtcctcacagggtcgtccctctgtgtgtgtctgtgttccaatctcctctccttatgaggtgtcttagtccatttcaggctgctatcacagaatactatagactgggtggcttagaaacagcagacattgattctctcaccgtcctagaggctggaggtccaagatcaaggtgtgagcagggctggttcctcctgaggcctccctccttggcttgtagacaccatcttctccctgtgtcctcacagggtcgtccctctgtgtgtgtctgtgtcctcatctcctcttcttataaggtctgtagtcctattggattagggcccaccctagtgatctcgttttattttaatcacctctctaaggacgttgtgttcaaatacagtcacagtctgatgccctgggggttaggactgcgacctgtgaatttggagggggatatagttcagcccatagaacccactatccacataagtcattccacttcaaaatcagcacaaagcattagttttaaaaatctcaaatctgtatttttaaaaattgctcttaacacattagaaaaatatagaaaaactttttttgctgtttttctgagacaaaatctcactctgtagcccagcctggagtgcagggacgtgatcatagatcattgcagcctccacctcctgggctcaagcaatcttttgcctcagtcgtctcccaagtagtagctgagactacaggtgcacatcaccacacccagctattttttttttttaagtagaaacggggtctcactatgtttctcaggctgggctccaaatgagctcaagtggtcttaccgccttagcctcccaaagtggtaggattacaggtgggagccaccacacccaacctggaggaactctttttttttaaaattttaaataaattactatttgtggcctgcgttttcatcctattctctttttttttaaccaacatttgctggcatttttttttatgccgaagaaaacacctttgcccatctatgtcaggcctccagaccctcagggatgtacatctaatgcaccttcagccaccggtgtaaacagtaaacaggggccagatggcgcctgtgcaccttccctggccttgggagagcattggaatctctgcagcttttaagagcatcttgcttcaggtttgctgacctgcttgcttctgtaagatcatgcagacttcctgagcaatatctagcatttcatggtctcttttctatcctgcaggaagagggggctatagactcaactctcgttatggaaatacttatggtaaaggaattatgtcttacagaatatgtgaggcaaaactgtccatttgcaaataactaacacactgtctgcactgatgggaagctgatgctttcatccagtgcacaaccaactggccgttcgagtctctcatttgcattttccttggtcatccatgctggggggagatgttgtgcatgccctgaggacttcatttcttcaaaggaactatggcccacttacaggtgttactgggtgcatgtgtgtgcacgtgtgtgtgtatacatatgtgttcacacacaggtatgcttgtgtgtattgtgtgtgcatgcatgtgtacatgtgcatgtggattttgtaatcatgtgcataagtgcatgtggatttcatgtgcatgtgtgcaagtgtctgtgcacacatgtggattgagcacatgcatgtttgtgtatgtgcacagatgtgttggcatgtacttgtggattttgcatgtgtgcatgcttgtgcttgggttgcatgtgcattgcatgtttcccatgtgtgtccattcacatgcatacatttaggggtgtgcaagcacatgtgtgcatgtggatagatgcaggagtgtgcatctgggtgtgctcgtgtggtatgtgcatactgcacgaatatatcatgtgcatctgtgcatgtggattgtgtgtatacatgcgtgtgtacaggcatgcacacacacacatgaatgtgtttgtgtgtgcatatttgtgtgtacatgcatgtgtttatgcatacaggtgtaaacatgtgcacacatcggtgtgtgcatgtgcacacatgtgtacatgtgtatgtttaggcgaattgtgctttatatgtgcttttgttgcctgtgtgtgtggtatgtgcatgtgtgtgtatgtggggatgtgtgggatgtgcatgtgtgtggatgtgcacattgcattgtgcttctgtgttgcatttgtatttacatgttgcacatgtgtgtaaatgcatgtgtgtgtgcacgtgtgtatgcgtgcttgtctgcctgtgtgttgcacgtttgttgcatgctgcatgtgtgtatgcatgtgcacacacatttgtgcatgtcagtgtgtgttgcatgtgcttgtgtatgaatggcgtgcgtgtgtgcatgtgtgtccatggggttgtcagcctgtgtgtgttttgcatgcgcatgtatgtagactctccaatcctgaaattaaagctgcatctccctctccctggtattatccccattctgctaatgaccattagacatggcatacacattcacattcctcctccttatgctgcttggctgtccccctccccccacaagaatgtaaattccctgaaaacagggatctgtgtgctgtgttcacagtcgcatcctcaacagtgcccggcaatataaggccctccataagctctgctgaataaacacgaacatccttttccgcttacaggtggagatcaccattcaacgtatggcaatccagaaggtaactgattgactcacccggtcccaacctttaataagagcacactctcctagatcagtgctgggaggagctgtgtgggcttctgtttcccaacctcatgactttcacggagcactcatactttgtatgtatataaagtagctcctgaataaaaatatctgaccttcagcacaggaccaatcagagttcagagaaaggagaggcaagcattggttttcactgcagaagatgccccttagctctcaaagcaaggctgtgaatgagtgctgagactattacatttctcccagtaccaccattactcccctttctttgaccagcactaacttgaaacccaagaaggacaggagaaaggaaggtatgaacactctgcccaaagaagccatcagagtgcactgtcaatcccgtctcaggtcaaaggagggagaacttgaagcccagaaggctgactttgtgtcctgtattgttgggagaacaggttccccattccctaagggtcatattcttagagatttgggctgacacctgcttgagtttaagttgagagtaaacgcactcaaccccaaggctcttgtgagttttcaattatgggggaggagaaagtgattgaaggtgacctctacctttcaatgatcatgcagagtactagtatcaatatttttggggtatgttggcatccttagaaaaatttatggtttcacctttttccctctgtggtgtaaagtgaggtccagagatggaaagggcaaggcaaataaacaagtaattgcagtcaaatctgatgaataatttcctggaacatatgggatcctgtagcaaggcagaagggatactcctagactaggttaggtgagggaggtagggtttcctggagagaacaatatccaagccaatcccccaaaatatgggtgggaggtgcccaggagaagagtgaggtgtcagggaagatggtgcactaggtagagctggatacacacgtggggacaccggaaattgtgtagccaggatgtggaatgcaacgggaaccagggaaggatgcaatggtgaccaggaaagacctccaggttagcagaggtggagtctgcacttcatagaaccttcatgggaaggagcctgcccctgttgatatgtaggtgaagaatggacctgagggggctcactaagacccagggagacaccctttcagaccagttcagtactccctggaaatgatgacaggctgaattaaagcctgggcaaaggaggcaaagagaagcagtcagcttggatgaccacttggtaatgacaattgattgtacttgattgatttgtaagagatgagagagaggaaaaggtatgtatcagtcagctatgctgtgtcacaaaaaaccccaaaacttagtagctggaaataacaaccatttattatgttcgtgattatgtgagtcagcaatttgggctgacaccattctagtggtcctcctggtctcttctgaactccctctcttgtgtgcagtcaactgtaggtgtggccagcgctttgaccatgtttcctgggtcttcttatgtatctgggactttaggtggaatggctcatctcagcttcatgtgggctctcacatccctccaggaagccaggccaggcttcatcacatggtgaccagacagggtaccaagagcatgaagagaagcgtgcctgggcttagagccaccatgccttcacttgtgtgacattctgttggctaaagcctggattttcagaatgaagatgcagctccacctctggatggggaacactgtgaaatcatactgtggagcgtgttcatgtagggaggggaagaatagagggctgtctctcccaggaggcagggtgtggcgggcggcagcatcagccgtagagcaggttcttgcgttcagtgacaacactcttccccccagcatggcagcctcattcgtggagcagtcttgtgtccctcacctatgccatgccatgtattggcccaggtgttcaaccctgtctgaagaaagccatgcatggaaagggtggctatttcaaatggaaacggtgatttcttccttttttccctttggaagtgttgatttttgtcacatcaagctccttcttgttctttgtgcaggagtgccaaagctctggagcaatttgccatcgaggcattgaggatgcttgtgtctagtgtgtgcttgggtctagagttccagcatgcctttgaaagcaagcctatctggcagtttttagtggaacaatatttttgcatgagtgggcattctacatctaaaaaggcacaaaatagttttgacatgtgcctgtcatcccaactactcaggaggcggaggcaggaggatcacttgagcccaggagttcaggacgagcttaggcggcatagtgagaccccatctctaaaaaaataaatcaggccaggcgcggtggctcccctctgtaatcccaacactttgggaggctgaggcgagtggatcacctgaggtcaagagttcgagaccagcctggccaacatggtgaaaccccatctctactaaaaatgcaaaaattagttgggcatggtggcatacacctgtagtcccagctattcgggaggctgaggcaggagaatcgcttgaacccgggagaaggaggttgcagtgaactgagatcacgccactgtattccagactgggcgacagagcaacattccgtctcaaaaaataataagaaataaataaataaataaataaataaaattaattaaaaggcatacatgaattgacttcaacaaacaaacaaaaatgccaagtgcctcgtctgtgcaaatcctggccttggatgtcttcagtggtaaaatgtggttgacaagcttggctctttgtgaaaacagaattacttcctaaggtttttttttctttttttttaaattaagtttctcttttttttctgtgaatacaagggtgggaagggacgtgatggagaagttactagatagatgcaaaagttattgcagtttttgtcattactttcaatggcaaaaaccgcaataacttttggaccaacctaatatttaagcagttttcctgcagccatgtttttttctcggatgagcttgctttttctccactcctgcaggcaatatggtagcaaaaatcgtgtctcccatcgtatccgtggtggtggtgacactgctgggagcagcagccagttatttcaaactaaacaataggagaaattgtttcaggacccatggtaagtttggctctaaacattgttttgcttgttactaagcctgatttaaaaaaaaaaattactttcagatgtctgtcactagcaaggttatttctggttaagttcaatatacataacttgcctaataatgtgattttttaaaatttatttttattctttttgagacagagttacactgtgttgcccaggctggactgcagtggcaggacctcggctcactgcaacctctacctcctgggttcaagagattctcttgcctcagcctcccgaacagctgggactacaggcatgcaccaccacgcctggctaatttttgtatttttagtagagatggggtttcaccatgttggccaggctggtcttgaactcctgacctcaagtgagctgcccgccttggcctcccaaagttctgagattacaggcgtgagccaccgtgcctggccaacaattgggttttcatggtcaggtgtgagctgtaccttcctctaaaccttgttacaatgaggctggcacattatctgtctaatgtaaaagaggaggagaaaaaaaggaaagaaaaagaaacaaacaaacaaaaattaccaacctacattgcaagactataagcatgacggttggtttaactacctgttctgttttgtattcagtgaaattttcgtcacaggcgagtcaggaaaaatacctgggttgaatgtgaatgttttgcccagaaccccacccgcaaagaaaactaccgaaacactgaattataagcctctctgaaattccgaaggtgcgctcagaccataggggagaggaaagatctgctgtggcttcctggttcaatgccggctccacactcctgggtttgaagaatcacttgggatttgagagcagaggatgccctaaagaaatctctgaaacaacagtcagggattgttttatagcctaaagagtgactcagatctttaactgggtgtctctggaggcttggtttaaacctcaggccacccacgtcagaatctgtctggagtttgcccagggccctctaactcataccttctttgtgtccccgaaggaaaccagaaaggggtgcccattcctacggtgtttgctttaggatttgcatttggcctcaaaaatcctaaaaccttcccatgcgctccctctgctggtgaatgggcagtatcaaccgttagctaatgaacctccgtttggggtgagcctccgtctacattacgccccgtcctgaaattttaggaggaaactgagtttctgaaaaactgccttattttcctggcaacctgagagcagattcttgggttcagtgacaacactctttcacccaacatggcagccatcattaacgaacaccacgtgttaacttcagtagcttttgtggcagtgatttgtaagcctttgttaaccaagggctgaaactgagtaagcagagagaggcacccatctccacaagcacaaaatgtaagggcggggtacaggggtcccccacaaactcaataatcaaggcaaatatattttagtgcaatattttagaaggaaaatcattggaatgggggccagttgagtttctgaaataggtgtagttttaaaaacgtggatgatgcctgccccatttatctgaggtggaaggaagcacgtttttgctaaagaggtataatgtcttgaagctctttcatgccttttggctgcctggtaagtatttttgtctactttctccattgtacttcgatgataccctcaccaggtattcccaagcaccaagtttatcttcccctcccttaaagttcctgagatcagaaaggaggatgtagacagagtgagctgatgttagggagatctcttcaagggtgagcagtgacatttatgtggatcctgggcctatatcacctcgctggctgtaaagcctttatactatctaggaaatatgtgcatgacagcaaatacgtatgggtttggtatcaaatggggctcagagctctgcgaacttgactctaaagttccaggctgctgctaatggtacccagctgtccacctctccttagttaggtcattaattttctctgtctcctaaaggatgacgtacatggtatactaaccatatccatggtgatgtggtgcagtgcacaacctgtggaactgtgtacctgctgaggccatacactgaagcttgcacactttgtagagaaagagttgtagtaacagagctacacagatagaagcagatgtctgtcacttgatgtggacttttaagaatcatactttgcttttattttataaagtggagcaaatgacaacatcacttcagaagttataaagaccaacaaggccatattcgaaaaaagaagttcctacaaatattagttttaaccaaaaaggaagttactcaattcatttaagatcatcaaaatccttaacaaatggcaaaatgtcaaaaacaatgttttcaaaacgaatatttgtttccagatatgattttaacagtttttaaatattttctatttttaatttttcctgctttattgaggtatagttgacaaataaacattgtatatatttaagatgtacaacttcatttctgcatcatttatttgttctaatctatctccttctgccgaatgtaaagcaggtgtcatgtagacagcacatagtctgatcttggttttcttttttttaaaatagatttttcattcttctagctttattaaagtatgatagacaaacattgtatatatttaagatgtgcaacttcatttctgcttcatttttttctgttctaatcttccttctcctaaatctagagcaagagtctcttgtaacagcatagaattggatcttggttttctttttctctgtttaataagacttttttttttgcccccacaatgacatttgtttctaatcttcctttcagaaccagaaaatgtctgaagatgttaagatcccctgattactttgagaaaaacaactaaaacaagaaccgtgtttatcactgttgtggagatttccttttattcttgacacaatttgatgacctaaagtgtgttttcttctgtgtaaagtacatgagctgcctcactaagcattccca

SEQ ID NO: 2915 - DNA, 63877 bp, human
tgtgcctacactggtcccacaggttttcagctgtggagtttgggatctgagcttggagcccatttgtttctggcagttccgctcatattttccacttgaagacatcgcctcccttccttccaagctgggagaccagaagtcaacaacaggagggtggagaggccgggtctcacaatccgcttggctggggagtccactgaggttcttgcatcctgaagcaaaccatggagagctggtggggacttccctgtcttgcgttcctgtgttttctaatgcacgcccgaggtaagaggcattttgctttgagggagatctgcctgggcatggatttttctattcttgctttaagaaactctttccaaaggagttgctatgaagtgaatggggataatttgcccaatgggattagaaaggagactaagagcgatgggtggctgagaggggagggagaagacgggctgctcccatttggaatctgggaattagatccagaagggcaggatgttagctgataccatctagatattcgccatattttcctgttttgatccatgtgtcccaagcgtttaaaaaatgacctatttaactccatgattcaagcatgactgggtgtgtgtggaatgtcagtcatttctttctgattttaaaaattagttctgaccatttccatacagtaaaagtagagttgaaactacttcatcccgtggggcagattaccagagattcgtttgccggaagggttgcatttattcagatttttaaatcttttcctaaacactgtcattcattcttgcaaattaaaaccacctgaattgttcacatcaaaaacttcgatataaacttgcaggctggctgtcccagatccaagattagatttttcagttccgtacgaggacctctttaagaaactccaatgaactcataaagtacaggatttgaacaacggttgagtaagtttctttggtcattttcatgtggcgatttcagagaagggaacacctgggcgcatcttaagagagagaagtatttctgttaggagttaaaacacatcattcagatgtccctgtggcagcatttcctgtttatcctatttaaagacatggacgtcattaagattggagttggttgtttatgggcggaggcggtgtcgggatggatagatcctggtggacatagtctaggatctgcagtgagaattttttattattctgtgctgtcttcagatctcacctagtaagtggacaatgtggccatgcattcattagcttctgtttacagggagatgttcaacagtaaacccacctccccagaaaagtacttccaggagtttgtatcattcacagtaagagccaaaggttaaccatatccccttgggcaaatcaacttctacaaagtgcggatacagacagttcccaacttaccatggtttgacatgatggttcaatttaagatttttcaactttacaacggtgtaaaattggtatgcattcagtacaaacgaaaactgtactttgagtacccatacaacttttcttttttttttttgagatgtcgtgtcgtttcattctgttgcccaggctggagtgcagtgacacaatctgagctcactgcaacctccacctcctacgttcaagcaattctcctgcctcagcatctcaagtagctgggattataggtgcccaccaccacacccagctaatttttctatttttagtagagactgggtttcaccatgttggccaggctggtcttgaatcttgacctctggtgatccaccggcctcccaaagtgctgggattataaatgtgagccaccatgcccggccccatacagccattctgtttttcactttcagtacaatgttcaataaattatgtgaggtatgcaacacctcattataaagttgactgtgtgctagatgatttgtccatccgttggctgatgaaaagtgttctgagcactctgaaggcaggtaaggctaagctatggcgtttggtagggtagttgtattaaatgcacttacaacataaaatattttcttttttttaatgtgttttaatttttttgagggaggggcccactgtgtcacctagactggagtgcggtggttccatcatagctcactgcagtcttcaccccaggggttcgaacaaacctcccacctcagcctccagagtagctgggactacaggcatttgccgctgtgcctgactagtttttaaaactttttgtagagacgggatctcactatgttgtccaggctggacttgaacatctcagctcaaacgatcctcctgccttggcctccccaaatcttgagattacaggcatcagccaccataccctgtcctgcgctaaattctttgactgacggcagcacttcctatgcactaggcatggattaacttagttgattgtccctcagccctatgacgggagtgtcgtgcctgatgtcattttacagatggtgtattagtcagggttctctagagggacagaactaatgcaatagaaatatatatagagagaggagtttattaagtattaactcatatgatcacaaggtcccacaacaggccgtctgcaggctgaggagcaaggagagccagtccaggttccaaaactgaagaacttggagtctgatgttccagcatccaccatgggagaaagatgtaggccagaagactaggccagtgtctcttttcacatttttctgcctgcttatattctagccacagcggcagctgattagatggtgcccacccaaattgagggtgggtccgccccttccagtccactgactcaaatgttaatctcctttggcaacaccctcacagacacacccaggatcaatactttgtatccttcaatccaatcaagttgacattcagtattaaccgtcacagatatgggtaaactgaggcactgaggatttggacgggggcagccggcagcggaatctgagctgtcctgtagctctgtctgggaagactccagtgagcatcccgctctatcccaagccttgtcttctgaaaatcagaatcatccctcctccaagtgttacaggaaaggggtccggatccagacgccaagacggggttcttggatctcgctccataaagaattcagggctagtctgtaaactgaaaacaagtttattaggaaagtaaaggaataaaagaatggctattccgcagagcagctcttagagctactgcttgcccatttttatggttatttcttagtgatatgctaagcaaggcttggattattcatgcctcccctttttagaccatgcagagttcctgacattgccgtggtatttgtaattgtcatggtgctggtgggagggtaacactgaggacaaccagaggccactctcatcaccatctgggttttggtgggttctggccggcttctttactaccacctgttttatcagctaggtctttatgacctgtatcttgtgcagaccttcagtctcatcctgtgactcagaatgccttaatcatctgggaatgcagcccagtaggtttcagccttctattgcccagcccctattcaagatggagtcgctctggttccagtgcctctgacacaagtagcgccccttagggaggttacaggagggactggaaggaaagtgaggtctggatcagggcccttctgtgtaaataagatgatgtacatgcagcagctgggtatgtcctgggtaaaaattagttaaatgcacagacgaccctgtttcatccccagccatcaccagctggaaatggggcacattcccaagatcccaaaaacattctgcaaggctggtgcgatgattgctatgaagtacttaagaaaacagattattgttcaggatcaatagctaatgcatgtggggcttaatgcctctgtgacgggttgatgggtgcagcaaaccaccatggcacatgtttacctatgtaacaaacctgcacgtcctgcacacgtatcccggaacttaaaataaaataaagaagacagaatattgttaatggttaatatgctgtaaatcattatgatgattactaaattatcaatacaaaagaagataatagcaagacggccatattcctaatagaggttgacattttagcagccctacatttccactgtatttaattagtatttgccgtccaatccagaggggcatgaaggagcacgagacaaaatcaggtcttctaacagctgagaagaagctgagaaccagaagtggaaaccccaaagggcagtgtatgaaatgtcatttattgaggggaaaaaaaagaaaatgacagagttcgatagaagaaataagcactagtgtttacataatcagtagggtgactttagtttacaataatctattgtagacttcaaaatagaagagtcggaatggttctaatatgaaggaaagacaaatatttaaggtggatggatatcccaagtaggctgatttgatctttacaaattatataaatgtattaaattattacatgtaccctgaagctatgtacatctgttatgcatcaattaaaaataaattaaaagaaaaggatatatgtccaggatatacaccagctaagacagtctcttccaagtctattgtacattattcccttatcagatttgaaacctgagagttccctgacgccccctcacaggatgtgcaacaggggtgtgtttgatctgtttgaccgccacacactgaaacctcttatgggaggcagaacttgcagacgggcaggtgcagcagctagtgtgagtgtttttgagctctgggccccacggtagcatctagggatgggtgcctgcgacccccgaagccctagtgggcgttttacggtgctcttttagctctgccatccgcacgtggcttaagtgttagccagctcagtgccgtcttggtacccgggttcttgtccagcatccaggaagaatcaggtcacacgaaccagctgaaggatggtaaatgcagaagagtttgttgccagatggagatgactcttagcgggatggttggggagttggaaaggggatggagtgggcagatgatcttcccctggagtttggttgtcctgcggctaatctcttctccaaccatccccagctgaacacctctcagtgttcagatgttccttctcttctctccttctctgctgtgctgctctttggttcctcaccttttctgctcatctgtctgtctgcacatggggtctggggtttggggttatatgggtacaggacaggcaggcatggtgggtcaaaaggcaacatttgggcacaaaaataggaatgcctgtttccatttaggactacaggtttccaggcttgagggcggggcctttgctggggaactgccctcttgtatctagtatcttcaggcctcctgtccgtatcaacatgacttaaaatgtgtgtgcatttgtatagagctgtgtttctatgtaaagactaaaaaagacttatgaaaaagatcactcagagctctgaacagtagcaaatcatatttctgagtacttcctgttgagtaaaggtaagtgaggattgtgccaagtatttttcattacttgctgcattaggttgtcacaggctgtttagtttacttctaaaaattgggatatggggaagttgtgggccgggcacagtggctcatgtttgtaatcccagcagtttgggaggccgagttgggcagatcacttgaggtcaggagtttgagaccagcctggccaacatggcagaacgctgtttctactaaaaatacaaaaattagccaggcatggtggggggtgtctgtaatcccagctattcaggaggctgagacaggagaatcgcttgaacccaggaggcggaggttgcaatcagctgagatcataccactgcactccagcctgggtgacagagtaagactccatctcaaaaaaaaaaaaaaaaaaaaaaaaaggaaaaaaaagttatgatgatcgcctaaggtgagaagccataccacgccagcgtacagaaccccaaaccacgccagcctcatcctacgtctcagttatatttttcttgacttgcttccattctggtgccccctctctccctgccccctccttccctgcaaaggatctagcaaatttgtaggtgtggaaagggaaccacaaatgggtcatttccctgccattgtcacctggagcgtgtagccatttcgtgcagtgattctctgtctttgatgtgcaggtcatcaccttgaagggaggaggtattaaaagcgccacccagtccccacccactgaggtctttattcagcaggtgtgggtcaggcatttgggagctgggagacctgcattttaagaagcaccccaggtgatgcccaagcggagctatgtgcttcttttaagagatgatgactccgtgtgcaaccgtgtggttacctttgcgtggagtctcatggatcactgccacagtggggaggcagctctgtgctctccaattcggtgatgtgtcattcactctatgcaggcccaaggtgacacccccagatacaggtgctgccatccagccattctcaaccagggatcatgtttatccacagggacacttgtcgatatcttgaggctttgcgttgccacactgatagcagggatgctgctggcatctagtgggtggagcccagggatgctggtcaacaccctgcagtgcacaggacgccccacagaaaagaatgatccaacctcatatgtcagtaggactgaggctgaggaatcttgccttagcatgagagatcctgtctgtctgtctgcctatctctagatctatctatcgtctaccattatccatccacctatctgtctctattatatacacctatcatctacctaatctatctgtcaatgattttctgtcatctattatctatctatttatctatctttctacctacttctctatccaactctcatctctattacctatctatgtatctatgtatctatctatgtatctatctatccatccgtctatcaatctatctatttatctagcagtccatcatctatctgtgacattcttctgctacccagggataattgtgttcctcgagtaacacttggcaatgtctggaaacaattttggtagttgcactgggatgggtgttctcgcattcggtgggtggagacaaggcatgttgttcaacaccttacagtgcacaggacagcacccatgacagagagttacgcagccccaagtgtcattagtgctgtagtggagaacctgctgttagttataacttctaaccctgcgaaaggggacaggttggaaatgtcatgctcctgtacgctgtaggaggtatagttgtctggaggtatagttgtctggaggtatagttgtcctgtacagtataggaggtacggtatagttgtctgggcatttctaaatggatcttactgtcagaatgcacttgtaggatcttttccccatagggcatagagccatggcacatataacccagaagctgagcattccatagtttccttcttggagtaggaaggggctgtgcagaaaaagtctatggctgtttggcacctgagtgtgaagacatctggcaaatattggagccaattagcagacaagcacggagtccaagaaatgtctcccctttcttggataacaactgacccttcctgtgagggcccccctcattccagccattttcctctttctcattggcacacagggggtagaaaagtggggttctgcctgcaggtggggctctgccagacacggcaaagctcctggggattcccccgatggatcaggggccagaggcacctaaacctgtgagcgatgtgtgcagccacggtgctgaggctgggaaactctgctgtagtctgtgaatcccaacctctgggaatgcttcagaatcagattctgggctgatctggaatctgcatgtggctggattctggtctgatccaggcatggaggcgtgtgcctgtaatcccagctactcgggaggctgaggtgagagaactgcttgaacctgggaggcagaggttgcagtgagctgagattgtgccattgcactgcagtgagctgagattgcaccactgcactccagcctgggcaacagagcgagactctgtctcagaaaaaaaaaattaaggaagagtattattgagagcgtaggccaggcgcgtgatgttgctgagatgaaactgtctctctagattcccaaaccctggttatctccactgaaccaggctgtccaatggcatccccattgtaattgaccatgttccatggtttaaatctgttgtgagccaaattgtaccctcctcaattttacaaatggaagtcctaacctgcaggacctccaattgtgactgtgtttggagatggggtctttaaagaggtgattcaggctgggtgcggtggctcatgcctgtaatcccagcactttgggaggctgaggctggcagatcatgaggtcaggagatggagatcatcctggctaacacggtgaaaccccatctctactaaaaatacaaaaaaaaaaaaaaaattagctgggcgtgcctgtagtcccagctacttgggaggctgaggcaggagaatcgcttgaacctgggaggtggaggttgcagtgagccgagatcgcactactgcactccagcctgggcgacagagcgaggctctgtctcaaaaaaaaaaaaaaaaaaaaaagaggtgattcaggcaaaatgaggtcactaggttgggccctgatccaacaggactgcagaccttataaaaagacgagatgaagacacagacatgcacacagggacgatcctgtgaggacttagggaaaagatggcatccacaagccaaggagagaggtctcagtaggaaccagccctgcccacaccttgatctcagacttccagcttccaggcctgtgggagaatcaatgtccactgtttaaacagcctggtctgtgggactttgctatggcagcagccacagtggacaaacacatttgtattccaatgaatgagttacctctgtaagggttgaattgtgcgtctccaaaatttatatattgaaggcctaatccctaggacctcagaacatgactgtgtttggtgatggggtctttaaagaggtgagaagggtacaatgagctcaggaggttgtgccctgatccaataggactggggtccttataaaaagagtagataaggacacagacacacacagagggatgaccctgtaaagacacagggagaagagggtgtctacaagtcaagaagagaggcctcaggaggaaccagctctgcccatgccttgatctcagaattccagcctccaggactgtgggagaataaaagtctgtggtttgtaagccacccagcctatggtattctgtgatagcagcctgcaatggactaagacatctcataagaagagcagatgaggacacagacatgcacatagagggatgaccacgtggggacacagggagaagatggtgtctacaagcccaggacagaggcctcaggaggaaacagccttgcccatatcctgatctcaagacgtccagcctccagggctgtgggagaatcaatgtctgttgcttataagccacccagtctatggtatgctgtgacagcagcctgaaatggactaagacacctcataagaagaggagatgaggacacagacgcacacagagggatgaccacgtggggactcagggagaagacggcatctacaagcccaggagagaggactcaggaggaaccggccctgcccacaccttgatctcagacttccagcttccaggactgtgggagaatcaaggttgttgtttaagctgcccagtctttgggattgcattgtaacaactctgggaagccattaccaagtctctgtcctgcaaagtgagatccatggatctgcagccttgacatcccctgggagctgatgagaaacactgtgtcttgggcccagacagacctgctgaagcatagtctgtgtgtcacccatgtcctgagggatccgtgtgcatgccactctgggaagacgggtttataacacaccgtcaaccagtgcctcattgcatggtctgcggtattttcctcgagttttccttgcaccaaagatgtcttgctttttgtgatgaatgatcattccttcctcttcgacgacaaaatacttcgatctctgcagacaccgtctgttgtgttacagacagacactgaggcctgaattctcattaccaatgtctgctctaatagagcttcaatctgcaactgcataatatggtcactgggaagtcaagaacggggccagttggttgaccttctggggagaggctgggctgcttggatgctgagaccgtggagggttcatgggttccgaggagcagatcatgcaccagggcggcctgctcagctctggtgtctgcagccccggtgagcttgagcattagggagtccctggatattcatgttgaggtgtggaggaggagactccagctgtgtttgatttcctgtcctgctggaaatataaacttcttaaccaattagagaacagaatggatttcatcttatccatggggctaaagtagaattcagcccttggcaaacaagccccccgggaataagattccccattggggcagcagccttccttgtcactttctgttgcaacctacggtcctaacctagtcatatgatttaattttttttactctgtgaatcatgccgtcctgggagagagtgagatggagcaaggacaaccctcttaggggcctgccaggcactctccctagcatggaaataaaggaaaaccttgagttccttcaagggaaattccaggcacctcgctggccttgagaagtacatggagcagcttgataagcaagaaggtgattgtagtgtagaacaatagccaaggaagttagagcctcaatatgtttagtttcctgtaaagactaaagataacatccttttttgagatggagtcttgctctgtcacccaggttgcagtgtagtggtgcaatcttggctcagtgcaacctccagcacctcctgggttcaagtgattctcatgcatcagcctcccaagtagctgggactacaggtgcacaccaccacgcccacatttttgtatttttagtagacacagggcttccccatgttggccagtctggtctggaactcctgacctcaggtaatctgcctgccctggcctcccaaagtgctgggattgcgggtgtgagccaccatgcccagccaagataacatcttactatatggccctgagttgattttcaggaacccagacccccaccaaataaaaaatgccatctgctggctcatagacgttgggtaagagaaactgaggcctgaattctcattacaaatgtttgttctaaattccttccctggggcatgtggcggtgggaggggggtggaaggggggtgaggggacgtgctggaggaagtcacaccaatggccacaactaacattgatttctgctgaccccaaatgctcagacaaacttggcctccttaaccaatgacaaatcagagaaactttgaatccacattaagcccctgcttccaggtatcccgcctttttagatcaaagcaatgtatagcctgcatgtattatggctttgcctgtaacctctgcctccttgccattgaaaaccctcagctactggccacccaggaggttgggtcttgaggcatcaaggaggttgcttgatgccctctaaatagctcggaataaacgcctcacttcctcacgctgcaatcccaatggcggtgttcggctttactgcacagggccggtggacctaagttgagttagtgggaggtgttcgaaccagggcaactccaggttgagtaggggctgtgtaaaatgaggccgagagctgccgggctgcattcccggatggtcaaggcattctaaggcacaggatgagataggaggttgacacaagaaacaagtcataaagaccttgctgatgaaacagcttgccgtaaagaagtcggccaaattttaccaaatccaagatggcgatgagagtgacctcgggtggtcctcacttgtgtcttcccaccagcaccatgacagtttacaaatgccacggcaatgtcaggaagttaccctatatggtctaaaaagaggaggcatgaatgggccactccttgtttagcatatcctcaagaaagaaccatacaaatgggcaaccagtggccctcggggctgctccgtctatggaggagccattctttattcctctgcttttctaataaacttgctttcattttatggactcgccgcaaattctttcttgtgcaaggtccaagaaccctgtcctggggtctgattccagacctctttccggtcacaagttcagtcacaagaaccattatcatatgctttctatatatacacataggtattttttaattgctgaactggagtcaaagagaaaccttaggatttgcctgaaggaagtcaagatttgtccttctcggggtccctgtgccagctttgtaaaacctcggaactttcccctctgtgggcttcctcaagctgaggagggctctatgggcttagtacccactaagtggcttcatctgcagcagctgacccaagaaagttgatttaaatgaacccacacttcagaggaaaccagtacaatccgatgtaaagaaataaaaaataggccgggggcggtggctcatgcctgtaattacagcactttgggaggccgaggcgggtgaatcacttcatgccaggagttcaagaccatcctggccaacatggtgaaaccccgtcattactaaaaacacaaaaattacctgggcgtagtggcatgcacctgtagtcccagctactcaggagactgaggcactagaagcgctcgaaccagggaggcaggggttgtagtgagccgagagtgcgccattgcactgcagcctgggcaacatagtgagattctttatccaaaaaaaaaaaaaaaaaaaaaaaaggctaggcacggcggctcatgcctgtaatctccgcactttgggaggccaaggtgggtggatcacgaggtcaggagtttgagaccagcctggccaacatggtgaaaccccatctctactaaaaataaaaaaaattagttgggcatagtagggggcgcctgtaatcccagctactcaggaggctgaggcaggcgggagaatcaattgaacctggggggcagaggttgcagtgaacagagattgcgccattgcactgcagcctgggcaacatagtgaggttctgtatgagagaaagagagaaagagggagggagggaaggaaggaaggaaggaaggaaggaaggaaggaaggaaacaattgcttgaaagggctttgtttcaccagggcacgcagatcaaaggacattggattgaataatgaaacagaagagcctgtctgaatttactaatgtggttgcacgtcccgtaatgattgcagttggctctaattcagttccgtggtgtataaattctgctggcaatagctgtaattggggtcagggatttagatagtctctgtgtgttccttttcattttctgctcagagcctgctgggagctgattttcttctttaaagcgaggtaaataattcagtggggagcagaggttttgctgtgggtccattgctctcctgtgctgcgtggcagctgtgctggtggcagctaatattcagtgggcagtggcctcgacattgcattattattcgagcaatggtactgttctttgctttgcaaaattgctgtttgttatattgactttctggggtcgtggcccctgaagcattactgaaaatcatggacatgaagcagatttattaactggagaaaagacatacaaatgtatttaatgtgtatacacgggagcattcagaatgaagaccccaagttacaaggggagattgtctatatttatgctttggttcatccaagtctggacagctgtgtagaaatagggttggacaaaaagggcctgatccaatgctaatggcctgagtggggaaacccagccaggcctgtgtgtctagattcttcttggcctctctctctctctttttttttgagacggagtctcactctgttgccaggctggagtgcagtggcacagtcttggctcactgcaatctccacctcccaggttcaagcaattctcctgcctcagcctcctgagtagctgggattacaggcacgcaccaccacgctcagctaagttttgtatttttagtagagacggggtttcaccatgttggccaggatggtctcgatctcttgaccttgtgatctgccctcctcggcctcccaaagtgctgggattacaggcgtgagccaccgcacccggcctcttcttggcctctctgaacagtgctccttccttccgggtatggggctgggagcttctctgggatggggggtcttaggacgcccaaacaaggcaggtcagggaatttccttatggccacttttttttttttttttttttttttcaagacagattcttgctctgtcacccaggctggagtgtactggtgtgaactcggctcactgcaagctccgcctcccgggttcacgccattctcctgcctcagcctcccgagtagctgggactacaggcgcccgccaccacacccggctaatttttttgtatttttactagagacggggtttcaccgtgttagccaggatggtctcgatctcctgacctcgtgatccgcctgcctcggcctcccaaagtgctgggattacaggtgtgagccaccgcgcccagcctgtgccactctttatacagataggatagagggaaagttagattcctgtttttaggttttatggctggcttcggggggaaaggcgttcttgtttctgggacccgtcttggggaagagggattctagttccttcggtgccttaggggagaatgggactcagagacatgggggctggagaagttccgagagaaacttctgcttctgaggctgctgctgaggcctgcacttggcggtattgtttcgtaagcctgaaccacgtgcaggtctgaatcaacataaagaatttgggtgggaggcaggggaactccaataagaagcatctttgaatccggcaggggtggaatttgggtcccagaggggtttggtgactgcaggctacagaagaatgcttcaaagtgctgtatcacatggctttgctccgaagggtcccgagcacagctttaccgggggctcatgtgtaacgctcggcccacccatccaccaacaggagccacttaatcgacatctccaggatgccagcaaccgaggaccgttgtcatagtcccagcacaaaatgaggctgctttcttcttgggggtttagggatcccagaccacaaggatttgattaaaagccgctcagttcactaactataagcaaagcaaatcagaaatagatctcctgttcctgccccgtcttatgttcccagtggaaaataaaccccgtgaaagcaatggcgtcatgtgcaacccgaccttggagacagagaccccagagttagcgttgtctacctgggacatctcccagcccaggggtcttactccagacccgtgaggaccccaggcgtggctttgctgcaacttccctggagaggagagaggacagggggccctgcctgggagatagatttgctgcctggcatgcgggactggagactgtctcagtgcccaggccgtctgatgctggccggagtccgcctggtttatgtaacgaggtctggatgtgaccaacaacggcctcgtgtgtgtgagtcacgcgtgcagcaacttctggctgtagtgcaacccctgaaaccaagcaaagcctaaagcccccaggctccacttcctctgtgaccctccccacccccaattcctgtcatctctcagggtcatccggagcatctcaaagctgaaggagcctccgctgcaacctggcctcctgctgcaggatgagacgagctgtctgcagccctcccgtgccacctgcctgttttatgcaacagcatttcagagaggagggactgggaggggagagacaacaccgaggcctttggttatttagggcaacagcagggagtggccgggtgcacagattggaggagattaagtggttgctgaggggatgcctgggattgctgggatgggcggagacataacacagtgaaagatattggtcaacggcgaacacagattggaatgtaaattctcagggtgtgtgcatagccgggacgcttaactttggcgtcctggacaggtgtctcgactggaactgctggcagccttggaggggagatgttgcacagatccaagaggctgacacggttcctgtcccccagcccagtctgagcagcttggaccatgatgatcaagagcgctggaggaggccaggtgcggtggctcacgcctgtaatcccagcactttgggaggccaaggcaggtgggtcacttgaggtcaggagttcgagaccagcctggccaacatggtgaaaccctgtctctactgaaaatacaaaagttagctgggcgtgatggcatgcacctgtaatcccagttactcagacggctgaggcacaagaatcgtttgaacccaggaggtgggagttgcagtgggctgagattgtgccactgcactccagcctaggcgacagagagagacgccatctaaaaacaaaacaaacaaaaagaaaacaacaataaagaaaaaataagaagagagctggatggagcaaagatttgctgggttgttcttaaaggcgagcctgtagtgatcgctggtaacagagaacgtcatctgagagggacgtgggggctcccagagtttgagagaaacggccgtgtgggatttgacctgtgatggcaccgccagctcccagcctccagtctgggcccaggggcagctgctgtgtgcaccctgggctcagagttccccttccctccaaggtttgtgactttgtcctgacttagggattcctgtctggggatgcgtcttctgctccggagaggccctaattgcctccacaaggagcggcaaagcctgcccgggtggcatctgactggagccatgccacagcctatacgaatctatgttggagcccttgaaccttcccccagagcaagcgtcaccgaggcagaccgatttttgggagggagacagacatcagagcgggggagacccagtacctagggctcacctggttcccccaggcttagcctcctccagggcttagtgtttgagtgagagattgtcccccctggacaattctgtagattctgactctgctcctgccttgccctgaacttcccagaacctcagtttcttcctttgggaaatatgcatgctggtcataccaacatccttgggtgggcagatgagactcttgggtgcctggcattactgcaacagaactcaatgcatagtaagtgctgactcaatgtgctcctggctgcatcctctacttcctgataaattctctggtggtgttttctctacaaggctagtactggcaggggcaagtgaggaacaagatcaaggtgtgcatatatgtcagcaagagggacccttcaccctcacaaattctgcagtgtgtttttaatgatgtgtcccaaagatgtgaatgttctcttctctctgctgcagacacattcattagattaactgcttttggatcaggtaggaacctcagcttgtccacacaggttgcttcctgaccctgtatttgtcagtgtaggctagctgctataacaaacagcccccaaagaattaaaagtttatctcttgtttgtgttgcagccaggtgaggtggcaaaggtgtcctatgctccatatagtctctcaggcatccaggaccctcacattgttgtgcttcaccttcttctagggcagcccctctcaacctagactctgtgcgtgtgtggaggggtggggggggcgttggggggcggggatatgcctgtcctaagctgtgagtgggacagtccaggagagaagtctatgtgcttggagagaggcttccttcaaagtttcctggccatgagcaggaatgaagctctgacacaggttgcaacgtgaacgcaactcaagagcatcatgctcaatgaaagaagccaggcacaaaataccacatattgtagaattctatttataagaaatttgcagaacagacaattcatggagacagaaagtggatagtggttgtcaggggctggggaggcgggaggggaactaactgctgaatggggacaggggtcttcttttgggtgatgagtatgctctgggactaggtggaggtggtggttgcatctcccatgtagctcatggtcaggttagttttagtgctctgggcgaccctaggcttgcaggaggaggggagcagcatgaggtgaggaacaagggggattctggcctttccatcatggggtgacttatgccctgtttgctcccaataggtcaaagagactttgatttggcagatgcccttgatgaccctggtaagtgccgatatttcaaggggagccttcccttttcagcttggatctaacagcatcagctgtatagttactttggggttggattgggccagtgttgggaatttcttggtcttgagatctctgttctttgcaggagattgcagacaccttgagacaaacctttacacactctctaaaagtctcagactcatttcttggtaggtctgtgcttctaaacctgtggtttaggaatatgctagtattttattattttattttactttattttgttgagatgggagtctcgttctgatgcccagactggagtgcagtggtgcaatcatagcttaccacatagcctcgacttcctggctcaagtgatcctcccacctcagcctcccaagtagctggaacaacaggtgtgtgcccccatgccaagctaatttttttcttttttcttttttgtagaaacggattctcactatgttgcccaggctggtcttgaacccctgggctcaagaaatccttctaccttggtttctcaaaacactgggattacagacgtgcctcaacatgcctggcccagtttctgcttttcttacacttcagttcatatccctcattgtcccacaccccgatcccaatccatggcctccaatctccccagtttctgcttttcttacacttcagttcatatccctcattgtcccataccccgatcccaatccatggcctccaatctcccctcccagagcacacttcattccgttctcccctcaacttctctggttaccttcactgacggggctgtgagtttttcttctccagggcactgaggacctggaatcttcccattctgtgttttcatcagtccaagttcagctagaacctttctggctgaccagaatgctgaaaatatgtgtcctgggccctgcagaaagtcctgcttgaggcagatagtctgattgagattcaggtgtattcagaccgcggtgggtgggagaaagggaaagatttggtttctgatgcaggcacaatggaaccaaacatttattttgaaagaaaaataaacttttgtgtacacagaggaagaatccattgggctttagcattgggaacaactggttgaccagtgcagttacataatggtgtttgttggaggaagagagaatgataaccagatctgatcctaaaaagccaacaacaagatgataggaactcatctctctcccagttttctgcacacagtgatgtttttgctaataattatcctaaaaggcagatacaaaattgttgtcagtgcaacaggaaaatgtaatgactcaccccaacatggagatgccatttctcccatgaagttagaaaaggtgaaggttgaatcctaccctgtcaaggcagattgaggggtgggggttagaggcaggtgtgtggttgcaaccactttggaagcattgggggattatctccaaaattcagactgagtgtgttgcaccagcgtttggtctggataaagaatgaggcatatctgcaagagaaccctgtgcaatagtgaaggaggggctggctggtaggctcagatacagaacaagacatgttattgatctgaaagatcactgacatgtgacccaggagttccacttctagacagatacccaagagaattgggagcagggactcaaacagttatttgtgtacccatgtttgcagcagcaatattcacaataagccaaaggtggaaacaacccaactgtccatcaggggatgaatgaatgaacagaatgtggtccctccaggcaacagaatatgatttggctgtaaaaaggaagggggttctgatgcgtgctacatgagccttgaaactgtgctcagtgaaacaagccaggcacaaaaggccacagggtgtaggatcccattaatatgaaatgtccagaataggcaaattcagagagacagaaagtggattagcgattgttgggctggaagaggggacaaaagggagggactgctcgtggctatggggtctccttttggggggatgaaactgttctggaactagatacaggtggtgattgtacaatattgtgaatatatgaaacaccattgaattgcacactttaaaatgtcaaattttatatgtgagtttcacattaattttttaaaaatcacataaataaacttattttccactcacctgctactaccttttcattgctcacctagaaggctgccagtgcctgcaaacacatctttgaatgcatcgttttgctaccaagagccccccatgaatgggcaggcatgtgcctgttcatccacagcccttcctcatgggaaggaagccccagtgcagaggaaccacagtcacctgcatggcgactgtggggaattcacttttcactgtctatactgcctgggctttaagaaactctgtgagtgtatcactattttaaaaaatagttataattttacattttaaaaaggagacagagaaaggaaggatgggagagagggagggagggtgggaggaggaaggaagggaaaaggaagagaagaaagaaaagaaggaaacaatgaaaggacagaggaaaacagggagggagggaggaaaaaggatggaaacaaggagggaagaaaaggaagaagagagggaacgatggagggaaggaaggaagaagaaaggagaggagataagaaaagactgaggggaggaaggaagaaggagaggaatgaaggaggaagggaagaaaggaggggggaaggaaagaaagaaaaataggagaagaaaggaagaaagaaaaagaataagggaaggacggagggaaggaaggagagagggagaggagaaaggttggaggggaggaaggaagaaaggagggtggggaggaaggaaagaagaagggggaaaaggagagagggaaggaaggaaggaaggagagaaggaaggaaggagagaaggaaggaaggagagaaggaaggaaggagagaaggaaggaaggagagaaggaaggaaggagagaaggaaggaaggagagaaggaaggaaggagagaaggaaggaaggagagaaggaaggaaggagcgaaggaaggaaggagagaaggaaggaaggagagaaggaaggaaggagagaaggaaggaaggagagaaggaaggaaggagagaaggaaggaaggagagaaggaaggaaggagcgaaggaaggaaggagcgaaggaaggaaggagagaaggaaggaaggagagaaggaaggaaggagagaaggaaggaaggagagaaggaaggaaggaagaagggagggcaggaagggagagggaggtggcaggaaggagaaaaggtgatgagaaaccttctattaaaatacaggacatgcgaaaccatatgccccgtttggaggttcaagctctccttcttgcagtctctgcatccccagtgaatgtccgcaccacacacaaacccgtgttccagccgcctcctaccaaggcaatgctaggctgttatgtaaaccatgctttcaaatacggtgtttcctctgtttggaagaagtctggccattgcacagccctgaagctccaattttcccagccatggccgactccacctcctttgagccatcttcctcaaacctcctcctgccctcgtctgcccatccacactgcacacccaggttcactaagcagggcagtcacaggctgcaccctgagcactcctgacctgatatccacatccatgcaatacatatttgctgaatgaataaatgaatgaatgaaagaaagtgagataagccatcattctggaagctgcaagtctttctccttcttttcttttgcctccccctgcctcaccctccaccgtccagccctgtggtggctctacgggcaggtggctcacttacttgtcttggatgttctcagctactttggccatcctgtgggcatcctcacagcctcaagggtggattgtttttgaatggattttaagggtgttttcttgtcttttttctcaattcaacatggaatttgtgtctatatcatttactttgtatggctttgtcactcccttttcacctttcatcagggcgttcatggcctttcttcatgcttccaatgaatcttcaatgcatattgcatttattttctctctttgttcacagaacccaccaagaagccaaactcaggtgagtgtctcttcagctgggaaaaactgaggcaacgtccttgaactgatgcttacggaggggatggttgaggatgttttacagaactgtggggtatatgaaagagatgcaacaactgtaccagatagcagatattgaaagcaaaatgtggtgattagggaaatgcaaatcacaaccacagtgaagcaccacttcgtccccactgagatggctaaaatctaaaatggaaaataacaagtgttggcaaggatgtgatgaaactggaatgtttgtacagtgctggtgggagtctaaaatggtacagccactgtgaacaaatgctttggtggatcctccaaaagttaaatacaggattactctatgaaccagcaattccactcctaggtatgtactcaaaataattgaaaacacgggttccaagaaaaatgtgtacacaaatgttcagagcagcactattcattatagctaaaagatagaaataactcacatgttaatcagtggaaggaatggataaacaaaatgtggtccattcacacaatggaatattatttagccttgaagaggaatgaagcactgaaaattgctacaaagtggttgagcctcaaaaacattttgcaaagagaaagaagccagacacaaatgatcacataatgtatatttttatgaagatgaaatttcaagaataggtgaatccctagaaccagaagcaatgtcgtgactgccaggggctggaggggaaagagagagtgactgcttgataaattccaggtttctttttgggggaacgaaagcattctggaagtacacagaggtgatggctgcacaacactgtgaatattctaagtgcccctgaattattcacttttaaatggttaattatatgtaaatttgacttcaatttatttatttattttcaattaaaaaggtaacctttggctgggggcggtggctcacacctgtaatcccagcgctttgaaaggccgaggtgggcagatcatctgaggtcaggggttcgagaccaacctggccaacatggtgaaacctggtctctactaaatataaaaaaattagctgggcatgatggcacatgtctgtaatcccagctactcgggaggctgaggcaagagaatcacttgaacccgggaggtggaggttgcagtgagccgagatcatgccactgcactccaacctgggtgacagagtgagattccgtctcaaaaaaaaaaaaaaaaagaaaagaaaagaaaagaaaaagaaataattcccggggccgggcgcagtggctcacgcctgtaatcccagcactttgggaggccaaggcgggtggatcacaaggtcaggagatcgagaccatcctggctaacacggtatgttgtacctgagcgagttagaaaaacgctttgagacaaattaagagtcctttataagccagcgaccgagagacggctaatgcttaatagtctctcggtcctgaggaaggggcttgattaacttttagatcttggtttaggaaggggagggctgggggtctagtgaaaaccattttacagaagtaaagtaggcaaaaagttaaaaggataaatggttgcaggaaagtaaacagttccaggtgcaggggctttaagactattacaaggtgatagacgcggggctttgggcgttactaatcagacgaattcccgggaactgcggatgtagctcgccacagtatcttatcagttaactgcattcttggatgtgctgggagtcagcctgcacgagttcagtccttgaggaaggggctgccagtgaaagagccaaggtggagtctggctggctctcttagctaagggagagtccattcaggtggaaagaaggctaggtgagtaaaggaaaagggagagtctaaaaacaggttagtaaaaaccaggttgggcattacaggtgaaaccccgtctctactaaaaaatacaaaaaaaatttgccaggcatggtggcgggcgcctgtagtctcagctacttgggaggctgaggcaggagaatggcgtgaacccgggaggcggagcttgcagtgagccgagatctcccactgcactccagcctgggcgacagagcgagactccgtctcaacaacaacaacaacaaaaagaaataactcccagacttccagcagactccttgactgccatgagagatgtcaggaagtcaatggacgggtgtttataggttgttcaggaaatgttcactatcaagcaagaattgaaaatgcagctaaattgctgttggagagtgatgatagcataaagatttccaacaagaagctctgcaaattttgctgaaaaatcttccaaatgatgctctgccataagaagaaattcacaccctgaatagcacagcaggatgcgaatagcaatgccagccaaagacattgcaaacaagccggtaaaactaagtgattgttagctgtttaaaaaaataataataactggtgttaacaacaaagtgaaacttaacttctgaagatgaggctaccttcacagagaggataagaaaggaagaactgagtaaaagtagttagatattgctggattttgacattttaaggttaagtgttcctgctaaaaataaaaattgaacatataactcctgaactagtggatgaaaatgaagaatgaagaataaaattaaatacaaaaaaaatgaagagtaaaattaaataccaaaattagccaagtgttgtggtgaatgcctgtagtcccagctactcaggaggctgaggtgggaggatcacttgagccccagaggtggaggttgcagtgagctgagattgcgccactgcacttccgcctgggtggcagagccaggctttgtctcaaaaataaaaaaaaataataaattaaaaacctgaatactaaatggaagttaagaaggaaggaattaaaaaagaagaaaagtaaaataaaatagtaggaatagtgaatccttagttatgttagatgttcagtgatttaataaatctgtaaaaagacggagatgagatgatgcaatttaaaatgtttcggctgggcgcagtggctcacgcctgtaatcccagcactgtaggaagccgaggcgggtggatcacgaggtcaggagatcgagaccatcctggctaacacggtgaaaccccatctctactaaaaatacaaataaaatgtttcatgctatttacgagagaagcatttgcaacaaaatgccaaagagaaggtgaaaatagctggaaaaaaaatgcgcaaagcaaataaccaatagaaagaaagccaagttgggctagcaaaatcagacaaaataaccttcgaggtgcaaacaactttgaggcccaaatagaggttcttcccactaaaagaatgattccctgaatgataatggaatcttgacccagcctgcacctcaggttaagttaaaagtggaaatttaaagatctaagtgtgagattttaaaaagcatttccccagaaataccaggatctgtagatggaaatgttattaagaataaagatgtggagctgggcgtggtggctcacgcctgtaatcccagaactttgggaggctgagactggctgatttcttgagcccaggagtttgagactagcctggacaacatagtgagaccccatctttacaaaaaaattaaaaaaaattagtggacatggtggcatgcacctctagtcccagttactcaggaggctgaggtgggaggatcacctgtgcccaggctgaggctgcagtgagccatgatcacgccactgcactccagcctgcgtgacagagcaagaccctgtctcaaaagaaaagaaaaaaaaagaagaaagaaatgaaaaccgtagctcagagacagagaaactgagcaatgcataggttcagaagggtttgaaacagactgaattgtgtcttggcatatgagagaggtcgcagctataaaacaatgagagaagaaaccaaattccacataggcaggactgagacaattggctgttcttgtggatgatacgtgatcaaatctcaacctcatgcgatacttttttttttttttttgagatggagtctcgctctgtcacccaggctgcagtgcagtggtgtgatctcacctccccgcaaacttctcctcccgggttcaagtaattctcgtgcctcagctgggactacaggcatgtgccaccacgcctggctaatttttgcatttttttagtagagacggggtttcaccaagttggccaggctggtctcgaactcctgacctcaggtgatctgtccacctcggtgtcccaaagtgctgggattacaggtgtgaaccaccacacccagcctcatgtaatacttaaaaatgaactacaggtggattacaaacctgaatataaaagaaaacttttttttttgaaaaatagagggaaatgtcttataacctcagagttaggaggtttttcttagatacaatacaaaaagcataaccacgcccatagtcccagctactcaggaggctgaggcataagaatcacttgagctcgagaggtggaggttgcagtgagccgagatcctgccattgcactccagctgaggctacagagtgagagtataaaaaaaaaaaaaaaaaagcataacctttaaaaatgggttagcctatgtctacatttaaataataataataataataatgttccaacttcaggctctgaaaaaagtcaaaagatgagctgtcaactagaagaggctccttactgctcataccaccagggaaagtttaatatgcaaaatgcagtcatccttcagaattcatgggggattagttttaagacgccttcttccccgcagacaccaaaatccacagctgctgaagtctctgatataaaacgtgcagtacttgcatataatgcaagtatatgttcctgtatatttttatttatttatttggagacagaatctcactctgttgcccaggctggagtgcagtggcgtgatcttggctcactgtaacctccacctcccgggttcaagagattctcctgactcaacctcccaagtagctgggattacaggtatgcgccaccacccccagctaatttttgtatttttggtagagacgggttttaaccatgttgtccaggctggtttcgaactcctgacctcacataatctgcccaccttggcctcccaaagtgctgggattacagggatgagccaccgtgtccagcctctggtatactttaaattatctctaggttactcataactcctgatacgctgtaaatgctatgcaaatagttgttatactatattattttttatttgtattactttttattggattgctatattttattttttgaaatattttcaatacaagactggttggatctatagatgcagaaattctggttatagagcacaaactgtgtatagatagctcctaccaaaacagacggatggtgaaaaaaagaaaagaaaagaaaagaaaaagaaaatggaggagagagactatgaggcgactaaaagaagagggatatgatcattccattcgctgacaagaaaaattcaaagaagagggaattatgcaattgaccagctgatgtgtgttagaaatgctcagggtcacacatattcattgaaagccaatttaagccactatttaaatttaaaccgatttaaacaattgggcttttttttttttttctaaaaaaaaaaaaaagtcaattaggccaggcgaggtggctcacacctgtcatcccggcactttgggaggccgaggtgggtggatcacaaggtcaggagtttgagaccagcctggccaacatggtgaaaccctgtttctactaaaaatacaaaagttagctgggcatggtggtgtgtgcctgaggctgtgagactgaggcaggagaatcacttgaacccaggaggcggaggttgcagggagcggagatcatgccactgcactccagcttgggcgacagaccaagactctgtctcaaaaaaaaaaaagaagaagtatattggttccgtctggaaaggtggagcacttgaagcaaaggcaggaagactggaagcagggagagggttttcaggtcacaaacaggtgagagacaaaacagttgccttcttttgagtttctgattagcctttccaaaggaggcgatcagatacgaatctgcctcagggagcagaggggggactttgaatagaatgggaggcaggttggccctaagcagttcccagctggacttttccctttagcttagtgacttgggggtcccgagatttatgttcccttcacagtgtatgagtgagagcacttggaaactgagagtggaagtgtcgcaggccaggtctcactaacacaggcccccacaacacctgtttcagtattgactgagtggttaaatattaaaagccagtgctgttatacaaaggctggaatgtaacaaaagcccaccgagagtttttcccaggactttcccgggccttaaagcatgacaaaataatgaatgaattcttaacaggacccatttaggattaaacaagttttactgggggtctgcagaaactccccaggcctccacaaacaagtttattggggctttgaaggaactctgcaaacctcctggatttagcaggagacaacatgagggtaatcaccccggcacctggacccattagattaagtcaatttactgaggctcctgaggaagatcctcaggactcagaccttagttatagattaaaagaagttaatcacttatgtctttagataaatgcacacacatatctccacatagcttggaaggtatataagctctggaaaactataattttgagttagtctggtgataatttccaggccttctccctgtaacaggttgcagaaataaaaactctcttcctccccagttcatcggtgtttcattattgggctgtgagaaatagcaacccagttgggtccgggaacagaaggtttggtgttatcttcatcacaggcactggactgtcggtaaatttattccatgacaattcttcctaggtttcttttttatattacttgcttccatcatggcagacagctacactggcttcttgccatgaaaacgaacttctagtaacaaaacggaaacctttttttttaagtttcaggtttcaaggttttacttctatctgcaaagtgatttttaaccagacaatggcaatctataaacacaccgtgggcagcaaatcagaacaaactgcaaggtcgatagtcacgctgatgagcttgtttctgcagcctgctcctaagggaaggacaattttcttttctaacagtgcaatgttgtttcctccacagatatctacccaaagccaaaaccaccttactacccacagcccgagaatcccgacagcggtggaagtaagaatccgcaggcctgaaactctttctcaatctggtttgatgatgtttgcctttttatttactagcaggtttagcctggttgcatttgaaatatgtgtgtaatagctcccttactgggaatgtagtttctttcctcactggggggagcaagaaagtccaacggacagaaacaatcttattttccctttgctttgacatctagaaaccactaaggtgtacttgtaaccacccaactggttcactttgttggctgcctagacagagctgatttatcaagataggggaactgcaatggagaaagagtaattcacgcagagccggctctaagggaggctagagttttattattaatcattcagtctctggaacatctggggatcagggttgttaaggataagttggcaggtaggggcttgggaagtggggagtgctgaccggtcaggttggaaagggaaccatagggggttgaagtgaggttttcttgctgttttctgttcctgggtggatggcggacctggttgagccagattaccgggctgagtggtgtcagctgatccatccagtgcagaggctgcaaaatatctcaagcaccgatcttaggttttacaatagtgatgttacccccaggagaaacttggggaggttcagactcttgcagccagaggctgcacgagccctaaagtgtaatttctaatcttgtagctaattttttggtcctgcaaaggcagactggttcccaggcaagaagggggtctttttgggaaaggggcattcttaattttgtttcagagtgaaaccacgaactgaattcgttcccaaggctagtttggctcacacccaggaaagaacaaggacagcttaaaggttagaagcaagatggagttggttaggtctgacctctttcactgtcatcatttcctcagtcataatttttgcaaaggccgtttgatactcaaaggacactttgcattatcatcacagaaagctaatcaggctgagagacaagtcctttctctcacttgttttcagtgctccaaatacctttggcttaaccattcccaaacccccacgtgtgctgtgcactttatgtgttttagagttggtttctccattttttctaacatttggcagacagtttttttccacagatttattacactcatcattgaaaaatatgcaattcaaaaaagaaagagagtgaacgagagagagaagagtggggaggggggtgggcatggagagagaaagagaaagagaaaagaaaggggaaagaagaaaggaaaagatagattctggccattaaagttatcagcagttcaacaaccttaaaaacttaaatgtttgccaggcagagcagcgtgaagctggctaaatcaagaggggttctggaagcttcctggtagtttgctctggctttaaactttcacagcttaacagcgtgtccattcattgcagacacgcacatccagatggacagaaattatctcctcttacaaggaatcattaaaaacagagaccaagacccaagggaggtgacacccacttgaaaaactacacctcaggccgggcgtgggggctcacgcctggaatcccagcactttgggaggccgaggcgggcagatcacctgaagtcaggagctcgagaccagcctggccaacatggcgaaaccctgtctctaccaaaaatacaaaaattagctgggcatggtggcatgcgcctataatcccagctacttgggaggctaagacacgagaattacttgaatccaggagaggaaggttacagtgagccaagattgtgccactgcactccagccggggaacagaatgagattctgtctcgaaaaaccaaaccaaaccaaaccaaaccaaacaaaacaaaaccccaaaacaccacctcacccttaactgcattagttaagccagctagtctttcttttttccccctctttcatgatgaaaatcccaaataccacccacctttttctcctgctatttcctcctagtcttttaaaaaccattgtcctgcggatcatggctatgttgcaaggcactcatgggaattccacagggaacgtgtttcttgctgaaacatacttgggaaacgcccagttaaacagactgccgtgggcttccctcccagagaattcatcaggacttaaaatgtgtggctgggcatggtgggtcacgtctgtaatcccagtactttggtagaccgaggctggtggatcacctgaggtcaggagttcaaggccagcctggccaacatggtgaaaccccatctctactaaaaatacaaaaattagtcgtggcctgtagtcccagcaactcgagaggctgaggcataagaatcgcttgaacctgggaggcagaggttgtagcaagctgagatggcgccactgcactccaggctgggcaacagagcgagactccgtctcaaaaaaaaaaaaaaaaagaataagaaaaaaaaaacttaaaatgcgagatcctttaagatgggccatcttcagagtgtgaacactcagcccctcccacagcaaagtgattcatgaaccccaataggaggaggagtgggggaagagaggctcaggctggggaggtgaccccccatgactcaagcctcaatctcctgatgcttgtcccaacaaagaggaggcttcctttccgactttggtttttcatgttgtgcttaaatccagccacactgatgcctttaacatggcagtcctgaattattaatcaatactgtgtgaatccaaaatatctgagacaggtctcaatcagtttacaaagtttattttgccaaggttaaggacgtgcccgtgacacagcctcaggaggtcctgatgacaagtgctcaaagttgtcaggacacagcttggttttacacattttagggagacaggagatatcaatcaatatgtataagaagtacattggtttgatctggaaatgcgggacaactggaagcaggggcttccaggtcacaggaagatacgagacaactagttgcattcttctaagtccttgatcggccttttactgaaaactcaatttacatgtgagacagggcaaaggaatagtacttatgcctcagtctggcccagtgaatctgcatttttcatcaacaatagggcagaggaagcaatcagacatgcatttgtctcaggggagcagaggggatgactttctgtcccacacctgtgaagatgagctgttggtgtacattgccagggtgaaattccacagaactgttttagggtaaacaaaacagtttactttcctcagattgtgaggacagtatgtagcttttaaaaaacttaaaaaaatttttttgtagctatcttatttagaaagaaaatgggaggcagatctgactaactttttttttccagcttgacttttcccttggcttaatgattttggggtcccaagatttattttcctttcacaattgaacatcagaacatggagtatttaacacaggaaatgagcaaatttaacgtacacacccaaggaaaaggaaaaatgaagctggttggaagttaattatggatagtgtggtatatgagcagaaattccccttaaccagtgttcttgcccaggctagcccaaatgagcccaggctagcctagattcccaagtgtgtatcttgagaacgaggaagagccctagaaaacaatgtgtaacgtccctccaagatggggtgttctggaacaatccctcagacaacgaaggcaattgttgatgggcaacattgggaagaccccagagatggaatgtcctaggcctttccatgttctctttctcattctccctccattgacttgataggtggctgggggatttataagtatttaccacacaccagccagctttctccggatggctccaggcatgcttggagcccagtggtctctttcccttagaatttgatctggaggaacccaaaattctctctgtgtcctttgaaattcagcacatttttcttggcttccatgagctcctgtggcatttctcaggccaactgttgactctgcttcctatgtctgtgcttgtccctttgagagatgtcagcgttgctcaccgattcttttctctgaccccagcagctcctatccatgttgtctttttttttttttttttcagacagagtctcactgtattgctcaggctggagtgcaatggcacgatggcatgatcttggctcactgcaacctccgcctcctgggttcaagcaattctcctgccttagcctcccgagtaactgggattacaggcgtgcaacaccacacctggctaatttttgtacttttagcagagacagggtttcaccatgttggccaggctggtctcaaactcctgacctcaggtgatctgcccaccttggcctcccaaaatgctgggattacaggtgtgagccactgtgcctgtcctcatgttgtcttgaaagtaacaagacaggcacggattctttttgatgcaagctgttatgggatgaattatgtctccccgcaaattcataggatgaagtcctaacccccagtttcctcagaatgtgactgtctttggagatggggcctttaagaaggagattaatgtaaaatgaggtcactagggtgggtccggatccaataggactagtatcctaataagaagagatgaggacttagacacacacagaggaaagattatatgaagacacagggagaagacggcatctacaagcccaggagagaggccttaggaggaaccagcccagaccatatcttgatctcacactcccagcctccaggactgtgggagaatcaatgtctgttgtttataagccacccagtctatggtgttctgtgacagcaacctgaaatggactaagacacctcataagaaggggagatgaggacgcagacacacacagagggacaatcctgtgaggacacagggagaagatggcatctgcaagcccaggagagaggcctcaggaggaatcagcccagcccacacctggatctcagacttccagcctccaggactgtgggagaatcaatgtctgttgtttataagccacccagtctttggtattctgtgatagcagcctgaaatggactaagacatctcataagaagaggagatgaggacacagacacacacagagggacgaccctgtgaggacacagggagaagatggtgtctacaagccaaggagagaggcctcaggagtaagcccaggaatcaatgcagttggaggttctgtgtgtgaatggaggagggaagctcacagatgaaggcgttttgagggaggactgaccttacagtgaggtacccagagacttcctgaaccaagccacgaatatgcagctcgtgctccgggcagtgccttctggcctggaaaccaaagctcccttgtgtccagtccccactcctctgtttggcccccaagtttccataatcccccacagttgtatcattttagagacctcaaaagagagtctaggctgggcgtggtggctcatgcctgtaatcccagccctttcagaggccgacgtgggtggatcacctgaagtcaggatttcaagaccagcctggccaacatggtgaaaccctgtctctactaaaaatacaaaaattagctgggcatggtggtgtatacctgtaatcccagctacttgggaggctggggccagagaatcgcttgaacccaggaggcggaggttgcagggagccgagattgtgccactgcactccagcctgggcaacaacagcaaaactccttctcaaaaaaaaaaaaaaaaaaagagagtctaggcagggcatggtggtccatgcctgtagtcctagctatactcaggaggctgaggtaggaggatcacttgagcccaggaggtggaggctgcagtgagctatgattcaccactgcactccagcctgggcaacagagcaacaccctgtctcaagagagagagaaagggaaagagagagagactattttgagaagtgaaaaaccagtcattctcagcccagatttccagtgttctgagacgtctgtcctgaggaaggactttgagaacagcatccttgccttttttgtgaattaaagtaatttcactcttgagccaatgtggataagcacttgacaggtactggcagtgccaggtaccaggaatatagaatgggtacagaaaataaagtttctagtccagcgacaaaaaggtgctgaagatacagactcatgtcgtgcaaagagcttgcactgattatttcatttcggcttcttgaatagggtcaaaggacatttaagctgagacaggagggacgagctaattaatgcttttccagatgacaaatggattcttcaaatatttagggagagtgtaaagtgatggacagggaacaggaggggtcatgacagaaggaatgccacctgcaaaagtcctggggcagggctgggcacggtggctcatgcgtgtaatcccaacactttgggaggccaaggtgggcagatcacctgaggtcagaagttcgagaccagcctgggcaacatagtgaaatcccatctctactaaaaatacaaaaattggccaggcgtggtggcacacacctgtaatctcagctactcgggaggctgaggcaggagaattgtttgaacccaggaggcagaggttgccgtgagctgagatcacaccactgcactccagcctgggcgacaaaagcgaaactccgtcttaaaaaaaaaagtcctagggcagaaagctcatggtaaacttgaggaacatgcaaaagtcattgcaaaaagttttaagaaattcaaatgaagccaggctcagtgtggctaatgcctatgatgattccagctctttgggaaggcaagacaggacgattgcttaagaacaggaatttgagaccaacctgggcaacatagcaagaccttgtctctacacaaattttaaaaattagccaactatggtggtatgcacctgtagactgagctacatgggtggctgaggtgggaggattgtttgagcctaggaactcgaggctgcggggagctatgattgcaccactgcactgcagcctgggcaacagagcaagactctgtctcaaaacaacaacaacacaaattcaaatgaaacggtgtaactcaagcaagatggaaatacaacacactatcaaaaggtcagatgtttcatcctaacatttatagaagtgactgacttctgtaaatggtgctggcatctgtagtagccctaaacagggaaaggtcaacaacgcactttctgccctgttaatttcagagagccctggacttcttgcgaaagcaccagtggtgtaagtttttgttttttcattgtaagctctgaggtggtattatgaatattgtctacatgattaataagctccgtaaaagcaatgggcagtaacatcttttctgtactttggcattcttatttatagatggtatctacctgaaagatgtcattatttttctgaaatcatactgttgttttccaacagatatctacccaaggccaaagccacgccctcaaccccagcctggcaattccggcaacagtggaggtaatgagtatttatttatttatttttattttattttattttattttattttactattttatttgattctatgttattttactttattttaccattttatttgattctatgttattttactttattttatttgattctatgttattttactattttattttattatttattttggagacagggtctcgctctgttgccctggccagagtgaagtgatgtaattgcagccttgaactcctgggctcaagcaatcttcctccctcagcctttcaagtagttaggactacagatgtgtaccacctacattgcaccacctatatttcaccacctatattggctatatttcaaattttttgcagagacaggatcttgctgtgttgttcaggctattcttgaactcccggcctcaagcaatcctctgcctcagcctcccaaaatgctgggattacaggcaccagctattgtggcccagcctgataatcagtattaaagtccattttagaagtgtttggggccaggcacagtggctcatgcctgtaatcccagcactttgggaagccgaggtgggcggatcacttgaggtcaggagtttgacaccagcctgagcaatatgatgaaaccctgtctctactaaaaatacaaaaattcgccgggcgtggtggtacatgcctgtaatccagctactcaggaggatgaagcaggagaatcgcttgaacccgcaaagcggaggctgctgtgagttgagatcacgccacagcactccagcctgggagacagagcgagcccctgtctcaaaaggaaaaaaaaaaaaaaaaagaagtgcttcacgcctgtaatcccagcactttgggaggccgaggtctcctcaggcagatcacctgaggtcaggagtttgaaaccagcggccaacatggtgaacccctgtttctactaaaaatacaaaattagctgggcagagtgacgcgtgcctgtaatcccagctactggggaggctgaggcaggagaatcgcttgaacccaggaggcggaggttgccttgagccaagattgtgccaatgcacaatctatctaggtgatagagtgagactctgtctcaaaaaaaggcgggggggtggttggatacaagtattatttaatgacttaaaaattctcatctccatggtgaaagaccaattgcttttgaaatgcacagacattgttttgcgaggagttcagttctactatccaccagcacctggggattacatttagttgatagtaaataaatttaaatgtttttgatgacattgactgaaaaataccatgcacactaagacatttcaagttatgatggaggaaggcaattttttcttgtttttttttttgttggtctgtgttctactcacttattcttccctctgcaagagttatctgcggccactttgcctgtgttcctacagcacttcccatctccgccttggcaattgtgtctcacgaacgtgagacactcaggaaagagatgctggtctgtaaagttggaagagtctcagcgattccattggtggggcaaatgtgtgcagattgaggaagctaagatacactgggtgtcttcctctctccacctgctttaaccattgggagttcccctgattgtgattgtttcaggacgttgcttggatgttgtcatattcctagggttcaaggcactccgtgaaatccaaggaaacaagctttgggtatgtcccagtgccttttcccttgggtcttgcaactgaagaattgtgtttcttccctagaaaaacgaacacacttttgcccactcacccacctcctgcaagtctccaaaaccacagcgttgtatcctagactatgttcccccaggaggtggttcctccctctgcattcccgtactccatactgcttgatatgttcttacatgcaacaccgtgcaattgtgtttagttgattcctgtgaattagaatgagaactctacatgggcatggatttttgcctttcattcactgctgcattccctagtctggaaagctgtgcctggcacacaatgagtcctaggtgaaggtcagtgaagtcattaatgcttgagtcccaacaggcaaacagctggattcatgaatgaaagacttaccgctacatcccttcatcagggtgtatagcttcaactccatttcctggaaagctctacaatagttcttcctcctcaaaaggctctggtcttgtgattcatagcattcgtccaccaagacatgaacaagggatctttatgtcagaggttccctgttcaaagctgttttagaggccaggcgtggtggctcattcaggtaatcccagcactttgggaggccgaagtgggaagaccacttgaggtcaggagttcgagaccagcctggccaacatggtgaaaccccatctccattaaaatacaaaaattagccaggcatggtggcatgtacctgtaatcacaactacttgagaggctgaggcaggagaatcacttgaacctgggaggcggagttcagttggagttgcagtgagccgagatcatgccattgcactccagcctgggtgacagaacgagactccatctcaaaaacagtaaaaataaaaaagctgttttaggaaacatcccttttttattattttttctttgagtcagggacttgcttggttgcctaggctgaaatgcagtggcgggatcacagctcactgcagcctccacctcctgggctcaagcaatcctccgactttagcctcctgaatagctgggactacagacacacagcactccacctggctaattttttcttttttctttttctttttctttctttttctttttctttgtgtgtgtgtgtgtgtgtgtgtgtatgtgtgtgtgttgggacagggtttccctctgttgcccaggctggtcacaaactcctggccttaagtgaccctcctgccttgacctctcaaagtgctgggattacagatgtgagccactgagcccagccctaggaaacagcctcttaagccaagtgcaatgactcttgaactccccagagcctctgtgcatgctacctcgacttcagcttcacagatgtatgcaactgcgggatcaggttaggggcactcacttaccggcagtcccaaagctctggagagtctgtgctgagggaatggtccatgttaaagcaaagcagaacaaccactctgccttttgtattttatacttgttttttttttgaaacagggtctctctgtgtcactcaggctggaatgcagtggtgtgatcatagctaactgcagcctccagttcctgggctcaagtgatcctcctggcagatgggactacaggcgcacaccaccaagcccagataattttttgtatttttttgtagagacagggggtctcactatgttgcccagactggtctccaactcctggcctcaagcaatcctcccgcctccacctcccaaagtgctgggttgcacccggcttgcatttcacacgtttaataaactcaatcagcatgtttcctaccccctagagtgacaatggtgcacattagcatggatttcttatagatcgagaccaaagacctaattacttatctatagaccaatcttggagaggaaaggcagactccaagggttaattcggggtccaggaaccacagaaggaaggtctccttggatctcgtttgagcctgaagtagctcagtctatgacagacaccatcagagggcagaggcacaggtgaacgcagcagtcggaactttgtcagagcagcaaaggacatcttaggaaatgaggcttgcaaagcagccttgggttattgagaaagctctctcagcgtggattctcagggctctgggatcttctctgccttgcaggtgcctctttgttttttgggaggaagcaggtgggtctcatgtgtcagggcagtaaggagcaggaatgaatggatgaaacaaatctgttggggtgggtagcggctgtgctctggggagccaagagagagacagggggatggtgctggtttcagacaagatagttgagcaggaacttgaaagagaaaaggagagtggatcgtggggacctgagaagctggaattctccctggggaatcggccactgccaacgtgagggctggggttaggagcatgcctatggtgatggagaagcctgggggaggtgcctggttgatggggcaagaggagccatctggagagaaggaaaagcctggagtctccttccgggcttgcttaaggactagggaggggcaggacatgagatgatgttggaggattctgagcaggggatgggcctaggtgggaggtggggcagaaggagagctggacgaggacatggtgagaggtgatgttggctcatccaggaaggacggccaggaggaagcagagggaaaggggcatgcaaaggtccagaggcaggagcaacggggaacatccagggaaggagggaagggcaggggatttggagatggggcaccctgagagagggatccaggcagcaggcagacacgacagcctgagcttcaccccagctcacggttggccctgggagggctttgagcagaagaggggcaaacatcagcaatatgaggccacactgcagacgttctgggccctgcacacgcctccttgcaggcaaggcggccagcccacaaggtaatttaattcctggtgcctgtgggcgtcctgcaaagagccagttggcgtcggaacgctcttctccaaaacctgtgccagtgcccccagcgcagacctggtgtgaaggggacctttggagaggtctcatgagcaatgccgcgtgctctgccccacaggttacttcaatgatgtggaccgtgatgacggacgctacccgcccaggcccaggccacggccgcctgcaggtaggtgccgagcctccccagatgcgacacattgaatttgcacagagagggtgggatgagaggcctgaagttggggatgagagagctgaggttggggcagagttggtgacgagcagacgataagctggtgcaggggatgacagagaaggccccatggccgcatcagtggggtttgcggtctgggcatctgtccgcctctccaggctgggggactggatggaaacaaaatgaacaggcagaactggagggtccactgaaacacttgcggtcatttctgtttagacttgtatatgtgtaagtgtgggtgtacatgtccagacacacctttatatatctgcatgcttatcaatcttcatttgtgtgtatatagatgtttatgtatctttatatttgtgtgtatatatgcttttaaatatatataaatgcatctacatatgtaggtatatggtttttttcatgtgtgtatatacatgcttttgtatatatacagtacgtggatacctttctctgtttttatatatgtatatcctgactttatatatatccttatatatatctttacataggtacatgttttatatgtgtatatatatctttatatttatatgcagatatatgctttttatatatatttatgtatatgtatatcgtttaatatatctttttaaaaatatatcttcatgtatatctttaaatacatatacattttatatacattttaatattttatgtgtatgttatataaatatatatctttacatatataattaaatatatgcctttatttatatacatctttatatatgtacatatatacctttacatgtatgtgcctttatttatatatgtatatatttatatatacacttttatatatacatatgtgtatatctttatatgtgtgtataaatgcctttatatacgtacacatatacctttatgtgtatatacttttatatgtgttatgtatgtacacacaactttatatatacatgtgtatatatctttatataggtatataaatgtctttaaatatgtatatacatatcttttgtatttatttatttttttttgagacggagtctcgctctgtcgcccaggctggagagcagtggcacaattttggctcactgcaacctctgcctcccgggttcaagtgatgttctgcctcagcctcctgagtagctgggattacaggcgcctgccagcacgcctggctaacttttgtatttttagtagagacggggtttcaccattttggccaggctggtcctgaactcctgacctcgtgatccacctgcctcagcctctcaaagcgttgggattacaggcgtgagccactgtacctggtctatatgtatatcttctaatgtatctttatatatatctttaatatatctttatatacatgtacattttatatacatttttatattttatgtatgttatataaatatatacatttatacatatataattatatacctttatttatatatctttatatgtacatatatacctatatatgcttttatatatgtatgtgtacatttatatatacacttttatatatgcatatgtatatgtctttatgtgtataaatatcttcataaatatatttatatatctatacataacctttatatatgtataaatatcttatataaatatatattttatgtgtatatatgcattatttgtataaacacatatttgtaaatgtctttccatatatatgcatatatagcttacatatgtttctatactgttatatataggtgtatacctttacatatgtatgcatactgttttatatatgtgtatataggtcccttcatgtatatatgtatatacatttaggtatatgtgtgtgtgtgtgtgtgtgtatatatatatacacctttatatatgtacatttatctttatacacacagacatatataaacacttctaatataaagttttctctgtaattggaggtgaatgtctatcaataatctttcatatagaaatacaagtacagactataggagacagagatgcatacaacattgggctgaagagtgtgatgtttgaggctttattttcaagcatgtgaggtttctggcctgtttagttctgcaattttattttagaagacataaaggacttgtcccagatattttgcaaagctggacctgcatctttcggacaaccagattgcatccagtcatcttttctgccgtgtttacttgcaataaataaagagcgctgtcttaggatttattacaataacaatcaggaataaactaaaaattactagttatttttgaaaggagaagctgagaacatttacgattgagaccatctgctggaaggtcctcctaatccggcgtcggcgtggctgatctcatatcagtttctcggcaggaagcgggtgcgcctgcgtgaatttggagtccccagggtaaatgttagtcccgtgacggcaaagtgtttttgatagctagagctcagtgttggcatgagttttcccacggggaagaggaagctttggtggggccacccttgactctcccctgctggtcactctttggagctctcttggcagtgacacgttcacacgacttgttgccattcccaatgagctggacagaccaacacctgcaggaaaccccacgctcagacacctgaacatccctcaactctaccttctctgtctaacaggaggtggcggcggtggctactccagttatggcaactccgacaacacgcacggtacccctacatctgggcatgcgatggtgggtggagggtgggaggggtcatctttctagggctcccgcttgcactctgccctgggccttctacctggagtctttggtgagtagggtgctgtgtgctggtgcctggtcttctgagaacctgtctgtgctgggctgttctgcttctgttccccaggagggtgggtgcagccacacatacacacacgcatacacacatgcacacacacacacacacacacacccctttaggtaaaagtaaacagagcaaagaactatacaactaattagagaaagagagcatccaacaaactggagagcatccaacaaattctttaggggcgcagctcgcttacttcaagcagaatagaaaacactttcaatggctgggcgcggtggctcatgcctgtaatcccagcactttgggaggctgaggtgggaggattgcttgagcccaggagtttgagaccagcctggacaacatggaaaaaccctgtctctacaaaaaatacatatatgcaaaaattagccaggcgtggtggcatgtgcctgtagttccagctactcaggaggcagaggtaggaggatcacttgagcccaggaggtcgaggcttcagtgagcagacagagataagatcgtgccactgcactccagcttgggtgacagactgagatcctgtctcaaagaaaaagaaaagaaaagaaaagaaaaaaagcaagagaactcttttggtcggtgcttatgcccagagtgaaagccgtgttctacagaagccataaacaggctcttggcttggttgagtttttctcatggagaccaggggaccttgaaaccctcagatcctctccggtttggaaaacgactgaagcaaaatgtcatcactgagaaagaaaacaataacaaaacactctgtaggttgattttaaaccatcatctccgttttaacattttccctttgttaagagttttgtacaccttcaatgaattgagtaaccatcttttcttttttttttttttttttttgagacagagtttcacttgttgcccaggctggagtgcagtggtgtgatctctgctcactgcaaccttggcctcccgggttcaagtgattctcctgcctcagcctcccaagtagctgggattacaagcatgtgccactacacagggctaatttttgtttttttagtagagacagggtttcaccatgttggtcagattggtcttgaactcttgacctcaggtgatccatctgcctcagcctcccaaagtgctgggattacaggcatgagccactacacctggctaatttttgtatttttagtacagatggggtttcaccttgttggtcaggctggtcttgaactcctgacctcaggtgatccgccctcttcagcctcccatagtgctgggattacagacgtgagccaccatgcccggccttgagtaaccatctttttggttaaaactaatatgtgccaagagctctggtaatgtgggaagtacttttttttctttttctttctttttttttttttaagatatggtctcattaggctttgtgagagccaaggctgttggccccctaagttttctctgaatcactgacatgaggcagcttaattaacaggagaaaaagcgtataaatttattgagtggatatacacgcaaaccttcagaaccaagactcaaccaccaatgggatgcaaaagcttatagaccatcttttttaactttgatgttaggttcaggggtccttgtgtagggttgttacataggtaaattgtttgtcaccggggtttggtgtacacattatgtcatcacccaggcaataagcatagtacctgataggtagtttttccatcctcactctactcccaccctctgccctcaagtaggccctggtgtctggtgttcccttctttgtgtccatgttgtcaatcgagaaaaatgacgagacgagcgtaaaagatttatttgccaaagttaaggttaagggcgcgccccaggagacaggtctgtggccttctccgaagatgattttgaaggctgcaaatttaaaggggaaagggtgggggtagggaaaaagagttattcatgcttttgtctggctcagtgaatctgtgtttttttacataagatggcatagacaaatggggcagagggaaaatgcagggaatctgcatgttgcataagataatctggacaaaatggggcaggggagcaatcacatatgatttgtgtctgctgggcgggggtgactgcaaagctgtcgatttgcatattgtcatggtgaaatcttcacagctcactaggattttccttgtgggcaaaatatgggggagacgtgtagcttttcatcttgtagccattttatttaggaaccaaaagggggaggcaggtttgtgtgacccagttcccagcttgacttttccctttgactaaatgagttcaggatcacaaaatttaatttcctttcacaatgcgtactccgtgtttagctcccacttgtaaatgagaacacatggtatttggttttctgttcctgcattagtttgctcaggagaatggccaccagctcgatccatgttgctgcaaaggacatgatcttgttcttttttatggctgtgtatatgggccacattgtatatgggccacatttcccttatccagtctaccattgatgggaacctaggctgattccatgtctttactatttgagtttgctatttgttgttctttgcaggaagaatgtgggctcagagcatggccccaaataggtgacgttggtaaagcaggtttaacgggtggcaagccaggtgatgagagggagacaggaagaggcctgcttagcaagggggtccttgttatgcagatgaaggttcccaggtagcagcgctcagagacgaccatggtaaatgtttcttttcagacctgtaaaggtgtcagagtctccgtttctctctcctacatccaggaaaagcttagaaagggaaggcctggctgcaacagcaaagatcctctacagatgccaatttccccacctcagtctgctggccctggagcggcaatttcaaaataaggcaaagcaatatattttggagtaaaatattttgatgtccgtcatcttcgttacctcggaagcgagtgttgtcatcagatccatttaacaaaatgaaagcaatgcatgacgctcgactgtccacttcaaaggagcaatagctgtggccctataggtagcccatcctcagaactcactccctatgacacagacaagcttcaggatgggagggggctcatgacaaagtgctcattacctggggtcaagaactgtctacttttggccgggcatggtggcccacgcctgtaatcccagcactttaggaggccaaggtgggtggatcccttgagttcaggagttcaagaccagcctgggcaaaatagtgaaaccctgtctctacaagaaaatacaaaaattagctgggcatggaagtgtgcgcctgtggtcccagctactcgggaggtgtaagtgaccctggaagtttgaggctgcagtgaaccgtgatagcaccactaccttccagcctgggccatggagtgagaccctgtctcaaaaaaaaaaaaaaaaaaaaaaaggacactaaaaaagaattgaccaccttcaactcaacgtactatgagatgagttccttccaccatctttctggaactagctaaggggttccccttacctactacctaggtagacctgatttattaagacgggaatcgcaatagagaaagagtttaattcacacagagctgactgaacgggagcatgtgaagcagctatgctgtctggggtacatacctggggttcattgttgcacgctgagaaagaattcaggacacagacacatgtggttgggttaaggagttgaaagtttaatagaagaaaggagagaggagagcagctccttgcaagagagagagggagagagagaaagagagagagagaaagagaagcatctgaaaaagttgggaggttgtggaccgcagcagcttttgtaggcaggctggaggaggtggtgtctgatttacatagggcttacagactggttcgatcaggtatgacttctacatagtgcgtggggaaggctggtggccccaccctaattttgttatgtaaatgggctttccagttggtcagtgccatcttgtctgctacttactgtacatggggctgacaaagaggagggaagatgaagctgccatcttgaacgtgtctaggccctagttcctgccggcattcacccatgtaagctcctagctggcttgtctatgtctgcagctcaactttattttttattttttatttttttttgagacggagtctcgctctgtcgcccaggctggagtgcagtggcgtcatctcggctcactgcaagctccgcctcccgggttcacgccattctcctgcctcagcctcccgagtagctgggactacaggcgcccgccaccacgcctggcaattttttctatttttagtagagacggggtttcaccgtgttagccaggatgatctcgatctcctgacctcgtgatccgcccgcctcggcctcccaaagtgctgggattacaggcgtgagccaccgcgcccggccacagctcaactttacaggctgctctttgttagaaaatgatttggggctgcttttcattaaaaagaaaagccttaccaaggactcccatacccttgctatgtgcctaagtaattaactaattccttcttaactcctatatcaactggaggttttgcttttttttctttaaacagggtttcattttgttacccaggctggactgcagtggtgaaatcatagctcactgcagcctcaacctcttgggctcaagcgatcctcccgcctcagcctcctgtgtagctaggaccacaggtgtatgccaccacacctgcctaatttttaaaaaatttttgtagagatggggtctcactatattgctcaggctggtcttcaactcctggcctcaagtgtttctccgacctcagcctcccaaagagctgggattacgggcatgagccactgcacctagccaagactggagttttatgactcaaatcagcttcccccaaaatttggacactgggctttttaacgtgtaatttggctggtaggagacccgggcgtggggagtgctgagtggttggttggaggtggaatgacagaggacggacatgggttctttttgttgtcttctgttcttgtgtgggacggcagagctcgctgagccgcattaccagtctgggtggcgccggctggtgcatctcaatgaagggtttaaaaaatgtctcaacttcaaccttaggttttacaatagtgatgccatccctaggagcaactgaagaggtttggaatcttgtggcctccggctgcatggctcctaacctattaatataatttctaatcttgtgactaatttgttagtctttcaaaggcagtctgatccccggggaagaagggagtttgtttcagaaaagggctgttatctttgtttgaatgttaagctggaacttcctcctatggttatctgagtctgtgttcaggaatgaactagggctgttcgagggctacaggcacgatgcagtcggttaggtcagatctctttcactgtcgtaattttctcactgttataatttttgcaaaggcggtttcaatttaactgaaaatgtcaggcaaagaccaaatttaatatttttacagaaagccactgggagtagttttttattgttttattatttatttatttagagacagagtctcactctgttgcccaggctggagtgcagtggtgcaatcatagctcactgcagcctcaaactcctgggctcaagcgatcctcccacctcagcctcccgaggagctggggctacaggcacacaccatcatacccagctaaatttttaagaaattttttgtagagatggggtctcaccgttgtaactgcccaatgggtttaccttgccccctgcctaaacagggccgatttatcaagacagaggaattgtaatggagaaagagtaattcatgcagagccagctgtgcccgagaccagagttttattattactcaaatcagtctccccaggcattcagggtccagagtttttaaagataatttggcgggtaggggcttgggaagtggggagggctgattggtcaggttgcagagggaaccataggggggtgaagtgaggttttcttgctgttttctgttcctgggtggatggcggaactggttgagccagattaccgggctggctggtgtcagctgatccatccagtgcagaggctgcaaaatgtctcaaacaccgcgcttacgttttacaatagtgatgttacccccaggagcaatttgcagaggttcagactcttgagccagaggctgcacgacccctaaaccataatttttcttttcttttcttctttttttgtttttttcgagacagagtatcactctgttgcccaggcttgagtgcagtggtgtgatctcggctcactgcatcctctgcctccctggttcaagcaattctcctgcctcagcctccccagtaactgggactacgggcacatgtcaccatgcccggctaattttcatatttttaccagagacggggtttcaccatattgttccggccggtctcgaactcctgacctgaggcgatccaccctcatcggcctcccaaagtgctgggattataggcttgagccactgcgcccagccctaaactataatttttaatcttgtagctaatttgttagtcctacaaagtccaactggtccccaggcaagaaggaggtgttttcaggaaaaggctgtgatcagttttgtttcagagtgaaaccatgaactgaattccttcccaaagttagttgggcctatgcccaggaatgaacaaggacagcttaagggttagaagcaagatagagtcggttaggtctggcctctttcactgtcatcatttcctcagttacaatttttgcaaaggtggtttcgccacgttgcccaggctggtcttgaactgggctcaagcgatcctcctaccttggcctccataagtgctgggattacaggcctgcaccaccacatccggcccaccttggagcgtgttatataaagcgagccgtccccacacccctacagcctacgaatgagccttttcaccccatgcacgattctctgaaactgctctctgtaaggagctattcgggacacgttcttttgttctctggcatactcatcaggtagaaagaagtgattcagcaagcggctcccctgagagccctgatcgtttcctgttttcctgtgaagttagtctcgggaggtctgcgctgtgccatttttgggggaccattatctggctcccgaatggatcaaagcttactggtcagggggctgctgtatccctggggcaaaactgccagaaaatagcaggtagccctgtggtccttggcagggccagggcccggtggaagcagcagctgggccaagaacatcaggcgtgcatgaggcacagcccagttttgggagcatgacgcttgttttcgaggatgcctgtgctccccttcctgcctggacccctgctctccagccccggcagagcgaggctgtgagtcagcgctcggattagcatcagcatggaggtgccggctgggatgcaagccgccgccatgggatgagtcacgcggcttctccccgaatccccaaaggaggcagagcgtgttaggcttgttctggcttcatgcagagcactgaggggtgagggctgaccgtggctggccgcggagggaagcccaaagtctggcctccctgcggagactggggagaaaatgttgcgctcgtcgtttttaaatactgggggacaagtttcccttgtctgctaaggctgccattgtaaattacaagagtcaggagggctgaagcaaaagggatttcttctcccacagtcctggaggctggaagtctgagatcaaggtgtgagcagggctggttcctcctgaagcctctctccttggctcgtcgacatcatcatctccctgtgtcctcacagggtcgtccctctgtgtgtgtctgtgttccaatctcctctccttatgaggtgtcttagtccatttcaggctgctatcacagaatactatagactgggtggcttagaaacagcagacattgattctctcaccgtcctagaggctggaggtccaagatcaaggtgtgagcagggctggttcctcctgaggcctccctccttggcttgtagacaccatcttctccctgtgtcctcacagggtcgtccctctgtgtgtgtctgtgtcctcatctcctcttcttataaggtctgtagtcctattggattagggcccaccctagtgatctcgttttattttaatcacctctctaaggacgttgtgttcaaatacagtcacagtctgatgccctgggggttaggactgcgacctgtgaatttggagggggatatagttcagcccatagaacccactatccacataagtcattccacttcaaaatcagcacaaagcattagttttaaaaatctcaaatctgtatttttaaaaattgctcttaacacattagaaaaatatagaaaaactttttttgctgtttttctgagacaaaatctcactctgtagcccagcctggagtgcagggacgtgatcatagatcattgcagcctccacctcctgggctcaagcaatcttttgcctcagtcgtctcccaagtagtagctgagactacaggtgcacatcaccacacccagctattttttttttttaagtagaaacggggtctcactatgtttctcaggctgggctccaaatgagctcaagtggtcttaccgccttagcctcccaaagtggtaggattacaggtgggagccaccacacccaacctggaggaactctttttttttaaaattttaaataaattactatttgtggcctgcgttttcatcctattctctttttttttaaccaacatttgctggcatttttttttatgccgaagaaaacacctttgcccatctatgtcaggcctccagaccctcagggatgtacatctaatgcaccttcagccaccggtgtaaacagtaaacaggggccagatggcgcctgtgcaccttccctggccttgggagagcattggaatctctgcagcttttaagagcatcttgcttcaggtttgctgacctgcttgcttctgtaagatcatgcagacttcctgagcaatatctagcatttcatggtctcttttctatcctgcaggaagagggggctatagactcaactctcgttatggaaatacttatggtaaaggaattatgtcttacagaatatgtgaggcaaaactgtccatttgcaaataactaacacactgtctgcactgatgggaagctgatgctttcatccagtgcacaaccaactggccgttcgagtctctcatttgcattttccttggtcatccatgctggggggagatgttgtgcatgccctgaggacttcatttcttcaaaggaactatggcccacttacaggtgttactgggtgcatgtgtgtgcacgtgtgtgtgtatacatatgtgttcacacacaggtatgcttgtgtgtattgtgtgtgcatgcatgtgtacatgtgcatgtggattttgtaatcatgtgcataagtgcatgtggatttcatgtgcatgtgtgcaagtgtctgtgcacacatgtggattgagcacatgcatgtttgtgtatgtgcacagatgtgttggcatgtacttgtggattttgcatgtgtgcatgcttgtgcttgggttgcatgtgcattgcatgtttcccatgtgtgtccattcacatgcatacatttaggggtgtgcaagcacatgtgtgcatgtggatagatgcaggagtgtgcatctgggtgtgctcgtgtggtatgtgcatactgcacgaatatatcatgtgcatctgtgcatgtggattgtgtgtatacatgcgtgtgtacaggcatgcacacacacacatgaatgtgtttgtgtgtgcatatttgtgtgtacatgcatgtgtttatgcatacaggtgtaaacatgtgcacacatcggtgtgtgcatgtgcacacatgtgtacatgtgtatgtttaggcgaattgtgctttatatgtgcttttgttgcctgtgtgtgtggtatgtgcatgtgtgtgtatgtggggatgtgtgggatgtgcatgtgtgtggatgtgcacattgcattgtgcttctgtgttgcatttgtatttacatgttgcacatgtgtgtaaatgcatgtgtgtgtgcacgtgtgtatgcgtgcttgtctgcctgtgtgttgcacgtttgttgcatgctgcatgtgtgtatgcatgtgcacacacatttgtgcatgtcagtgtgtgttgcatgtgcttgtgtatgaatggcgtgcgtgtgtgcatgtgtgtccatggggttgtcagcctgtgtgtgttttgcatgcgcatgtatgtagactctccaatcctgaaattaaagctgcatctccctctccctggtattatccccattctgctaatgaccattagacatggcatacacattcacattcctcctccttatgctgcttggctgtccccctccccccacaagaatgtaaattccctgaaaacagggatctgtgtgctgtgttcacagtcgcatcctcaacagtgcccggcaatataaggccctccataagctctgctgaataaacacgaacatccttttccgcttacaggtggagatcaccattcaacgtatggcaatccagaaggtaactgattgactcacccggtcccaacctttaataagagcacactctcctagatcagtgctgggaggagctgtgtgggcttctgtttcccaacctcatgactttcacggagcactcatactttgtatgtatataaagtagctcctgaataaaaatatctgaccttcagcacaggaccaatcagagttcagagaaaggagaggcaagcattggttttcactgcagaagatgccccttagctctcaaagcaaggctgtgaatgagtgctgagactattacatttctcccagtaccaccattactcccctttctttgaccagcactaacttgaaacccaagaaggacaggagaaaggaaggtatgaacactctgcccaaagaagccatcagagtgcactgtcaatcccgtctcaggtcaaaggagggagaacttgaagcccagaaggctgactttgtgtcctgtattgttgggagaacaggttccccattccctaagggtcatattcttagagatttgggctgacacctgcttgagtttaagttgagagtaaacgcactcaaccccaaggctcttgtgagttttcaattatgggggaggagaaagtgattgaaggtgacctctacctttcaatgatcatgcagagtactagtatcaatatttttggggtatgttggcatccttagaaaaatttatggtttcacctttttccctctgtggtgtaaagtgaggtccagagatggaaagggcaaggcaaataaacaagtaattgcagtcaaatctgatgaataatttcctggaacatatgggatcctgtagcaaggcagaagggatactcctagactaggttaggtgagggaggtagggtttcctggagagaacaatatccaagccaatcccccaaaatatgggtgggaggtgcccaggagaagagtgaggtgtcagggaagatggtgcactaggtagagctggatacacacgtggggacaccggaaattgtgtagccaggatgtggaatgcaacgggaaccagggaaggatgcaatggtgaccaggaaagacctccaggttagcagaggtggagtctgcacttcatagaaccttcatgggaaggagcctgcccctgttgatatgtaggtgaagaatggacctgagggggctcactaagacccagggagacaccctttcagaccagttcagtactccctggaaatgatgacaggctgaattaaagcctgggcaaaggaggcaaagagaagcagtcagcttggatgaccacttggtaatgacaattgattgtacttgattgatttgtaagagatgagagagaggaaaaggtatgtatcagtcagctatgctgtgtcacaaaaaaccccaaaacttagtagctggaaataacaaccatttattatgttcgtgattatgtgagtcagcaatttgggctgacaccattctagtggtcctcctggtctcttctgaactccctctcttgtgtgcagtcaactgtaggtgtggccagcgctttgaccatgtttcctgggtcttcttatgtatctgggactttaggtggaatggctcatctcagcttcatgtgggctctcacatccctccaggaagccaggccaggcttcatcacatggtgaccagacagggtaccaagagcatgaagagaagcgtgcctgggcttagagccaccatgccttcacttgtgtgacattctgttggctaaagcctggattttcagaatgaagatgcagctccacctctggatggggaacactgtgaaatcatactgtggagcgtgttcatgtagggaggggaagaatagagggctgtctctcccaggaggcagggtgtggcgggcggcagcatcagccgtagagcaggttcttgcgttcagtgacaacactcttccccccagcatggcagcctcattcgtggagcagtcttgtgtccctcacctatgccatgccatgtattggcccaggtgttcaaccctgtctgaagaaagccatgcatggaaagggtggctatttcaaatggaaacggtgatttcttccttttttccctttggaagtgttgatttttgtcacatcaagctccttcttgttctttgtgcaggagtgccaaagctctggagcaatttgccatcgaggcattgaggatgcttgtgtctagtgtgtgcttgggtctagagttccagcatgcctttgaaagcaagcctatctggcagtttttagtggaacaatatttttgcatgagtgggcattctacatctaaaaaggcacaaaatagttttgacatgtgcctgtcatcccaactactcaggaggcggaggcaggaggatcacttgagcccaggagttcaggacgagcttaggcggcatagtgagaccccatctctaaaaaaataaatcaggccaggcgcggtggctcccctctgtaatcccaacactttgggaggctgaggcgagtggatcacctgaggtcaagagttcgagaccagcctggccaacatggtgaaaccccatctctactaaaaatgcaaaaattagttgggcatggtggcatacacctgtagtcccagctattcgggaggctgaggcaggagaatcgcttgaacccgggagaaggaggttgcagtgaactgagatcacgccactgtattccagactgggcgacagagcaacattccgtctcaaaaaataataagaaataaataaataaataaataaataaaattaattaaaaggcatacatgaattgacttcaacaaacaaacaaaaatgccaagtgcctcgtctgtgcaaatcctggccttggatgtcttcagtggtaaaatgtggttgacaagcttggctctttgtgaaaacagaattacttcctaaggtttttttttctttttttttaaattaagtttctcttttttttctgtgaatacaagggtgggaagggacgtgatggagaagttactagatagatgcaaaagttattgcagtttttgtcattactttcaatggcaaaaaccgcaataacttttggaccaacctaatatttaagcagttttcctgcagccatgtttttttctcggatgagcttgctttttctccactcctgcaggcaatatggtagcaaaaatcgtgtctcccatcgtatccgtggtggtggtgacactgctgggagcagcagccagttatttcaaactaaacaataggagaaattgtttcaggacccatggtaagtttggctctaaacattgttttgcttgttactaagcctgatttaaaaaaaaaaattactttcagatgtctgtcactagcaaggttatttctggttaagttcaatatacataacttgcctaataatgtgattttttaaaatttatttttattctttttgagacagagttacactgtgttgcccaggctggactgcagtggcaggacctcggctcactgcaacctctacctcctgggttcaagagattctcttgcctcagcctcccgaacagctgggactacaggcatgcaccaccacgcctggctaatttttgtatttttagtagagatggggtttcaccatgttggccaggctggtcttgaactcctgacctcaagtgagctgcccgccttggcctcccaaagttctgagattacaggcgtgagccaccgtgcctggccaacaattgggttttcatggtcaggtgtgagctgtaccttcctctaaaccttgttacaatgaggctggcacattatctgtctaatgtaaaagaggaggagaaaaaaaggaaagaaaaagaaacaaacaaacaaaaattaccaacctacattgcaagactataagcatgacggttggtttaactacctgttctgttttgtattcagtgaaattttcgtcacaggcgagtcaggaaaaatacctgggttgaatgtgaatgttttgcccagaaccccacccgcaaagaaaactaccgaaacactgaattataagcctctctgaaattccgaaggtgcgctcagaccataggggagaggaaagatctgctgtggcttcctggttcaatgccggctccacactcctgggtttgaagaatcacttgggatttgagagcagaggatgccctaaagaaatctctgaaacaacagtcagggattgttttatagcctaaagagtgactcagatctttaactgggtgtctctggaggcttggtttaaacctcaggccacccacgtcagaatctgtctggagtttgcccagggccctctaactcataccttctttgtgtccccgaaggaaaccagaaaggggtgcccattcctacggtgtttgctttaggatttgcatttggcctcaaaaatcctaaaaccttcccatgcgctccctctgctggtgaatgggcagtatcaaccgttagctaatgaacctccgtttggggtgagcctccgtctacattacgccccgtcctgaaattttaggaggaaactgagtttctgaaaaactgccttattttcctggcaacctgagagcagattcttgggttcagtgacaacactctttcacccaacatggcagccatcattaacgaacaccacgtgttaacttcagtagcttttgtggcagtgatttgtaagcctttgttaaccaagggctgaaactgagtaagcagagagaggcacccatctccacaagcacaaaatgtaagggcggggtacaggggtcccccacaaactcaataatcaaggcaaatatattttagtgcaatattttagaaggaaaatcattggaatgggggccagttgagtttctgaaataggtgtagttttaaaaacgtggatgatgcctgccccatttatctgaggtggaaggaagcacgtttttgctaaagaggtataatgtcttgaagctctttcatgccttttggctgcctggtaagtatttttgtctactttctccattgtacttcgatgataccctcaccaggtattcccaagcaccaagtttatcttcccctcccttaaagttcctgagatcagaaaggaggatgtagacagagtgagctgatgttagggagatctcttcaagggtgagcagtgacatttatgtggatcctgggcctatatcacctcgctggctgtaaagcctttatactatctaggaaatatgtgcatgacagcaaatacgtatgggtttggtatcaaatggggctcagagctctgcgaacttgactctaaagttccaggctgctgctaatggtacccagctgtccacctctccttagttaggtcattaattttctctgtctcctaaaggatgacgtacatggtatactaaccatatccatggtgatgtggtgcagtgcacaacctgtggaactgtgtacctgctgaggccatacactgaagcttgcacactttgtagagaaagagttgtagtaacagagctacacagatagaagcagatgtctgtcacttgatgtggacttttaagaatcatactttgcttttattttataaagtggagcaaatgacaacatcacttcagaagttataaagaccaacaaggccatattcgaaaaaagaagttcctacaaatattagttttaaccaaaaaggaagttactcaattcatttaagatcatcaaaatccttaacaaatggcaaaatgtcaaaaacaatgttttcaaaacgaatatttgtttccagatatgattttaacagtttttaaatattttctatttttaatttttcctgctttattgaggtatagttgacaaataaacattgtatatatttaagatgtacaacttcatttctgcatcatttatttgttctaatctatctccttctgccgaatgtaaagcaggtgtcatgtagacagcacatagtctgatcttggttttcttttttttaaaatagatttttcattcttctagctttattaaagtatgatagacaaacattgtatatatttaagatgtgcaacttcatttctgcttcatttttttctgttctaatcttccttctcctaaatctagagcaagagtctcttgtaacagcatagaattggatcttggttttctttttctctgtttaataagacttttttttttgcccccacaatgacatttgtttctaatcttcctttcagaaccagaaaatgtctgaagatgttaagatcccctgattactttgagaaaaacaactaaaacaagaaccgtgtttatcactgttgtggagatttccttttattcttgacacaatttgatgacctaaagtgtgttttcttctgtgtaaagtacatgagctgcctcactaagcattcccaactcattgaatgtgatgtggttataaagataagttaggcagctagaccctgcgttctaaaaaaggattgcttgcaatgttggtttggctattcatttgcacaaagagactgtggctctctgttgtgagatcttcagctacctcatggtgcaataacacacacacgcttaaccatgttgatggcacaaagcggtgagcagtagggaggtagaatatcttggtggggaggggatgttatcagcttctgggagatgaagaatattgttgaggttccaaagatgctggacctgtgctaaattcttcagtgatatgaaaaaatcattgagcattcattattgcgaatgaagtggggatgcattatttctgacacccacaagcagggtttgatcatcctttcagctttgagatatctgcacataaaattattattacctgaagaaaataaggctgcattttgaaatgttaagtgcaaaatgactgatgttaaaaccatctgggggaaatcttgggatgctttttcctaggaaatcatatggttgtgatatgttttggcgcataggagacagaaatagtgattatcaggcgttgagcctttttgtagtatttttagtctttgatactctgtaagtgctagttcctaaggcaccaacattgcattccttggtttatactttttctattcatcagggtaggaagtcttaaatccttaggcatccaagaagtatactagctttttgcttctcttttagaaatacttgtggggagagaaaaaaggatggtttgggcatattggtatagtttgagtaaactaaggttaatgttcatataacatttagactttgccataaatatcagaaccaaagatcaagacattcatgtacagtctggaatgtatatatggggcccataaaaattcccagtatgcatgttttatgctcaccattatgaattggggtcttcaaagagagaaggttgaaagtggaaagcacttgaaagggctccccggtttgtaaaatatctttaatcattcacattaggtacctcggagttgcgggtctcaaatgtggattcatgcatcatttgtgcagtttgaagatagtccatatttcctatttcagtattaggtcctgcaacacttttcaattcttgtagaaggtttttttcaggagtggtgatgtctgatgctcaattactattttccctataagagtttcagcatgagcttaattaaattcttgtgaaaaaacctgtgtttttagttacacacacacacacacacacacctacttaaatggaatctaaacatttttagcctttaatccattccattttctaaaactgtcataaactatttttaatcattttaaataaatgtaaaagaaaaataa

SEQ ID NO: 2916 - DNA, 22700 bp, human
cctgtcttgcgttcctgtgttttctaatgcacgcccgaggtaagaggcattttgctttgagggagatctgcctgggcatggatttttctattcttgctttaagaaactctttccaaaggagttgctatgaagtgaatggggataatttgcccaatgggattagaaaggagactaagagcgatgggtggctgagaggggagggagaagacgggctgctcccatttggaatctgggaattagatccagaagggcaggatgttagctgataccatctagatattcgccatattttcctgttttgatccatgtgtcccaagcgtttaaaaaatgacctatttaactccatgattcaagcatgactgggtgtgtgtggaatgtcagtcatttctttctgattttaaaaattagttctgaccatttccatacagtaaaagtagagttgaaactacttcatcccgtggggcagattaccagagattcgtttgccggaagggttgcatttattcagatttttaaatcttttcctaaacactgtcattcattcttgcaaattaaaaccacctgaattgttcacatcaaaaacttcgatataaacttgcaggctggctgtcccagatccaagattagatttttcagttccgtacgaggacctctttaagaaactccaatgaactcataaagtacaggatttgaacaacggttgagtaagtttctttggtcattttcatgtggcgatttcagagaagggaacacctgggcgcatcttaagagagagaagtatttctgttaggagttaaaacacatcattcagatgtccctgtggcagcatttcctgtttatcctatttaaagacatggacgtcattaagattggagttggttgtttatgggcggaggcggtgtcgggatggatagatcctggtggacatagtctaggatctgcagtgagaattttttattattctgtgctgtcttcagatctcacctagtaagtggacaatgtggccatgcattcattagcttctgtttacagggagatgttcaacagtaaacccacctccccagaaaagtacttccaggagtttgtatcattcacagtaagagccaaaggttaaccatatccccttgggcaaatcaacttctacaaagtgcggatacagacagttcccaacttaccatggtttgacatgatggttcaatttaagatttttcaactttacaacggtgtaaaattggtatgcattcagtacaaacgaaaactgtactttgagtacccatacaacttttcttttttttttttgagatgtcgtgtcgtttcattctgttgcccaggctggagtgcagtgacacaatctgagctcactgcaacctccacctcctacgttcaagcaattctcctgcctcagcatctcaagtagctgggattataggtgcccaccaccacacccagctaatttttctatttttagtagagactgggtttcaccatgttggccaggctggtcttgaatcttgacctctggtgatccaccggcctcccaaagtgctgggattataaatgtgagccaccatgcccggccccatacagccattctgtttttcactttcagtacaatgttcaataaattatgtgaggtatgcaacacctcattataaagttgactgtgtgctagatgatttgtccatccgttggctgatgaaaagtgttctgagcactctgaaggcaggtaaggctaagctatggcgtttggtagggtagttgtattaaatgcacttacaacataaaatattttcttttttttaatgtgttttaatttttttgagggaggggcccactgtgtcacctagactggagtgcggtggttccatcatagctcactgcagtcttcaccccaggggttcgaacaaacctcccacctcagcctccagagtagctgggactacaggcatttgccgctgtgcctgactagtttttaaaactttttgtagagacgggatctcactatgttgtccaggctggacttgaacatctcagctcaaacgatcctcctgccttggcctccccaaatcttgagattacaggcatcagccaccataccctgtcctgcgctaaattctttgactgacggcagcacttcctatgcactaggcatggattaacttagttgattgtccctcagccctatgacgggagtgtcgtgcctgatgtcattttacagatggtgtattagtcagggttctctagagggacagaactaatgcaatagaaatatatatagagagaggagtttattaagtattaactcatatgatcacaaggtcccacaacaggccgtctgcaggctgaggagcaaggagagccagtccaggttccaaaactgaagaacttggagtctgatgttccagcatccaccatgggagaaagatgtaggccagaagactaggccagtgtctcttttcacatttttctgcctgcttatattctagccacagcggcagctgattagatggtgcccacccaaattgagggtgggtccgccccttccagtccactgactcaaatgttaatctcctttggcaacaccctcacagacacacccaggatcaatactttgtatccttcaatccaatcaagttgacattcagtattaaccgtcacagatatgggtaaactgaggcactgaggatttggacgggggcagccggcagcggaatctgagctgtcctgtagctctgtctgggaagactccagtgagcatcccgctctatcccaagccttgtcttctgaaaatcagaatcatccctcctccaagtgttacaggaaaggggtccggatccagacgccaagacggggttcttggatctcgctccataaagaattcagggctagtctgtaaactgaaaacaagtttattaggaaagtaaaggaataaaagaatggctattccgcagagcagctcttagagctactgcttgcccatttttatggttatttcttagtgatatgctaagcaaggcttggattattcatgcctcccctttttagaccatgcagagttcctgacattgccgtggtatttgtaattgtcatggtgctggtgggagggtaacactgaggacaaccagaggccactctcatcaccatctgggttttggtgggttctggccggcttctttactaccacctgttttatcagctaggtctttatgacctgtatcttgtgcagaccttcagtctcatcctgtgactcagaatgccttaatcatctgggaatgcagcccagtaggtttcagccttctattgcccagcccctattcaagatggagtcgctctggttccagtgcctctgacacaagtagcgccccttagggaggttacaggagggactggaaggaaagtgaggtctggatcagggcccttctgtgtaaataagatgatgtacatgcagcagctgggtatgtcctgggtaaaaattagttaaatgcacagacgaccctgtttcatccccagccatcaccagctggaaatggggcacattcccaagatcccaaaaacattctgcaaggctggtgcgatgattgctatgaagtacttaagaaaacagattattgttcaggatcaatagctaatgcatgtggggcttaatgcctctgtgacgggttgatgggtgcagcaaaccaccatggcacatgtttacctatgtaacaaacctgcacgtcctgcacacgtatcccggaacttaaaataaaataaagaagacagaatattgttaatggttaatatgctgtaaatcattatgatgattactaaattatcaatacaaaagaagataatagcaagacggccatattcctaatagaggttgacattttagcagccctacatttccactgtatttaattagtatttgccgtccaatccagaggggcatgaaggagcacgagacaaaatcaggtcttctaacagctgagaagaagctgagaaccagaagtggaaaccccaaagggcagtgtatgaaatgtcatttattgaggggaaaaaaaagaaaatgacagagttcgatagaagaaataagcactagtgtttacataatcagtagggtgactttagtttacaataatctattgtagacttcaaaatagaagagtcggaatggttctaatatgaaggaaagacaaatatttaaggtggatggatatcccaagtaggctgatttgatctttacaaattatataaatgtattaaattattacatgtaccctgaagctatgtacatctgttatgcatcaattaaaaataaattaaaagaaaaggatatatgtccaggatatacaccagctaagacagtctcttccaagtctattgtacattattcccttatcagatttgaaacctgagagttccctgacgccccctcacaggatgtgcaacaggggtgtgtttgatctgtttgaccgccacacactgaaacctcttatgggaggcagaacttgcagacgggcaggtgcagcagctagtgtgagtgtttttgagctctgggccccacggtagcatctagggatgggtgcctgcgacccccgaagccctagtgggcgttttacggtgctcttttagctctgccatccgcacgtggcttaagtgttagccagctcagtgccgtcttggtacccgggttcttgtccagcatccaggaagaatcaggtcacacgaaccagctgaaggatggtaaatgcagaagagtttgttgccagatggagatgactcttagcgggatggttggggagttggaaaggggatggagtgggcagatgatcttcccctggagtttggttgtcctgcggctaatctcttctccaaccatccccagctgaacacctctcagtgttcagatgttccttctcttctctccttctctgctgtgctgctctttggttcctcaccttttctgctcatctgtctgtctgcacatggggtctggggtttggggttatatgggtacaggacaggcaggcatggtgggtcaaaaggcaacatttgggcacaaaaataggaatgcctgtttccatttaggactacaggtttccaggcttgagggcggggcctttgctggggaactgccctcttgtatctagtatcttcaggcctcctgtccgtatcaacatgacttaaaatgtgtgtgcatttgtatagagctgtgtttctatgtaaagactaaaaaagacttatgaaaaagatcactcagagctctgaacagtagcaaatcatatttctgagtacttcctgttgagtaaaggtaagtgaggattgtgccaagtatttttcattacttgctgcattaggttgtcacaggctgtttagtttacttctaaaaattgggatatggggaagttgtgggccgggcacagtggctcatgtttgtaatcccagcagtttgggaggccgagttgggcagatcacttgaggtcaggagtttgagaccagcctggccaacatggcagaacgctgtttctactaaaaatacaaaaattagccaggcatggtggggggtgtctgtaatcccagctattcaggaggctgagacaggagaatcgcttgaacccaggaggcggaggttgcaatcagctgagatcataccactgcactccagcctgggtgacagagtaagactccatctcaaaaaaaaaaaaaaaaaaaaaaaaaggaaaaaaaagttatgatgatcgcctaaggtgagaagccataccacgccagcgtacagaaccccaaaccacgccagcctcatcctacgtctcagttatatttttcttgacttgcttccattctggtgccccctctctccctgccccctccttccctgcaaaggatctagcaaatttgtaggtgtggaaagggaaccacaaatgggtcatttccctgccattgtcacctggagcgtgtagccatttcgtgcagtgattctctgtctttgatgtgcaggtcatcaccttgaagggaggaggtattaaaagcgccacccagtccccacccactgaggtctttattcagcaggtgtgggtcaggcatttgggagctgggagacctgcattttaagaagcaccccaggtgatgcccaagcggagctatgtgcttcttttaagagatgatgactccgtgtgcaaccgtgtggttacctttgcgtggagtctcatggatcactgccacagtggggaggcagctctgtgctctccaattcggtgatgtgtcattcactctatgcaggcccaaggtgacacccccagatacaggtgctgccatccagccattctcaaccagggatcatgtttatccacagggacacttgtcgatatcttgaggctttgcgttgccacactgatagcagggatgctgctggcatctagtgggtggagcccagggatgctggtcaacaccctgcagtgcacaggacgccccacagaaaagaatgatccaacctcatatgtcagtaggactgaggctgaggaatcttgccttagcatgagagatcctgtctgtctgtctgcctatctctagatctatctatcgtctaccattatccatccacctatctgtctctattatatacacctatcatctacctaatctatctgtcaatgattttctgtcatctattatctatctatttatctatctttctacctacttctctatccaactctcatctctattacctatctatgtatctatgtatctatctatgtatctatctatccatccgtctatcaatctatctatttatctagcagtccatcatctatctgtgacattcttctgctacccagggataattgtgttcctcgagtaacacttggcaatgtctggaaacaattttggtagttgcactgggatgggtgttctcgcattcggtgggtggagacaaggcatgttgttcaacaccttacagtgcacaggacagcacccatgacagagagttacgcagccccaagtgtcattagtgctgtagtggagaacctgctgttagttataacttctaaccctgcgaaaggggacaggttggaaatgtcatgctcctgtacgctgtaggaggtatagttgtctggaggtatagttgtctggaggtatagttgtcctgtacagtataggaggtacggtatagttgtctgggcatttctaaatggatcttactgtcagaatgcacttgtaggatcttttccccatagggcatagagccatggcacatataacccagaagctgagcattccatagtttccttcttggagtaggaaggggctgtgcagaaaaagtctatggctgtttggcacctgagtgtgaagacatctggcaaatattggagccaattagcagacaagcacggagtccaagaaatgtctcccctttcttggataacaactgacccttcctgtgagggcccccctcattccagccattttcctctttctcattggcacacagggggtagaaaagtggggttctgcctgcaggtggggctctgccagacacggcaaagctcctggggattcccccgatggatcaggggccagaggcacctaaacctgtgagcgatgtgtgcagccacggtgctgaggctgggaaactctgctgtagtctgtgaatcccaacctctgggaatgcttcagaatcagattctgggctgatctggaatctgcatgtggctggattctggtctgatccaggcatggaggcgtgtgcctgtaatcccagctactcgggaggctgaggtgagagaactgcttgaacctgggaggcagaggttgcagtgagctgagattgtgccattgcactgcagtgagctgagattgcaccactgcactccagcctgggcaacagagcgagactctgtctcagaaaaaaaaaattaaggaagagtattattgagagcgtaggccaggcgcgtgatgttgctgagatgaaactgtctctctagattcccaaaccctggttatctccactgaaccaggctgtccaatggcatccccattgtaattgaccatgttccatggtttaaatctgttgtgagccaaattgtaccctcctcaattttacaaatggaagtcctaacctgcaggacctccaattgtgactgtgtttggagatggggtctttaaagaggtgattcaggctgggtgcggtggctcatgcctgtaatcccagcactttgggaggctgaggctggcagatcatgaggtcaggagatggagatcatcctggctaacacggtgaaaccccatctctactaaaaatacaaaaaaaaaaaaaaaattagctgggcgtgcctgtagtcccagctacttgggaggctgaggcaggagaatcgcttgaacctgggaggtggaggttgcagtgagccgagatcgcactactgcactccagcctgggcgacagagcgaggctctgtctcaaaaaaaaaaaaaaaaaaaaaagaggtgattcaggcaaaatgaggtcactaggttgggccctgatccaacaggactgcagaccttataaaaagacgagatgaagacacagacatgcacacagggacgatcctgtgaggacttagggaaaagatggcatccacaagccaaggagagaggtctcagtaggaaccagccctgcccacaccttgatctcagacttccagcttccaggcctgtgggagaatcaatgtccactgtttaaacagcctggtctgtgggactttgctatggcagcagccacagtggacaaacacatttgtattccaatgaatgagttacctctgtaagggttgaattgtgcgtctccaaaatttatatattgaaggcctaatccctaggacctcagaacatgactgtgtttggtgatggggtctttaaagaggtgagaagggtacaatgagctcaggaggttgtgccctgatccaataggactggggtccttataaaaagagtagataaggacacagacacacacagagggatgaccctgtaaagacacagggagaagagggtgtctacaagtcaagaagagaggcctcaggaggaaccagctctgcccatgccttgatctcagaattccagcctccaggactgtgggagaataaaagtctgtggtttgtaagccacccagcctatggtattctgtgatagcagcctgcaatggactaagacatctcataagaagagcagatgaggacacagacatgcacatagagggatgaccacgtggggacacagggagaagatggtgtctacaagcccaggacagaggcctcaggaggaaacagccttgcccatatcctgatctcaagacgtccagcctccagggctgtgggagaatcaatgtctgttgcttataagccacccagtctatggtatgctgtgacagcagcctgaaatggactaagacacctcataagaagaggagatgaggacacagacgcacacagagggatgaccacgtggggactcagggagaagacggcatctacaagcccaggagagaggactcaggaggaaccggccctgcccacaccttgatctcagacttccagcttccaggactgtgggagaatcaaggttgttgtttaagctgcccagtctttgggattgcattgtaacaactctgggaagccattaccaagtctctgtcctgcaaagtgagatccatggatctgcagccttgacatcccctgggagctgatgagaaacactgtgtcttgggcccagacagacctgctgaagcatagtctgtgtgtcacccatgtcctgagggatccgtgtgcatgccactctgggaagacgggtttataacacaccgtcaaccagtgcctcattgcatggtctgcggtattttcctcgagttttccttgcaccaaagatgtcttgctttttgtgatgaatgatcattccttcctcttcgacgacaaaatacttcgatctctgcagacaccgtctgttgtgttacagacagacactgaggcctgaattctcattaccaatgtctgctctaatagagcttcaatctgcaactgcataatatggtcactgggaagtcaagaacggggccagttggttgaccttctggggagaggctgggctgcttggatgctgagaccgtggagggttcatgggttccgaggagcagatcatgcaccagggcggcctgctcagctctggtgtctgcagccccggtgagcttgagcattagggagtccctggatattcatgttgaggtgtggaggaggagactccagctgtgtttgatttcctgtcctgctggaaatataaacttcttaaccaattagagaacagaatggatttcatcttatccatggggctaaagtagaattcagcccttggcaaacaagccccccgggaataagattccccattggggcagcagccttccttgtcactttctgttgcaacctacggtcctaacctagtcatatgatttaattttttttactctgtgaatcatgccgtcctgggagagagtgagatggagcaaggacaaccctcttaggggcctgccaggcactctccctagcatggaaataaaggaaaaccttgagttccttcaagggaaattccaggcacctcgctggccttgagaagtacatggagcagcttgataagcaagaaggtgattgtagtgtagaacaatagccaaggaagttagagcctcaatatgtttagtttcctgtaaagactaaagataacatccttttttgagatggagtcttgctctgtcacccaggttgcagtgtagtggtgcaatcttggctcagtgcaacctccagcacctcctgggttcaagtgattctcatgcatcagcctcccaagtagctgggactacaggtgcacaccaccacgcccacatttttgtatttttagtagacacagggcttccccatgttggccagtctggtctggaactcctgacctcaggtaatctgcctgccctggcctcccaaagtgctgggattgcgggtgtgagccaccatgcccagccaagataacatcttactatatggccctgagttgattttcaggaacccagacccccaccaaataaaaaatgccatctgctggctcatagacgttgggtaagagaaactgaggcctgaattctcattacaaatgtttgttctaaattccttccctggggcatgtggcggtgggaggggggtggaaggggggtgaggggacgtgctggaggaagtcacaccaatggccacaactaacattgatttctgctgaccccaaatgctcagacaaacttggcctccttaaccaatgacaaatcagagaaactttgaatccacattaagcccctgcttccaggtatcccgcctttttagatcaaagcaatgtatagcctgcatgtattatggctttgcctgtaacctctgcctccttgccattgaaaaccctcagctactggccacccaggaggttgggtcttgaggcatcaaggaggttgcttgatgccctctaaatagctcggaataaacgcctcacttcctcacgctgcaatcccaatggcggtgttcggctttactgcacagggccggtggacctaagttgagttagtgggaggtgttcgaaccagggcaactccaggttgagtaggggctgtgtaaaatgaggccgagagctgccgggctgcattcccggatggtcaaggcattctaaggcacaggatgagataggaggttgacacaagaaacaagtcataaagaccttgctgatgaaacagcttgccgtaaagaagtcggccaaattttaccaaatccaagatggcgatgagagtgacctcgggtggtcctcacttgtgtcttcccaccagcaccatgacagtttacaaatgccacggcaatgtcaggaagttaccctatatggtctaaaaagaggaggcatgaatgggccactccttgtttagcatatcctcaagaaagaaccatacaaatgggcaaccagtggccctcggggctgctccgtctatggaggagccattctttattcctctgcttttctaataaacttgctttcattttatggactcgccgcaaattctttcttgtgcaaggtccaagaaccctgtcctggggtctgattccagacctctttccggtcacaagttcagtcacaagaaccattatcatatgctttctatatatacacataggtattttttaattgctgaactggagtcaaagagaaaccttaggatttgcctgaaggaagtcaagatttgtccttctcggggtccctgtgccagctttgtaaaacctcggaactttcccctctgtgggcttcctcaagctgaggagggctctatgggcttagtacccactaagtggcttcatctgcagcagctgacccaagaaagttgatttaaatgaacccacacttcagaggaaaccagtacaatccgatgtaaagaaataaaaaataggccgggggcggtggctcatgcctgtaattacagcactttgggaggccgaggcgggtgaatcacttcatgccaggagttcaagaccatcctggccaacatggtgaaaccccgtcattactaaaaacacaaaaattacctgggcgtagtggcatgcacctgtagtcccagctactcaggagactgaggcactagaagcgctcgaaccagggaggcaggggttgtagtgagccgagagtgcgccattgcactgcagcctgggcaacatagtgagattctttatccaaaaaaaaaaaaaaaaaaaaaaaaggctaggcacggcggctcatgcctgtaatctccgcactttgggaggccaaggtgggtggatcacgaggtcaggagtttgagaccagcctggccaacatggtgaaaccccatctctactaaaaataaaaaaaattagttgggcatagtagggggcgcctgtaatcccagctactcaggaggctgaggcaggcgggagaatcaattgaacctggggggcagaggttgcagtgaacagagattgcgccattgcactgcagcctgggcaacatagtgaggttctgtatgagagaaagagagaaagagggagggagggaaggaaggaaggaaggaaggaaggaaggaaggaaggaaacaattgcttgaaagggctttgtttcaccagggcacgcagatcaaaggacattggattgaataatgaaacagaagagcctgtctgaatttactaatgtggttgcacgtcccgtaatgattgcagttggctctaattcagttccgtggtgtataaattctgctggcaatagctgtaattggggtcagggatttagatagtctctgtgtgttccttttcattttctgctcagagcctgctgggagctgattttcttctttaaagcgaggtaaataattcagtggggagcagaggttttgctgtgggtccattgctctcctgtgctgcgtggcagctgtgctggtggcagctaatattcagtgggcagtggcctcgacattgcattattattcgagcaatggtactgttctttgctttgcaaaattgctgtttgttatattgactttctggggtcgtggcccctgaagcattactgaaaatcatggacatgaagcagatttattaactggagaaaagacatacaaatgtatttaatgtgtatacacgggagcattcagaatgaagaccccaagttacaaggggagattgtctatatttatgctttggttcatccaagtctggacagctgtgtagaaatagggttggacaaaaagggcctgatccaatgctaatggcctgagtggggaaacccagccaggcctgtgtgtctagattcttcttggcctctctctctctctttttttttgagacggagtctcactctgttgccaggctggagtgcagtggcacagtcttggctcactgcaatctccacctcccaggttcaagcaattctcctgcctcagcctcctgagtagctgggattacaggcacgcaccaccacgctcagctaagttttgtatttttagtagagacggggtttcaccatgttggccaggatggtctcgatctcttgaccttgtgatctgccctcctcggcctcccaaagtgctgggattacaggcgtgagccaccgcacccggcctcttcttggcctctctgaacagtgctccttccttccgggtatggggctgggagcttctctgggatggggggtcttaggacgcccaaacaaggcaggtcagggaatttccttatggccacttttttttttttttttttttttttcaagacagattcttgctctgtcacccaggctggagtgtactggtgtgaactcggctcactgcaagctccgcctcccgggttcacgccattctcctgcctcagcctcccgagtagctgggactacaggcgcccgccaccacacccggctaatttttttgtatttttactagagacggggtttcaccgtgttagccaggatggtctcgatctcctgacctcgtgatccgcctgcctcggcctcccaaagtgctgggattacaggtgtgagccaccgcgcccagcctgtgccactctttatacagataggatagagggaaagttagattcctgtttttaggttttatggctggcttcggggggaaaggcgttcttgtttctgggacccgtcttggggaagagggattctagttccttcggtgccttaggggagaatgggactcagagacatgggggctggagaagttccgagagaaacttctgcttctgaggctgctgctgaggcctgcacttggcggtattgtttcgtaagcctgaaccacgtgcaggtctgaatcaacataaagaatttgggtgggaggcaggggaactccaataagaagcatctttgaatccggcaggggtggaatttgggtcccagaggggtttggtgactgcaggctacagaagaatgcttcaaagtgctgtatcacatggctttgctccgaagggtcccgagcacagctttaccgggggctcatgtgtaacgctcggcccacccatccaccaacaggagccacttaatcgacatctccaggatgccagcaaccgaggaccgttgtcatagtcccagcacaaaatgaggctgctttcttcttgggggtttagggatcccagaccacaaggatttgattaaaagccgctcagttcactaactataagcaaagcaaatcagaaatagatctcctgttcctgccccgtcttatgttcccagtggaaaataaaccccgtgaaagcaatggcgtcatgtgcaacccgaccttggagacagagaccccagagttagcgttgtctacctgggacatctcccagcccaggggtcttactccagacccgtgaggaccccaggcgtggctttgctgcaacttccctggagaggagagaggacagggggccctgcctgggagatagatttgctgcctggcatgcgggactggagactgtctcagtgcccaggccgtctgatgctggccggagtccgcctggtttatgtaacgaggtctggatgtgaccaacaacggcctcgtgtgtgtgagtcacgcgtgcagcaacttctggctgtagtgcaacccctgaaaccaagcaaagcctaaagcccccaggctccacttcctctgtgaccctccccacccccaattcctgtcatctctcagggtcatccggagcatctcaaagctgaaggagcctccgctgcaacctggcctcctgctgcaggatgagacgagctgtctgcagccctcccgtgccacctgcctgttttatgcaacagcatttcagagaggagggactgggaggggagagacaacaccgaggcctttggttatttagggcaacagcagggagtggccgggtgcacagattggaggagattaagtggttgctgaggggatgcctgggattgctgggatgggcggagacataacacagtgaaagatattggtcaacggcgaacacagattggaatgtaaattctcagggtgtgtgcatagccgggacgcttaactttggcgtcctggacaggtgtctcgactggaactgctggcagccttggaggggagatgttgcacagatccaagaggctgacacggttcctgtcccccagcccagtctgagcagcttggaccatgatgatcaagagcgctggaggaggccaggtgcggtggctcacgcctgtaatcccagcactttgggaggccaaggcaggtgggtcacttgaggtcaggagttcgagaccagcctggccaacatggtgaaaccctgtctctactgaaaatacaaaagttagctgggcgtgatggcatgcacctgtaatcccagttactcagacggctgaggcacaagaatcgtttgaacccaggaggtgggagttgcagtgggctgagattgtgccactgcactccagcctaggcgacagagagagacgccatctaaaaacaaaacaaacaaaaagaaaacaacaataaagaaaaaataagaagagagctggatggagcaaagatttgctgggttgttcttaaaggcgagcctgtagtgatcgctggtaacagagaacgtcatctgagagggacgtgggggctcccagagtttgagagaaacggccgtgtgggatttgacctgtgatggcaccgccagctcccagcctccagtctgggcccaggggcagctgctgtgtgcaccctgggctcagagttccccttccctccaaggtttgtgactttgtcctgacttagggattcctgtctggggatgcgtcttctgctccggagaggccctaattgcctccacaaggagcggcaaagcctgcccgggtggcatctgactggagccatgccacagcctatacgaatctatgttggagcccttgaaccttcccccagagcaagcgtcaccgaggcagaccgatttttgggagggagacagacatcagagcgggggagacccagtacctagggctcacctggttcccccaggcttagcctcctccagggcttagtgtttgagtgagagattgtcccccctggacaattctgtagattctgactctgctcctgccttgccctgaacttcccagaacctcagtttcttcctttgggaaatatgcatgctggtcataccaacatccttgggtgggcagatgagactcttgggtgcctggcattactgcaacagaactcaatgcatagtaagtgctgactcaatgtgctcctggctgcatcctctacttcctgataaattctctggtggtgttttctctacaaggctagtactggcaggggcaagtgaggaacaagatcaaggtgtgcatatatgtcagcaagagggacccttcaccctcacaaattctgcagtgtgtttttaatgatgtgtcccaaagatgtgaatgttctcttctctctgctgcagacacattcattagattaactgcttttggatcaggtaggaacctcagcttgtccacacaggttgcttcctgaccctgtatttgtcagtgtaggctagctgctataacaaacagcccccaaagaattaaaagtttatctcttgtttgtgttgcagccaggtgaggtggcaaaggtgtcctatgctccatatagtctctcaggcatccaggaccctcacattgttgtgcttcaccttcttctagggcagcccctctcaacctagactctgtgcgtgtgtggaggggtggggggggcgttggggggcggggatatgcctgtcctaagctgtgagtgggacagtccaggagagaagtctatgtgcttggagagaggcttccttcaaagtttcctggccatgagcaggaatgaagctctgacacaggttgcaacgtgaacgcaactcaagagcatcatgctcaatgaaagaagccaggcacaaaataccacatattgtagaattctatttataagaaatttgcagaacagacaattcatggagacagaaagtggatagtggttgtcaggggctggggaggcgggaggggaactaactgctgaatggggacaggggtcttcttttgggtgatgagtatgctctgggactaggtggaggtggtggttgcatctcccatgtagctcatggtcaggttagttttagtgctctgggcgaccctaggcttgcaggaggaggggagcagcatgaggtgaggaacaagggggattctggcctttccatcatggggtgacttatgccctgtttgctcccaataggtcaaagagactttgatttggcagatgcccttgatgaccctggtaagtgccgatatttcaaggggagccttcccttttcagcttggatctaacagcatcagctgtatagttactttggggttggattgggccagtgttgggaatttcttggtcttgagatctctgttctttgcaggagattgcagacaccttgagacaaacctttacacactctctaaaagtctcagactcatttcttggtaggtctgtgcttctaaacctgtggtttaggaatatgctagtattttattattttattttactttattttgttgagatgggagtctcgttctgatgcccagactggagtgcagtggtgcaatcatagcttaccacatagcctcgacttcctggctcaagtgatcctcccacctcagcctcccaagtagctggaacaacaggtgtgtgcccccatgccaagctaatttttttcttttttcttttttgtagaaacggattctcactatgttgcccaggctggtcttgaacccctgggctcaagaaatccttctaccttggtttctcaaaacactgggattacagacgtgcctcaacatgcctggcccagtttctgcttttcttacacttcagttcatatccctcattgtcccacaccccgatcccaatccatggcctccaatctccccagtttctgcttttcttacacttcagttcatatccctcattgtcccataccccgatcccaatccatggcctccaatctcccctcccagagcacacttcattccgttctcccctcaacttctctggttaccttcactgacggggctgtgagtttttcttctccagggcactgaggacctggaatcttcccattctgtgttttcatcagtccaagttcagctagaacctttctggctgaccagaatgctgaaaatatgtgtcctgggccctgcagaaagtcctgcttgaggcagatagtctgattgagattcaggtgtattcagaccgcggtgggtgggagaaagggaaagatttggtttctgatgcaggcacaatggaaccaaacatttattttgaaagaaaaataaacttttgtgtacacagaggaagaatccattgggctttagcattgggaacaactggttgaccagtgcagttacataatggtgtttgttggaggaagagagaatgataaccagatctgatcctaaaaagccaacaacaagatgataggaactcatctctctcccagttttctgcacacagtgatgtttttgctaataattatcctaaaaggcagatacaaaattgttgtcagtgcaacaggaaaatgtaatgactcaccccaacatggagatgccatttctcccatgaagttagaaaaggtgaaggttgaatcctaccctgtcaaggcagattgaggggtgggggttagaggcaggtgtgtggttgcaaccactttggaagcattgggggattatctccaaaattcagactgagtgtgttgcaccagcgtttggtctggataaagaatgaggcatatctgcaagagaaccctgtgcaatagtgaaggaggggctggctggtaggctcagatacagaacaagacatgttattgatctgaaagatcactgacatgtgacccaggagttccacttctagacagatacccaagagaattgggagcagggactcaaacagttatttgtgtacccatgtttgcagcagcaatattcacaataagccaaaggtggaaacaacccaactgtccatcaggggatgaatgaatgaacagaatgtggtccctccaggcaacagaatatgatttggctgtaaaaaggaagggggttctgatgcgtgctacatgagccttgaaactgtgctcagtgaaacaagccaggcacaaaaggccacagggtgtaggatcccattaatatgaaatgtccagaataggcaaattcagagagacagaaagtggattagcgattgttgggctggaagaggggacaaaagggagggactgctcgtggctatggggtctccttttggggggatgaaactgttctggaactagatacaggtggtgattgtacaatattgtgaatatatgaaacaccattgaattgcacactttaaaatgtcaaattttatatgtgagtttcacattaattttttaaaaatcacataaataaacttattttccactcacctgctactaccttttcattgctcacctagaaggctgccagtgcctgcaaacacatctttgaatgcatcgttttgctaccaagagccccccatgaatgggcaggcatgtgcctgttcatccacagcccttcctcatgggaaggaagccccagtgcagaggaaccacagtcacctgcatggcgactgtggggaattcacttttcactgtctatactgcctgggctttaagaaactctgtgagtgtatcactattttaaaaaatagttataattttacattttaaaaaggagacagagaaaggaaggatgggagagagggagggagggtgggaggaggaaggaagggaaaaggaagagaagaaagaaaagaaggaaacaatgaaaggacagaggaaaacagggagggagggaggaaaaaggatggaaacaaggagggaagaaaaggaagaagagagggaacgatggagggaaggaaggaagaagaaaggagaggagataagaaaagactgaggggaggaaggaagaaggagaggaatgaaggaggaagggaagaaaggaggggggaaggaaagaaagaaaaataggagaagaaaggaagaaagaaaaagaataagggaaggacggagggaaggaaggagagagggagaggagaaaggttggaggggaggaaggaagaaaggagggtggggaggaaggaaagaagaagggggaaaaggagagagggaaggaaggaaggaaggagagaaggaaggaaggagagaaggaaggaaggagagaaggaaggaaggagagaaggaaggaaggagagaaggaaggaaggagagaaggaaggaaggagagaaggaaggaaggagagaaggaaggaaggagagaaggaaggaaggagcgaaggaaggaaggagagaaggaaggaaggagagaaggaaggaaggagagaaggaaggaaggagagaaggaaggaaggagagaaggaaggaaggagagaaggaaggaaggagcgaaggaaggaaggagcgaaggaaggaaggagagaaggaaggaaggagagaaggaaggaaggagagaaggaaggaaggagagaaggaaggaaggaagaagggagggcaggaagggagagggaggtggcaggaaggagaaaaggtgatgagaaaccttctattaaaatacaggacatgcgaaaccatatgccccgtttggaggttcaagctctccttcttgcagtctctgcatccccagtgaatgtccgcaccacacacaaacccgtgttccagccgcctcctaccaaggcaatgctaggctgttatgtaaaccatgctttcaaatacggtgtttcctctgtttggaagaagtctggccattgcacagccctgaagctccaattttcccagccatggccgactccacctcctttgagccatcttcctcaaacctcctcctgccctcgtctgcccatccacactgcacacccaggttcactaagcagggcagtcacaggctgcaccctgagcactcctgacctgatatccacatccatgcaatacatatttgctgaatgaataaatgaatgaatgaaagaaagtgagataagccatcattctggaagctgcaagtctttctccttcttttcttttgcctccccctgcctcaccctccaccgtccagccctgtggtggctctacgggcaggtggctcacttacttgtcttggatgttctcagctactttggccatcctgtgggcatcctcacagcctcaagggtggattgtttttgaatggattttaagggtgttttcttgtcttttttctcaattcaacatggaatttgtgtctatatcatttactttgtatggctttgtcactcccttttcacctttcatcagggcgttcatggcctttcttcatgcttccaatgaatcttcaatgcatattgcatttattttctctctttgttcacagaacccaccaagaagccaaactcaggtgagtgtctcttcagctgggaaaaactgaggcaacgtccttgaactgatgcttacggaggggatggttgaggatgttttacagaactgtggggtatatgaaagagatgcaacaactgtaccagatagcagatattgaaagcaaaatgtggtgattagggaaatgcaaatcacaaccacagtgaagcaccacttcgtccccactgagatggctaaaatctaaaatggaaaataacaagtgttggcaaggatgtgatg

SEQ ID NO: 2917 - DNA, 62496 bp, human
tgcctacactggtcccacaggttttcagctgtggagtttgggatctgagcttggagcccatttgtttctggcagttccgctcatattttccacttgaagacatcgcctcccttccttccaagctgggagaccagaagtcaacaacaggagggtggagaggccgggtctcacaatccgcttggctggggagtccactgaggttcttgcatcctgaagcaaaccatggagagctggtggggacttccctgtcttgcgttcctgtgttttctaatgcacgcccgaggtaagaggcattttgctttgagggagatctgcctgggcatggatttttctattcttgctttaagaaactctttccaaaggagttgctatgaagtgaatggggataatttgcccaatgggattagaaaggagactaagagcgatgggtggctgagaggggagggagaagacgggctgctcccatttggaatctgggaattagatccagaagggcaggatgttagctgataccatctagatattcgccatattttcctgttttgatccatgtgtcccaagcgtttaaaaaatgacctatttaactccatgattcaagcatgactgggtgtgtgtggaatgtcagtcatttctttctgattttaaaaattagttctgaccatttccatacagtaaaagtagagttgaaactacttcatcccgtggggcagattaccagagattcgtttgccggaagggttgcatttattcagatttttaaatcttttcctaaacactgtcattcattcttgcaaattaaaaccacctgaattgttcacatcaaaaacttcgatataaacttgcaggctggctgtcccagatccaagattagatttttcagttccgtacgaggacctctttaagaaactccaatgaactcataaagtacaggatttgaacaacggttgagtaagtttctttggtcattttcatgtggcgatttcagagaagggaacacctgggcgcatcttaagagagagaagtatttctgttaggagttaaaacacatcattcagatgtccctgtggcagcatttcctgtttatcctatttaaagacatggacgtcattaagattggagttggttgtttatgggcggaggcggtgtcgggatggatagatcctggtggacatagtctaggatctgcagtgagaattttttattattctgtgctgtcttcagatctcacctagtaagtggacaatgtggccatgcattcattagcttctgtttacagggagatgttcaacagtaaacccacctccccagaaaagtacttccaggagtttgtatcattcacagtaagagccaaaggttaaccatatccccttgggcaaatcaacttctacaaagtgcggatacagacagttcccaacttaccatggtttgacatgatggttcaatttaagatttttcaactttacaacggtgtaaaattggtatgcattcagtacaaacgaaaactgtactttgagtacccatacaacttttcttttttttttttgagatgtcgtgtcgtttcattctgttgcccaggctggagtgcagtgacacaatctgagctcactgcaacctccacctcctacgttcaagcaattctcctgcctcagcatctcaagtagctgggattataggtgcccaccaccacacccagctaatttttctatttttagtagagactgggtttcaccatgttggccaggctggtcttgaatcttgacctctggtgatccaccggcctcccaaagtgctgggattataaatgtgagccaccatgcccggccccatacagccattctgtttttcactttcagtacaatgttcaataaattatgtgaggtatgcaacacctcattataaagttgactgtgtgctagatgatttgtccatccgttggctgatgaaaagtgttctgagcactctgaaggcaggtaaggctaagctatggcgtttggtagggtagttgtattaaatgcacttacaacataaaatattttcttttttttaatgtgttttaatttttttgagggaggggcccactgtgtcacctagactggagtgcggtggttccatcatagctcactgcagtcttcaccccaggggttcgaacaaacctcccacctcagcctccagagtagctgggactacaggcatttgccgctgtgcctgactagtttttaaaactttttgtagagacgggatctcactatgttgtccaggctggacttgaacatctcagctcaaacgatcctcctgccttggcctccccaaatcttgagattacaggcatcagccaccataccctgtcctgcgctaaattctttgactgacggcagcacttcctatgcactaggcatggattaacttagttgattgtccctcagccctatgacgggagtgtcgtgcctgatgtcattttacagatggtgtattagtcagggttctctagagggacagaactaatgcaatagaaatatatatagagagaggagtttattaagtattaactcatatgatcacaaggtcccacaacaggccgtctgcaggctgaggagcaaggagagccagtccaggttccaaaactgaagaacttggagtctgatgttccagcatccaccatgggagaaagatgtaggccagaagactaggccagtgtctcttttcacatttttctgcctgcttatattctagccacagcggcagctgattagatggtgcccacccaaattgagggtgggtccgccccttccagtccactgactcaaatgttaatctcctttggcaacaccctcacagacacacccaggatcaatactttgtatccttcaatccaatcaagttgacattcagtattaaccgtcacagatatgggtaaactgaggcactgaggatttggacgggggcagccggcagcggaatctgagctgtcctgtagctctgtctgggaagactccagtgagcatcccgctctatcccaagccttgtcttctgaaaatcagaatcatccctcctccaagtgttacaggaaaggggtccggatccagacgccaagacggggttcttggatctcgctccataaagaattcagggctagtctgtaaactgaaaacaagtttattaggaaagtaaaggaataaaagaatggctattccgcagagcagctcttagagctactgcttgcccatttttatggttatttcttagtgatatgctaagcaaggcttggattattcatgcctcccctttttagaccatgcagagttcctgacattgccgtggtatttgtaattgtcatggtgctggtgggagggtaacactgaggacaaccagaggccactctcatcaccatctgggttttggtgggttctggccggcttctttactaccacctgttttatcagctaggtctttatgacctgtatcttgtgcagaccttcagtctcatcctgtgactcagaatgccttaatcatctgggaatgcagcccagtaggtttcagccttctattgcccagcccctattcaagatggagtcgctctggttccagtgcctctgacacaagtagcgccccttagggaggttacaggagggactggaaggaaagtgaggtctggatcagggcccttctgtgtaaataagatgatgtacatgcagcagctgggtatgtcctgggtaaaaattagttaaatgcacagacgaccctgtttcatccccagccatcaccagctggaaatggggcacattcccaagatcccaaaaacattctgcaaggctggtgcgatgattgctatgaagtacttaagaaaacagattattgttcaggatcaatagctaatgcatgtggggcttaatgcctctgtgacgggttgatgggtgcagcaaaccaccatggcacatgtttacctatgtaacaaacctgcacgtcctgcacacgtatcccggaacttaaaataaaataaagaagacagaatattgttaatggttaatatgctgtaaatcattatgatgattactaaattatcaatacaaaagaagataatagcaagacggccatattcctaatagaggttgacattttagcagccctacatttccactgtatttaattagtatttgccgtccaatccagaggggcatgaaggagcacgagacaaaatcaggtcttctaacagctgagaagaagctgagaaccagaagtggaaaccccaaagggcagtgtatgaaatgtcatttattgaggggaaaaaaaagaaaatgacagagttcgatagaagaaataagcactagtgtttacataatcagtagggtgactttagtttacaataatctattgtagacttcaaaatagaagagtcggaatggttctaatatgaaggaaagacaaatatttaaggtggatggatatcccaagtaggctgatttgatctttacaaattatataaatgtattaaattattacatgtaccctgaagctatgtacatctgttatgcatcaattaaaaataaattaaaagaaaaggatatatgtccaggatatacaccagctaagacagtctcttccaagtctattgtacattattcccttatcagatttgaaacctgagagttccctgacgccccctcacaggatgtgcaacaggggtgtgtttgatctgtttgaccgccacacactgaaacctcttatgggaggcagaacttgcagacgggcaggtgcagcagctagtgtgagtgtttttgagctctgggccccacggtagcatctagggatgggtgcctgcgacccccgaagccctagtgggcgttttacggtgctcttttagctctgccatccgcacgtggcttaagtgttagccagctcagtgccgtcttggtacccgggttcttgtccagcatccaggaagaatcaggtcacacgaaccagctgaaggatggtaaatgcagaagagtttgttgccagatggagatgactcttagcgggatggttggggagttggaaaggggatggagtgggcagatgatcttcccctggagtttggttgtcctgcggctaatctcttctccaaccatccccagctgaacacctctcagtgttcagatgttccttctcttctctccttctctgctgtgctgctctttggttcctcaccttttctgctcatctgtctgtctgcacatggggtctggggtttggggttatatgggtacaggacaggcaggcatggtgggtcaaaaggcaacatttgggcacaaaaataggaatgcctgtttccatttaggactacaggtttccaggcttgagggcggggcctttgctggggaactgccctcttgtatctagtatcttcaggcctcctgtccgtatcaacatgacttaaaatgtgtgtgcatttgtatagagctgtgtttctatgtaaagactaaaaaagacttatgaaaaagatcactcagagctctgaacagtagcaaatcatatttctgagtacttcctgttgagtaaaggtaagtgaggattgtgccaagtatttttcattacttgctgcattaggttgtcacaggctgtttagtttacttctaaaaattgggatatggggaagttgtgggccgggcacagtggctcatgtttgtaatcccagcagtttgggaggccgagttgggcagatcacttgaggtcaggagtttgagaccagcctggccaacatggcagaacgctgtttctactaaaaatacaaaaattagccaggcatggtggggggtgtctgtaatcccagctattcaggaggctgagacaggagaatcgcttgaacccaggaggcggaggttgcaatcagctgagatcataccactgcactccagcctgggtgacagagtaagactccatctcaaaaaaaaaaaaaaaaaaaaaaaaaggaaaaaaaagttatgatgatcgcctaaggtgagaagccataccacgccagcgtacagaaccccaaaccacgccagcctcatcctacgtctcagttatatttttcttgacttgcttccattctggtgccccctctctccctgccccctccttccctgcaaaggatctagcaaatttgtaggtgtggaaagggaaccacaaatgggtcatttccctgccattgtcacctggagcgtgtagccatttcgtgcagtgattctctgtctttgatgtgcaggtcatcaccttgaagggaggaggtattaaaagcgccacccagtccccacccactgaggtctttattcagcaggtgtgggtcaggcatttgggagctgggagacctgcattttaagaagcaccccaggtgatgcccaagcggagctatgtgcttcttttaagagatgatgactccgtgtgcaaccgtgtggttacctttgcgtggagtctcatggatcactgccacagtggggaggcagctctgtgctctccaattcggtgatgtgtcattcactctatgcaggcccaaggtgacacccccagatacaggtgctgccatccagccattctcaaccagggatcatgtttatccacagggacacttgtcgatatcttgaggctttgcgttgccacactgatagcagggatgctgctggcatctagtgggtggagcccagggatgctggtcaacaccctgcagtgcacaggacgccccacagaaaagaatgatccaacctcatatgtcagtaggactgaggctgaggaatcttgccttagcatgagagatcctgtctgtctgtctgcctatctctagatctatctatcgtctaccattatccatccacctatctgtctctattatatacacctatcatctacctaatctatctgtcaatgattttctgtcatctattatctatctatttatctatctttctacctacttctctatccaactctcatctctattacctatctatgtatctatgtatctatctatgtatctatctatccatccgtctatcaatctatctatttatctagcagtccatcatctatctgtgacattcttctgctacccagggataattgtgttcctcgagtaacacttggcaatgtctggaaacaattttggtagttgcactgggatgggtgttctcgcattcggtgggtggagacaaggcatgttgttcaacaccttacagtgcacaggacagcacccatgacagagagttacgcagccccaagtgtcattagtgctgtagtggagaacctgctgttagttataacttctaaccctgcgaaaggggacaggttggaaatgtcatgctcctgtacgctgtaggaggtatagttgtctggaggtatagttgtctggaggtatagttgtcctgtacagtataggaggtacggtatagttgtctgggcatttctaaatggatcttactgtcagaatgcacttgtaggatcttttccccatagggcatagagccatggcacatataacccagaagctgagcattccatagtttccttcttggagtaggaaggggctgtgcagaaaaagtctatggctgtttggcacctgagtgtgaagacatctggcaaatattggagccaattagcagacaagcacggagtccaagaaatgtctcccctttcttggataacaactgacccttcctgtgagggcccccctcattccagccattttcctctttctcattggcacacagggggtagaaaagtggggttctgcctgcaggtggggctctgccagacacggcaaagctcctggggattcccccgatggatcaggggccagaggcacctaaacctgtgagcgatgtgtgcagccacggtgctgaggctgggaaactctgctgtagtctgtgaatcccaacctctgggaatgcttcagaatcagattctgggctgatctggaatctgcatgtggctggattctggtctgatccaggcatggaggcgtgtgcctgtaatcccagctactcgggaggctgaggtgagagaactgcttgaacctgggaggcagaggttgcagtgagctgagattgtgccattgcactgcagtgagctgagattgcaccactgcactccagcctgggcaacagagcgagactctgtctcagaaaaaaaaaattaaggaagagtattattgagagcgtaggccaggcgcgtgatgttgctgagatgaaactgtctctctagattcccaaaccctggttatctccactgaaccaggctgtccaatggcatccccattgtaattgaccatgttccatggtttaaatctgttgtgagccaaattgtaccctcctcaattttacaaatggaagtcctaacctgcaggacctccaattgtgactgtgtttggagatggggtctttaaagaggtgattcaggctgggtgcggtggctcatgcctgtaatcccagcactttgggaggctgaggctggcagatcatgaggtcaggagatggagatcatcctggctaacacggtgaaaccccatctctactaaaaatacaaaaaaaaaaaaaaaattagctgggcgtgcctgtagtcccagctacttgggaggctgaggcaggagaatcgcttgaacctgggaggtggaggttgcagtgagccgagatcgcactactgcactccagcctgggcgacagagcgaggctctgtctcaaaaaaaaaaaaaaaaaaaaaagaggtgattcaggcaaaatgaggtcactaggttgggccctgatccaacaggactgcagaccttataaaaagacgagatgaagacacagacatgcacacagggacgatcctgtgaggacttagggaaaagatggcatccacaagccaaggagagaggtctcagtaggaaccagccctgcccacaccttgatctcagacttccagcttccaggcctgtgggagaatcaatgtccactgtttaaacagcctggtctgtgggactttgctatggcagcagccacagtggacaaacacatttgtattccaatgaatgagttacctctgtaagggttgaattgtgcgtctccaaaatttatatattgaaggcctaatccctaggacctcagaacatgactgtgtttggtgatggggtctttaaagaggtgagaagggtacaatgagctcaggaggttgtgccctgatccaataggactggggtccttataaaaagagtagataaggacacagacacacacagagggatgaccctgtaaagacacagggagaagagggtgtctacaagtcaagaagagaggcctcaggaggaaccagctctgcccatgccttgatctcagaattccagcctccaggactgtgggagaataaaagtctgtggtttgtaagccacccagcctatggtattctgtgatagcagcctgcaatggactaagacatctcataagaagagcagatgaggacacagacatgcacatagagggatgaccacgtggggacacagggagaagatggtgtctacaagcccaggacagaggcctcaggaggaaacagccttgcccatatcctgatctcaagacgtccagcctccagggctgtgggagaatcaatgtctgttgcttataagccacccagtctatggtatgctgtgacagcagcctgaaatggactaagacacctcataagaagaggagatgaggacacagacgcacacagagggatgaccacgtggggactcagggagaagacggcatctacaagcccaggagagaggactcaggaggaaccggccctgcccacaccttgatctcagacttccagcttccaggactgtgggagaatcaaggttgttgtttaagctgcccagtctttgggattgcattgtaacaactctgggaagccattaccaagtctctgtcctgcaaagtgagatccatggatctgcagccttgacatcccctgggagctgatgagaaacactgtgtcttgggcccagacagacctgctgaagcatagtctgtgtgtcacccatgtcctgagggatccgtgtgcatgccactctgggaagacgggtttataacacaccgtcaaccagtgcctcattgcatggtctgcggtattttcctcgagttttccttgcaccaaagatgtcttgctttttgtgatgaatgatcattccttcctcttcgacgacaaaatacttcgatctctgcagacaccgtctgttgtgttacagacagacactgaggcctgaattctcattaccaatgtctgctctaatagagcttcaatctgcaactgcataatatggtcactgggaagtcaagaacggggccagttggttgaccttctggggagaggctgggctgcttggatgctgagaccgtggagggttcatgggttccgaggagcagatcatgcaccagggcggcctgctcagctctggtgtctgcagccccggtgagcttgagcattagggagtccctggatattcatgttgaggtgtggaggaggagactccagctgtgtttgatttcctgtcctgctggaaatataaacttcttaaccaattagagaacagaatggatttcatcttatccatggggctaaagtagaattcagcccttggcaaacaagccccccgggaataagattccccattggggcagcagccttccttgtcactttctgttgcaacctacggtcctaacctagtcatatgatttaattttttttactctgtgaatcatgccgtcctgggagagagtgagatggagcaaggacaaccctcttaggggcctgccaggcactctccctagcatggaaataaaggaaaaccttgagttccttcaagggaaattccaggcacctcgctggccttgagaagtacatggagcagcttgataagcaagaaggtgattgtagtgtagaacaatagccaaggaagttagagcctcaatatgtttagtttcctgtaaagactaaagataacatccttttttgagatggagtcttgctctgtcacccaggttgcagtgtagtggtgcaatcttggctcagtgcaacctccagcacctcctgggttcaagtgattctcatgcatcagcctcccaagtagctgggactacaggtgcacaccaccacgcccacatttttgtatttttagtagacacagggcttccccatgttggccagtctggtctggaactcctgacctcaggtaatctgcctgccctggcctcccaaagtgctgggattgcgggtgtgagccaccatgcccagccaagataacatcttactatatggccctgagttgattttcaggaacccagacccccaccaaataaaaaatgccatctgctggctcatagacgttgggtaagagaaactgaggcctgaattctcattacaaatgtttgttctaaattccttccctggggcatgtggcggtgggaggggggtggaaggggggtgaggggacgtgctggaggaagtcacaccaatggccacaactaacattgatttctgctgaccccaaatgctcagacaaacttggcctccttaaccaatgacaaatcagagaaactttgaatccacattaagcccctgcttccaggtatcccgcctttttagatcaaagcaatgtatagcctgcatgtattatggctttgcctgtaacctctgcctccttgccattgaaaaccctcagctactggccacccaggaggttgggtcttgaggcatcaaggaggttgcttgatgccctctaaatagctcggaataaacgcctcacttcctcacgctgcaatcccaatggcggtgttcggctttactgcacagggccggtggacctaagttgagttagtgggaggtgttcgaaccagggcaactccaggttgagtaggggctgtgtaaaatgaggccgagagctgccgggctgcattcccggatggtcaaggcattctaaggcacaggatgagataggaggttgacacaagaaacaagtcataaagaccttgctgatgaaacagcttgccgtaaagaagtcggccaaattttaccaaatccaagatggcgatgagagtgacctcgggtggtcctcacttgtgtcttcccaccagcaccatgacagtttacaaatgccacggcaatgtcaggaagttaccctatatggtctaaaaagaggaggcatgaatgggccactccttgtttagcatatcctcaagaaagaaccatacaaatgggcaaccagtggccctcggggctgctccgtctatggaggagccattctttattcctctgcttttctaataaacttgctttcattttatggactcgccgcaaattctttcttgtgcaaggtccaagaaccctgtcctggggtctgattccagacctctttccggtcacaagttcagtcacaagaaccattatcatatgctttctatatatacacataggtattttttaattgctgaactggagtcaaagagaaaccttaggatttgcctgaaggaagtcaagatttgtccttctcggggtccctgtgccagctttgtaaaacctcggaactttcccctctgtgggcttcctcaagctgaggagggctctatgggcttagtacccactaagtggcttcatctgcagcagctgacccaagaaagttgatttaaatgaacccacacttcagaggaaaccagtacaatccgatgtaaagaaataaaaaataggccgggggcggtggctcatgcctgtaattacagcactttgggaggccgaggcgggtgaatcacttcatgccaggagttcaagaccatcctggccaacatggtgaaaccccgtcattactaaaaacacaaaaattacctgggcgtagtggcatgcacctgtagtcccagctactcaggagactgaggcactagaagcgctcgaaccagggaggcaggggttgtagtgagccgagagtgcgccattgcactgcagcctgggcaacatagtgagattctttatccaaaaaaaaaaaaaaaaaaaaaaaaggctaggcacggcggctcatgcctgtaatctccgcactttgggaggccaaggtgggtggatcacgaggtcaggagtttgagaccagcctggccaacatggtgaaaccccatctctactaaaaataaaaaaaattagttgggcatagtagggggcgcctgtaatcccagctactcaggaggctgaggcaggcgggagaatcaattgaacctggggggcagaggttgcagtgaacagagattgcgccattgcactgcagcctgggcaacatagtgaggttctgtatgagagaaagagagaaagagggagggagggaaggaaggaaggaaggaaggaaggaaggaaggaaggaaacaattgcttgaaagggctttgtttcaccagggcacgcagatcaaaggacattggattgaataatgaaacagaagagcctgtctgaatttactaatgtggttgcacgtcccgtaatgattgcagttggctctaattcagttccgtggtgtataaattctgctggcaatagctgtaattggggtcagggatttagatagtctctgtgtgttccttttcattttctgctcagagcctgctgggagctgattttcttctttaaagcgaggtaaataattcagtggggagcagaggttttgctgtgggtccattgctctcctgtgctgcgtggcagctgtgctggtggcagctaatattcagtgggcagtggcctcgacattgcattattattcgagcaatggtactgttctttgctttgcaaaattgctgtttgttatattgactttctggggtcgtggcccctgaagcattactgaaaatcatggacatgaagcagatttattaactggagaaaagacatacaaatgtatttaatgtgtatacacgggagcattcagaatgaagaccccaagttacaaggggagattgtctatatttatgctttggttcatccaagtctggacagctgtgtagaaatagggttggacaaaaagggcctgatccaatgctaatggcctgagtggggaaacccagccaggcctgtgtgtctagattcttcttggcctctctctctctctttttttttgagacggagtctcactctgttgccaggctggagtgcagtggcacagtcttggctcactgcaatctccacctcccaggttcaagcaattctcctgcctcagcctcctgagtagctgggattacaggcacgcaccaccacgctcagctaagttttgtatttttagtagagacggggtttcaccatgttggccaggatggtctcgatctcttgaccttgtgatctgccctcctcggcctcccaaagtgctgggattacaggcgtgagccaccgcacccggcctcttcttggcctctctgaacagtgctccttccttccgggtatggggctgggagcttctctgggatggggggtcttaggacgcccaaacaaggcaggtcagggaatttccttatggccacttttttttttttttttttttttttcaagacagattcttgctctgtcacccaggctggagtgtactggtgtgaactcggctcactgcaagctccgcctcccgggttcacgccattctcctgcctcagcctcccgagtagctgggactacaggcgcccgccaccacacccggctaatttttttgtatttttactagagacggggtttcaccgtgttagccaggatggtctcgatctcctgacctcgtgatccgcctgcctcggcctcccaaagtgctgggattacaggtgtgagccaccgcgcccagcctgtgccactctttatacagataggatagagggaaagttagattcctgtttttaggttttatggctggcttcggggggaaaggcgttcttgtttctgggacccgtcttggggaagagggattctagttccttcggtgccttaggggagaatgggactcagagacatgggggctggagaagttccgagagaaacttctgcttctgaggctgctgctgaggcctgcacttggcggtattgtttcgtaagcctgaaccacgtgcaggtctgaatcaacataaagaatttgggtgggaggcaggggaactccaataagaagcatctttgaatccggcaggggtggaatttgggtcccagaggggtttggtgactgcaggctacagaagaatgcttcaaagtgctgtatcacatggctttgctccgaagggtcccgagcacagctttaccgggggctcatgtgtaacgctcggcccacccatccaccaacaggagccacttaatcgacatctccaggatgccagcaaccgaggaccgttgtcatagtcccagcacaaaatgaggctgctttcttcttgggggtttagggatcccagaccacaaggatttgattaaaagccgctcagttcactaactataagcaaagcaaatcagaaatagatctcctgttcctgccccgtcttatgttcccagtggaaaataaaccccgtgaaagcaatggcgtcatgtgcaacccgaccttggagacagagaccccagagttagcgttgtctacctgggacatctcccagcccaggggtcttactccagacccgtgaggaccccaggcgtggctttgctgcaacttccctggagaggagagaggacagggggccctgcctgggagatagatttgctgcctggcatgcgggactggagactgtctcagtgcccaggccgtctgatgctggccggagtccgcctggtttatgtaacgaggtctggatgtgaccaacaacggcctcgtgtgtgtgagtcacgcgtgcagcaacttctggctgtagtgcaacccctgaaaccaagcaaagcctaaagcccccaggctccacttcctctgtgaccctccccacccccaattcctgtcatctctcagggtcatccggagcatctcaaagctgaaggagcctccgctgcaacctggcctcctgctgcaggatgagacgagctgtctgcagccctcccgtgccacctgcctgttttatgcaacagcatttcagagaggagggactgggaggggagagacaacaccgaggcctttggttatttagggcaacagcagggagtggccgggtgcacagattggaggagattaagtggttgctgaggggatgcctgggattgctgggatgggcggagacataacacagtgaaagatattggtcaacggcgaacacagattggaatgtaaattctcagggtgtgtgcatagccgggacgcttaactttggcgtcctggacaggtgtctcgactggaactgctggcagccttggaggggagatgttgcacagatccaagaggctgacacggttcctgtcccccagcccagtctgagcagcttggaccatgatgatcaagagcgctggaggaggccaggtgcggtggctcacgcctgtaatcccagcactttgggaggccaaggcaggtgggtcacttgaggtcaggagttcgagaccagcctggccaacatggtgaaaccctgtctctactgaaaatacaaaagttagctgggcgtgatggcatgcacctgtaatcccagttactcagacggctgaggcacaagaatcgtttgaacccaggaggtgggagttgcagtgggctgagattgtgccactgcactccagcctaggcgacagagagagacgccatctaaaaacaaaacaaacaaaaagaaaacaacaataaagaaaaaataagaagagagctggatggagcaaagatttgctgggttgttcttaaaggcgagcctgtagtgatcgctggtaacagagaacgtcatctgagagggacgtgggggctcccagagtttgagagaaacggccgtgtgggatttgacctgtgatggcaccgccagctcccagcctccagtctgggcccaggggcagctgctgtgtgcaccctgggctcagagttccccttccctccaaggtttgtgactttgtcctgacttagggattcctgtctggggatgcgtcttctgctccggagaggccctaattgcctccacaaggagcggcaaagcctgcccgggtggcatctgactggagccatgccacagcctatacgaatctatgttggagcccttgaaccttcccccagagcaagcgtcaccgaggcagaccgatttttgggagggagacagacatcagagcgggggagacccagtacctagggctcacctggttcccccaggcttagcctcctccagggcttagtgtttgagtgagagattgtcccccctggacaattctgtagattctgactctgctcctgccttgccctgaacttcccagaacctcagtttcttcctttgggaaatatgcatgctggtcataccaacatccttgggtgggcagatgagactcttgggtgcctggcattactgcaacagaactcaatgcatagtaagtgctgactcaatgtgctcctggctgcatcctctacttcctgataaattctctggtggtgttttctctacaaggctagtactggcaggggcaagtgaggaacaagatcaaggtgtgcatatatgtcagcaagagggacccttcaccctcacaaattctgcagtgtgtttttaatgatgtgtcccaaagatgtgaatgttctcttctctctgctgcagacacattcattagattaactgcttttggatcaggtaggaacctcagcttgtccacacaggttgcttcctgaccctgtatttgtcagtgtaggctagctgctataacaaacagcccccaaagaattaaaagtttatctcttgtttgtgttgcagccaggtgaggtggcaaaggtgtcctatgctccatatagtctctcaggcatccaggaccctcacattgttgtgcttcaccttcttctagggcagcccctctcaacctagactctgtgcgtgtgtggaggggtggggggggcgttggggggcggggatatgcctgtcctaagctgtgagtgggacagtccaggagagaagtctatgtgcttggagagaggcttccttcaaagtttcctggccatgagcaggaatgaagctctgacacaggttgcaacgtgaacgcaactcaagagcatcatgctcaatgaaagaagccaggcacaaaataccacatattgtagaattctatttataagaaatttgcagaacagacaattcatggagacagaaagtggatagtggttgtcaggggctggggaggcgggaggggaactaactgctgaatggggacaggggtcttcttttgggtgatgagtatgctctgggactaggtggaggtggtggttgcatctcccatgtagctcatggtcaggttagttttagtgctctgggcgaccctaggcttgcaggaggaggggagcagcatgaggtgaggaacaagggggattctggcctttccatcatggggtgacttatgccctgtttgctcccaataggtcaaagagactttgatttggcagatgcccttgatgaccctggtaagtgccgatatttcaaggggagccttcccttttcagcttggatctaacagcatcagctgtatagttactttggggttggattgggccagtgttgggaatttcttggtcttgagatctctgttctttgcaggagattgcagacaccttgagacaaacctttacacactctctaaaagtctcagactcatttcttggtaggtctgtgcttctaaacctgtggtttaggaatatgctagtattttattattttattttactttattttgttgagatgggagtctcgttctgatgcccagactggagtgcagtggtgcaatcatagcttaccacatagcctcgacttcctggctcaagtgatcctcccacctcagcctcccaagtagctggaacaacaggtgtgtgcccccatgccaagctaatttttttcttttttcttttttgtagaaacggattctcactatgttgcccaggctggtcttgaacccctgggctcaagaaatccttctaccttggtttctcaaaacactgggattacagacgtgcctcaacatgcctggcccagtttctgcttttcttacacttcagttcatatccctcattgtcccacaccccgatcccaatccatggcctccaatctccccagtttctgcttttcttacacttcagttcatatccctcattgtcccataccccgatcccaatccatggcctccaatctcccctcccagagcacacttcattccgttctcccctcaacttctctggttaccttcactgacggggctgtgagtttttcttctccagggcactgaggacctggaatcttcccattctgtgttttcatcagtccaagttcagctagaacctttctggctgaccagaatgctgaaaatatgtgtcctgggccctgcagaaagtcctgcttgaggcagatagtctgattgagattcaggtgtattcagaccgcggtgggtgggagaaagggaaagatttggtttctgatgcaggcacaatggaaccaaacatttattttgaaagaaaaataaacttttgtgtacacagaggaagaatccattgggctttagcattgggaacaactggttgaccagtgcagttacataatggtgtttgttggaggaagagagaatgataaccagatctgatcctaaaaagccaacaacaagatgataggaactcatctctctcccagttttctgcacacagtgatgtttttgctaataattatcctaaaaggcagatacaaaattgttgtcagtgcaacaggaaaatgtaatgactcaccccaacatggagatgccatttctcccatgaagttagaaaaggtgaaggttgaatcctaccctgtcaaggcagattgaggggtgggggttagaggcaggtgtgtggttgcaaccactttggaagcattgggggattatctccaaaattcagactgagtgtgttgcaccagcgtttggtctggataaagaatgaggcatatctgcaagagaaccctgtgcaatagtgaaggaggggctggctggtaggctcagatacagaacaagacatgttattgatctgaaagatcactgacatgtgacccaggagttccacttctagacagatacccaagagaattgggagcagggactcaaacagttatttgtgtacccatgtttgcagcagcaatattcacaataagccaaaggtggaaacaacccaactgtccatcaggggatgaatgaatgaacagaatgtggtccctccaggcaacagaatatgatttggctgtaaaaaggaagggggttctgatgcgtgctacatgagccttgaaactgtgctcagtgaaacaagccaggcacaaaaggccacagggtgtaggatcccattaatatgaaatgtccagaataggcaaattcagagagacagaaagtggattagcgattgttgggctggaagaggggacaaaagggagggactgctcgtggctatggggtctccttttggggggatgaaactgttctggaactagatacaggtggtgattgtacaatattgtgaatatatgaaacaccattgaattgcacactttaaaatgtcaaattttatatgtgagtttcacattaattttttaaaaatcacataaataaacttattttccactcacctgctactaccttttcattgctcacctagaaggctgccagtgcctgcaaacacatctttgaatgcatcgttttgctaccaagagccccccatgaatgggcaggcatgtgcctgttcatccacagcccttcctcatgggaaggaagccccagtgcagaggaaccacagtcacctgcatggcgactgtggggaattcacttttcactgtctatactgcctgggctttaagaaactctgtgagtgtatcactattttaaaaaatagttataattttacattttaaaaaggagacagagaaaggaaggatgggagagagggagggagggtgggaggaggaaggaagggaaaaggaagagaagaaagaaaagaaggaaacaatgaaaggacagaggaaaacagggagggagggaggaaaaaggatggaaacaaggagggaagaaaaggaagaagagagggaacgatggagggaaggaaggaagaagaaaggagaggagataagaaaagactgaggggaggaaggaagaaggagaggaatgaaggaggaagggaagaaaggaggggggaaggaaagaaagaaaaataggagaagaaaggaagaaagaaaaagaataagggaaggacggagggaaggaaggagagagggagaggagaaaggttggaggggaggaaggaagaaaggagggtggggaggaaggaaagaagaagggggaaaaggagagagggaaggaaggaaggaaggagagaaggaaggaaggagagaaggaaggaaggagagaaggaaggaaggagagaaggaaggaaggagagaaggaaggaaggagagaaggaaggaaggagagaaggaaggaaggagagaaggaaggaaggagagaaggaaggaaggagcgaaggaaggaaggagagaaggaaggaaggagagaaggaaggaaggagagaaggaaggaaggagagaaggaaggaaggagagaaggaaggaaggagagaaggaaggaaggagcgaaggaaggaaggagcgaaggaaggaaggagagaaggaaggaaggagagaaggaaggaaggagagaaggaaggaaggagagaaggaaggaaggaagaagggagggcaggaagggagagggaggtggcaggaaggagaaaaggtgatgagaaaccttctattaaaatacaggacatgcgaaaccatatgccccgtttggaggttcaagctctccttcttgcagtctctgcatccccagtgaatgtccgcaccacacacaaacccgtgttccagccgcctcctaccaaggcaatgctaggctgttatgtaaaccatgctttcaaatacggtgtttcctctgtttggaagaagtctggccattgcacagccctgaagctccaattttcccagccatggccgactccacctcctttgagccatcttcctcaaacctcctcctgccctcgtctgcccatccacactgcacacccaggttcactaagcagggcagtcacaggctgcaccctgagcactcctgacctgatatccacatccatgcaatacatatttgctgaatgaataaatgaatgaatgaaagaaagtgagataagccatcattctggaagctgcaagtctttctccttcttttcttttgcctccccctgcctcaccctccaccgtccagccctgtggtggctctacgggcaggtggctcacttacttgtcttggatgttctcagctactttggccatcctgtgggcatcctcacagcctcaagggtggattgtttttgaatggattttaagggtgttttcttgtcttttttctcaattcaacatggaatttgtgtctatatcatttactttgtatggctttgtcactcccttttcacctttcatcagggcgttcatggcctttcttcatgcttccaatgaatcttcaatgcatattgcatttattttctctctttgttcacagaacccaccaagaagccaaactcaggtgagtgtctcttcagctgggaaaaactgaggcaacgtccttgaactgatgcttacggaggggatggttgaggatgttttacagaactgtggggtatatgaaagagatgcaacaactgtaccagatagcagatattgaaagcaaaatgtggtgattagggaaatgcaaatcacaaccacagtgaagcaccacttcgtccccactgagatggctaaaatctaaaatggaaaataacaagtgttggcaaggatgtgatgaaactggaatgtttgtacagtgctggtgggagtctaaaatggtacagccactgtgaacaaatgctttggtggatcctccaaaagttaaatacaggattactctatgaaccagcaattccactcctaggtatgtactcaaaataattgaaaacacgggttccaagaaaaatgtgtacacaaatgttcagagcagcactattcattatagctaaaagatagaaataactcacatgttaatcagtggaaggaatggataaacaaaatgtggtccattcacacaatggaatattatttagccttgaagaggaatgaagcactgaaaattgctacaaagtggttgagcctcaaaaacattttgcaaagagaaagaagccagacacaaatgatcacataatgtatatttttatgaagatgaaatttcaagaataggtgaatccctagaaccagaagcaatgtcgtgactgccaggggctggaggggaaagagagagtgactgcttgataaattccaggtttctttttgggggaacgaaagcattctggaagtacacagaggtgatggctgcacaacactgtgaatattctaagtgcccctgaattattcacttttaaatggttaattatatgtaaatttgacttcaatttatttatttattttcaattaaaaaggtaacctttggctgggggcggtggctcacacctgtaatcccagcgctttgaaaggccgaggtgggcagatcatctgaggtcaggggttcgagaccaacctggccaacatggtgaaacctggtctctactaaatataaaaaaattagctgggcatgatggcacatgtctgtaatcccagctactcgggaggctgaggcaagagaatcacttgaacccgggaggtggaggttgcagtgagccgagatcatgccactgcactccaacctgggtgacagagtgagattccgtctcaaaaaaaaaaaaaaaaagaaaagaaaagaaaagaaaaagaaataattcccggggccgggcgcagtggctcacgcctgtaatcccagcactttgggaggccaaggcgggtggatcacaaggtcaggagatcgagaccatcctggctaacacggtatgttgtacctgagcgagttagaaaaacgctttgagacaaattaagagtcctttataagccagcgaccgagagacggctaatgcttaatagtctctcggtcctgaggaaggggcttgattaacttttagatcttggtttaggaaggggagggctgggggtctagtgaaaaccattttacagaagtaaagtaggcaaaaagttaaaaggataaatggttgcaggaaagtaaacagttccaggtgcaggggctttaagactattacaaggtgatagacgcggggctttgggcgttactaatcagacgaattcccgggaactgcggatgtagctcgccacagtatcttatcagttaactgcattcttggatgtgctgggagtcagcctgcacgagttcagtccttgaggaaggggctgccagtgaaagagccaaggtggagtctggctggctctcttagctaagggagagtccattcaggtggaaagaaggctaggtgagtaaaggaaaagggagagtctaaaaacaggttagtaaaaaccaggttgggcattacaggtgaaaccccgtctctactaaaaaatacaaaaaaaatttgccaggcatggtggcgggcgcctgtagtctcagctacttgggaggctgaggcaggagaatggcgtgaacccgggaggcggagcttgcagtgagccgagatctcccactgcactccagcctgggcgacagagcgagactccgtctcaacaacaacaacaacaaaaagaaataactcccagacttccagcagactccttgactgccatgagagatgtcaggaagtcaatggacgggtgtttataggttgttcaggaaatgttcactatcaagcaagaattgaaaatgcagctaaattgctgttggagagtgatgatagcataaagatttccaacaagaagctctgcaaattttgctgaaaaatcttccaaatgatgctctgccataagaagaaattcacaccctgaatagcacagcaggatgcgaatagcaatgccagccaaagacattgcaaacaagccggtaaaactaagtgattgttagctgtttaaaaaaataataataactggtgttaacaacaaagtgaaacttaacttctgaagatgaggctaccttcacagagaggataagaaaggaagaactgagtaaaagtagttagatattgctggattttgacattttaaggttaagtgttcctgctaaaaataaaaattgaacatataactcctgaactagtggatgaaaatgaagaatgaagaataaaattaaatacaaaaaaaatgaagagtaaaattaaataccaaaattagccaagtgttgtggtgaatgcctgtagtcccagctactcaggaggctgaggtgggaggatcacttgagccccagaggtggaggttgcagtgagctgagattgcgccactgcacttccgcctgggtggcagagccaggctttgtctcaaaaataaaaaaaaataataaattaaaaacctgaatactaaatggaagttaagaaggaaggaattaaaaaagaagaaaagtaaaataaaatagtaggaatagtgaatccttagttatgttagatgttcagtgatttaataaatctgtaaaaagacggagatgagatgatgcaatttaaaatgtttcggctgggcgcagtggctcacgcctgtaatcccagcactgtaggaagccgaggcgggtggatcacgaggtcaggagatcgagaccatcctggctaacacggtgaaaccccatctctactaaaaatacaaataaaatgtttcatgctatttacgagagaagcatttgcaacaaaatgccaaagagaaggtgaaaatagctggaaaaaaaatgcgcaaagcaaataaccaatagaaagaaagccaagttgggctagcaaaatcagacaaaataaccttcgaggtgcaaacaactttgaggcccaaatagaggttcttcccactaaaagaatgattccctgaatgataatggaatcttgacccagcctgcacctcaggttaagttaaaagtggaaatttaaagatctaagtgtgagattttaaaaagcatttccccagaaataccaggatctgtagatggaaatgttattaagaataaagatgtggagctgggcgtggtggctcacgcctgtaatcccagaactttgggaggctgagactggctgatttcttgagcccaggagtttgagactagcctggacaacatagtgagaccccatctttacaaaaaaattaaaaaaaattagtggacatggtggcatgcacctctagtcccagttactcaggaggctgaggtgggaggatcacctgtgcccaggctgaggctgcagtgagccatgatcacgccactgcactccagcctgcgtgacagagcaagaccctgtctcaaaagaaaagaaaaaaaaagaagaaagaaatgaaaaccgtagctcagagacagagaaactgagcaatgcataggttcagaagggtttgaaacagactgaattgtgtcttggcatatgagagaggtcgcagctataaaacaatgagagaagaaaccaaattccacataggcaggactgagacaattggctgttcttgtggatgatacgtgatcaaatctcaacctcatgcgatacttttttttttttttttgagatggagtctcgctctgtcacccaggctgcagtgcagtggtgtgatctcacctccccgcaaacttctcctcccgggttcaagtaattctcgtgcctcagctgggactacaggcatgtgccaccacgcctggctaatttttgcatttttttagtagagacggggtttcaccaagttggccaggctggtctcgaactcctgacctcaggtgatctgtccacctcggtgtcccaaagtgctgggattacaggtgtgaaccaccacacccagcctcatgtaatacttaaaaatgaactacaggtggattacaaacctgaatataaaagaaaacttttttttttgaaaaatagagggaaatgtcttataacctcagagttaggaggtttttcttagatacaatacaaaaagcataaccacgcccatagtcccagctactcaggaggctgaggcataagaatcacttgagctcgagaggtggaggttgcagtgagccgagatcctgccattgcactccagctgaggctacagagtgagagtataaaaaaaaaaaaaaaaaagcataacctttaaaaatgggttagcctatgtctacatttaaataataataataataataatgttccaacttcaggctctgaaaaaagtcaaaagatgagctgtcaactagaagaggctccttactgctcataccaccagggaaagtttaatatgcaaaatgcagtcatccttcagaattcatgggggattagttttaagacgccttcttccccgcagacaccaaaatccacagctgctgaagtctctgatataaaacgtgcagtacttgcatataatgcaagtatatgttcctgtatatttttatttatttatttggagacagaatctcactctgttgcccaggctggagtgcagtggcgtgatcttggctcactgtaacctccacctcccgggttcaagagattctcctgactcaacctcccaagtagctgggattacaggtatgcgccaccacccccagctaatttttgtatttttggtagagacgggttttaaccatgttgtccaggctggtttcgaactcctgacctcacataatctgcccaccttggcctcccaaagtgctgggattacagggatgagccaccgtgtccagcctctggtatactttaaattatctctaggttactcataactcctgatacgctgtaaatgctatgcaaatagttgttatactatattattttttatttgtattactttttattggattgctatattttattttttgaaatattttcaatacaagactggttggatctatagatgcagaaattctggttatagagcacaaactgtgtatagatagctcctaccaaaacagacggatggtgaaaaaaagaaaagaaaagaaaagaaaaagaaaatggaggagagagactatgaggcgactaaaagaagagggatatgatcattccattcgctgacaagaaaaattcaaagaagagggaattatgcaattgaccagctgatgtgtgttagaaatgctcagggtcacacatattcattgaaagccaatttaagccactatttaaatttaaaccgatttaaacaattgggcttttttttttttttctaaaaaaaaaaaaaagtcaattaggccaggcgaggtggctcacacctgtcatcccggcactttgggaggccgaggtgggtggatcacaaggtcaggagtttgagaccagcctggccaacatggtgaaaccctgtttctactaaaaatacaaaagttagctgggcatggtggtgtgtgcctgaggctgtgagactgaggcaggagaatcacttgaacccaggaggcggaggttgcagggagcggagatcatgccactgcactccagcttgggcgacagaccaagactctgtctcaaaaaaaaaaaagaagaagtatattggttccgtctggaaaggtggagcacttgaagcaaaggcaggaagactggaagcagggagagggttttcaggtcacaaacaggtgagagacaaaacagttgccttcttttgagtttctgattagcctttccaaaggaggcgatcagatacgaatctgcctcagggagcagaggggggactttgaatagaatgggaggcaggttggccctaagcagttcccagctggacttttccctttagcttagtgacttgggggtcccgagatttatgttcccttcacagtgtatgagtgagagcacttggaaactgagagtggaagtgtcgcaggccaggtctcactaacacaggcccccacaacacctgtttcagtattgactgagtggttaaatattaaaagccagtgctgttatacaaaggctggaatgtaacaaaagcccaccgagagtttttcccaggactttcccgggccttaaagcatgacaaaataatgaatgaattcttaacaggacccatttaggattaaacaagttttactgggggtctgcagaaactccccaggcctccacaaacaagtttattggggctttgaaggaactctgcaaacctcctggatttagcaggagacaacatgagggtaatcaccccggcacctggacccattagattaagtcaatttactgaggctcctgaggaagatcctcaggactcagaccttagttatagattaaaagaagttaatcacttatgtctttagataaatgcacacacatatctccacatagcttggaaggtatataagctctggaaaactataattttgagttagtctggtgataatttccaggccttctccctgtaacaggttgcagaaataaaaactctcttcctccccagttcatcggtgtttcattattgggctgtgagaaatagcaacccagttgggtccgggaacagaaggtttggtgttatcttcatcacaggcactggactgtcggtaaatttattccatgacaattcttcctaggtttcttttttatattacttgcttccatcatggcagacagctacactggcttcttgccatgaaaacgaacttctagtaacaaaacggaaacctttttttttaagtttcaggtttcaaggttttacttctatctgcaaagtgatttttaaccagacaatggcaatctataaacacaccgtgggcagcaaatcagaacaaactgcaaggtcgatagtcacgctgatgagcttgtttctgcagcctgctcctaagggaaggacaattttcttttctaacagtgcaatgttgtttcctccacagatatctacccaaagccaaaaccaccttactacccacagcccgagaatcccgacagcggtggaagtaagaatccgcaggcctgaaactctttctcaatctggtttgatgatgtttgcctttttatttactagcaggtttagcctggttgcatttgaaatatgtgtgtaatagctcccttactgggaatgtagtttctttcctcactggggggagcaagaaagtccaacggacagaaacaatcttattttccctttgctttgacatctagaaaccactaaggtgtacttgtaaccacccaactggttcactttgttggctgcctagacagagctgatttatcaagataggggaactgcaatggagaaagagtaattcacgcagagccggctctaagggaggctagagttttattattaatcattcagtctctggaacatctggggatcagggttgttaaggataagttggcaggtaggggcttgggaagtggggagtgctgaccggtcaggttggaaagggaaccatagggggttgaagtgaggttttcttgctgttttctgttcctgggtggatggcggacctggttgagccagattaccgggctgagtggtgtcagctgatccatccagtgcagaggctgcaaaatatctcaagcaccgatcttaggttttacaatagtgatgttacccccaggagaaacttggggaggttcagactcttgcagccagaggctgcacgagccctaaagtgtaatttctaatcttgtagctaattttttggtcctgcaaaggcagactggttcccaggcaagaagggggtctttttgggaaaggggcattcttaattttgtttcagagtgaaaccacgaactgaattcgttcccaaggctagtttggctcacacccaggaaagaacaaggacagcttaaaggttagaagcaagatggagttggttaggtctgacctctttcactgtcatcatttcctcagtcataatttttgcaaaggccgtttgatactcaaaggacactttgcattatcatcacagaaagctaatcaggctgagagacaagtcctttctctcacttgttttcagtgctccaaatacctttggcttaaccattcccaaacccccacgtgtgctgtgcactttatgtgttttagagttggtttctccattttttctaacatttggcagacagtttttttccacagatttattacactcatcattgaaaaatatgcaattcaaaaaagaaagagagtgaacgagagagagaagagtggggaggggggtgggcatggagagagaaagagaaagagaaaagaaaggggaaagaagaaaggaaaagatagattctggccattaaagttatcagcagttcaacaaccttaaaaacttaaatgtttgccaggcagagcagcgtgaagctggctaaatcaagaggggttctggaagcttcctggtagtttgctctggctttaaactttcacagcttaacagcgtgtccattcattgcagacacgcacatccagatggacagaaattatctcctcttacaaggaatcattaaaaacagagaccaagacccaagggaggtgacacccacttgaaaaactacacctcaggccgggcgtgggggctcacgcctggaatcccagcactttgggaggccgaggcgggcagatcacctgaagtcaggagctcgagaccagcctggccaacatggcgaaaccctgtctctaccaaaaatacaaaaattagctgggcatggtggcatgcgcctataatcccagctacttgggaggctaagacacgagaattacttgaatccaggagaggaaggttacagtgagccaagattgtgccactgcactccagccggggaacagaatgagattctgtctcgaaaaaccaaaccaaaccaaaccaaaccaaacaaaacaaaaccccaaaacaccacctcacccttaactgcattagttaagccagctagtctttcttttttccccctctttcatgatgaaaatcccaaataccacccacctttttctcctgctatttcctcctagtcttttaaaaaccattgtcctgcggatcatggctatgttgcaaggcactcatgggaattccacagggaacgtgtttcttgctgaaacatacttgggaaacgcccagttaaacagactgccgtgggcttccctcccagagaattcatcaggacttaaaatgtgtggctgggcatggtgggtcacgtctgtaatcccagtactttggtagaccgaggctggtggatcacctgaggtcaggagttcaaggccagcctggccaacatggtgaaaccccatctctactaaaaatacaaaaattagtcgtggcctgtagtcccagcaactcgagaggctgaggcataagaatcgcttgaacctgggaggcagaggttgtagcaagctgagatggcgccactgcactccaggctgggcaacagagcgagactccgtctcaaaaaaaaaaaaaaaaagaataagaaaaaaaaaacttaaaatgcgagatcctttaagatgggccatcttcagagtgtgaacactcagcccctcccacagcaaagtgattcatgaaccccaataggaggaggagtgggggaagagaggctcaggctggggaggtgaccccccatgactcaagcctcaatctcctgatgcttgtcccaacaaagaggaggcttcctttccgactttggtttttcatgttgtgcttaaatccagccacactgatgcctttaacatggcagtcctgaattattaatcaatactgtgtgaatccaaaatatctgagacaggtctcaatcagtttacaaagtttattttgccaaggttaaggacgtgcccgtgacacagcctcaggaggtcctgatgacaagtgctcaaagttgtcaggacacagcttggttttacacattttagggagacaggagatatcaatcaatatgtataagaagtacattggtttgatctggaaatgcgggacaactggaagcaggggcttccaggtcacaggaagatacgagacaactagttgcattcttctaagtccttgatcggccttttactgaaaactcaatttacatgtgagacagggcaaaggaatagtacttatgcctcagtctggcccagtgaatctgcatttttcatcaacaatagggcagaggaagcaatcagacatgcatttgtctcaggggagcagaggggatgactttctgtcccacacctgtgaagatgagctgttggtgtacattgccagggtgaaattccacagaactgttttagggtaaacaaaacagtttactttcctcagattgtgaggacagtatgtagcttttaaaaaacttaaaaaaatttttttgtagctatcttatttagaaagaaaatgggaggcagatctgactaactttttttttccagcttgacttttcccttggcttaatgattttggggtcccaagatttattttcctttcacaattgaacatcagaacatggagtatttaacacaggaaatgagcaaatttaacgtacacacccaaggaaaaggaaaaatgaagctggttggaagttaattatggatagtgtggtatatgagcagaaattccccttaaccagtgttcttgcccaggctagcccaaatgagcccaggctagcctagattcccaagtgtgtatcttgagaacgaggaagagccctagaaaacaatgtgtaacgtccctccaagatggggtgttctggaacaatccctcagacaacgaaggcaattgttgatgggcaacattgggaagaccccagagatggaatgtcctaggcctttccatgttctctttctcattctccctccattgacttgataggtggctgggggatttataagtatttaccacacaccagccagctttctccggatggctccaggcatgcttggagcccagtggtctctttcccttagaatttgatctggaggaacccaaaattctctctgtgtcctttgaaattcagcacatttttcttggcttccatgagctcctgtggcatttctcaggccaactgttgactctgcttcctatgtctgtgcttgtccctttgagagatgtcagcgttgctcaccgattcttttctctgaccccagcagctcctatccatgttgtctttttttttttttttttcagacagagtctcactgtattgctcaggctggagtgcaatggcacgatggcatgatcttggctcactgcaacctccgcctcctgggttcaagcaattctcctgccttagcctcccgagtaactgggattacaggcgtgcaacaccacacctggctaatttttgtacttttagcagagacagggtttcaccatgttggccaggctggtctcaaactcctgacctcaggtgatctgcccaccttggcctcccaaaatgctgggattacaggtgtgagccactgtgcctgtcctcatgttgtcttgaaagtaacaagacaggcacggattctttttgatgcaagctgttatgggatgaattatgtctccccgcaaattcataggatgaagtcctaacccccagtttcctcagaatgtgactgtctttggagatggggcctttaagaaggagattaatgtaaaatgaggtcactagggtgggtccggatccaataggactagtatcctaataagaagagatgaggacttagacacacacagaggaaagattatatgaagacacagggagaagacggcatctacaagcccaggagagaggccttaggaggaaccagcccagaccatatcttgatctcacactcccagcctccaggactgtgggagaatcaatgtctgttgtttataagccacccagtctatggtgttctgtgacagcaacctgaaatggactaagacacctcataagaaggggagatgaggacgcagacacacacagagggacaatcctgtgaggacacagggagaagatggcatctgcaagcccaggagagaggcctcaggaggaatcagcccagcccacacctggatctcagacttccagcctccaggactgtgggagaatcaatgtctgttgtttataagccacccagtctttggtattctgtgatagcagcctgaaatggactaagacatctcataagaagaggagatgaggacacagacacacacagagggacgaccctgtgaggacacagggagaagatggtgtctacaagccaaggagagaggcctcaggagtaagcccaggaatcaatgcagttggaggttctgtgtgtgaatggaggagggaagctcacagatgaaggcgttttgagggaggactgaccttacagtgaggtacccagagacttcctgaaccaagccacgaatatgcagctcgtgctccgggcagtgccttctggcctggaaaccaaagctcccttgtgtccagtccccactcctctgtttggcccccaagtttccataatcccccacagttgtatcattttagagacctcaaaagagagtctaggctgggcgtggtggctcatgcctgtaatcccagccctttcagaggccgacgtgggtggatcacctgaagtcaggatttcaagaccagcctggccaacatggtgaaaccctgtctctactaaaaatacaaaaattagctgggcatggtggtgtatacctgtaatcccagctacttgggaggctggggccagagaatcgcttgaacccaggaggcggaggttgcagggagccgagattgtgccactgcactccagcctgggcaacaacagcaaaactccttctcaaaaaaaaaaaaaaaaaaagagagtctaggcagggcatggtggtccatgcctgtagtcctagctatactcaggaggctgaggtaggaggatcacttgagcccaggaggtggaggctgcagtgagctatgattcaccactgcactccagcctgggcaacagagcaacaccctgtctcaagagagagagaaagggaaagagagagagactattttgagaagtgaaaaaccagtcattctcagcccagatttccagtgttctgagacgtctgtcctgaggaaggactttgagaacagcatccttgccttttttgtgaattaaagtaatttcactcttgagccaatgtggataagcacttgacaggtactggcagtgccaggtaccaggaatatagaatgggtacagaaaataaagtttctagtccagcgacaaaaaggtgctgaagatacagactcatgtcgtgcaaagagcttgcactgattatttcatttcggcttcttgaatagggtcaaaggacatttaagctgagacaggagggacgagctaattaatgcttttccagatgacaaatggattcttcaaatatttagggagagtgtaaagtgatggacagggaacaggaggggtcatgacagaaggaatgccacctgcaaaagtcctggggcagggctgggcacggtggctcatgcgtgtaatcccaacactttgggaggccaaggtgggcagatcacctgaggtcagaagttcgagaccagcctgggcaacatagtgaaatcccatctctactaaaaatacaaaaattggccaggcgtggtggcacacacctgtaatctcagctactcgggaggctgaggcaggagaattgtttgaacccaggaggcagaggttgccgtgagctgagatcacaccactgcactccagcctgggcgacaaaagcgaaactccgtcttaaaaaaaaaagtcctagggcagaaagctcatggtaaacttgaggaacatgcaaaagtcattgcaaaaagttttaagaaattcaaatgaagccaggctcagtgtggctaatgcctatgatgattccagctctttgggaaggcaagacaggacgattgcttaagaacaggaatttgagaccaacctgggcaacatagcaagaccttgtctctacacaaattttaaaaattagccaactatggtggtatgcacctgtagactgagctacatgggtggctgaggtgggaggattgtttgagcctaggaactcgaggctgcggggagctatgattgcaccactgcactgcagcctgggcaacagagcaagactctgtctcaaaacaacaacaacacaaattcaaatgaaacggtgtaactcaagcaagatggaaatacaacacactatcaaaaggtcagatgtttcatcctaacatttatagaagtgactgacttctgtaaatggtgctggcatctgtagtagccctaaacagggaaaggtcaacaacgcactttctgccctgttaatttcagagagccctggacttcttgcgaaagcaccagtggtgtaagtttttgttttttcattgtaagctctgaggtggtattatgaatattgtctacatgattaataagctccgtaaaagcaatgggcagtaacatcttttctgtactttggcattcttatttatagatggtatctacctgaaagatgtcattatttttctgaaatcatactgttgttttccaacagatatctacccaaggccaaagccacgccctcaaccccagcctggcaattccggcaacagtggaggtaatgagtatttatttatttatttttattttattttattttattttattttactattttatttgattctatgttattttactttattttaccattttatttgattctatgttattttactttattttatttgattctatgttattttactattttattttattatttattttggagacagggtctcgctctgttgccctggccagagtgaagtgatgtaattgcagccttgaactcctgggctcaagcaatcttcctccctcagcctttcaagtagttaggactacagatgtgtaccacctacattgcaccacctatatttcaccacctatattggctatatttcaaattttttgcagagacaggatcttgctgtgttgttcaggctattcttgaactcccggcctcaagcaatcctctgcctcagcctcccaaaatgctgggattacaggcaccagctattgtggcccagcctgataatcagtattaaagtccattttagaagtgtttggggccaggcacagtggctcatgcctgtaatcccagcactttgggaagccgaggtgggcggatcacttgaggtcaggagtttgacaccagcctgagcaatatgatgaaaccctgtctctactaaaaatacaaaaattcgccgggcgtggtggtacatgcctgtaatccagctactcaggaggatgaagcaggagaatcgcttgaacccgcaaagcggaggctgctgtgagttgagatcacgccacagcactccagcctgggagacagagcgagcccctgtctcaaaaggaaaaaaaaaaaaaaaaagaagtgcttcacgcctgtaatcccagcactttgggaggccgaggtctcctcaggcagatcacctgaggtcaggagtttgaaaccagcggccaacatggtgaacccctgtttctactaaaaatacaaaattagctgggcagagtgacgcgtgcctgtaatcccagctactggggaggctgaggcaggagaatcgcttgaacccaggaggcggaggttgccttgagccaagattgtgccaatgcacaatctatctaggtgatagagtgagactctgtctcaaaaaaaggcgggggggtggttggatacaagtattatttaatgacttaaaaattctcatctccatggtgaaagaccaattgcttttgaaatgcacagacattgttttgcgaggagttcagttctactatccaccagcacctggggattacatttagttgatagtaaataaatttaaatgtttttgatgacattgactgaaaaataccatgcacactaagacatttcaagttatgatggaggaaggcaattttttcttgtttttttttttgttggtctgtgttctactcacttattcttccctctgcaagagttatctgcggccactttgcctgtgttcctacagcacttcccatctccgccttggcaattgtgtctcacgaacgtgagacactcaggaaagagatgctggtctgtaaagttggaagagtctcagcgattccattggtggggcaaatgtgtgcagattgaggaagctaagatacactgggtgtcttcctctctccacctgctttaaccattgggagttcccctgattgtgattgtttcaggacgttgcttggatgttgtcatattcctagggttcaaggcactccgtgaaatccaaggaaacaagctttgggtatgtcccagtgccttttcccttgggtcttgcaactgaagaattgtgtttcttccctagaaaaacgaacacacttttgcccactcacccacctcctgcaagtctccaaaaccacagcgttgtatcctagactatgttcccccaggaggtggttcctccctctgcattcccgtactccatactgcttgatatgttcttacatgcaacaccgtgcaattgtgtttagttgattcctgtgaattagaatgagaactctacatgggcatggatttttgcctttcattcactgctgcattccctagtctggaaagctgtgcctggcacacaatgagtcctaggtgaaggtcagtgaagtcattaatgcttgagtcccaacaggcaaacagctggattcatgaatgaaagacttaccgctacatcccttcatcagggtgtatagcttcaactccatttcctggaaagctctacaatagttcttcctcctcaaaaggctctggtcttgtgattcatagcattcgtccaccaagacatgaacaagggatctttatgtcagaggttccctgttcaaagctgttttagaggccaggcgtggtggctcattcaggtaatcccagcactttgggaggccgaagtgggaagaccacttgaggtcaggagttcgagaccagcctggccaacatggtgaaaccccatctccattaaaatacaaaaattagccaggcatggtggcatgtacctgtaatcacaactacttgagaggctgaggcaggagaatcacttgaacctgggaggcggagttcagttggagttgcagtgagccgagatcatgccattgcactccagcctgggtgacagaacgagactccatctcaaaaacagtaaaaataaaaaagctgttttaggaaacatcccttttttattattttttctttgagtcagggacttgcttggttgcctaggctgaaatgcagtggcgggatcacagctcactgcagcctccacctcctgggctcaagcaatcctccgactttagcctcctgaatagctgggactacagacacacagcactccacctggctaattttttcttttttctttttctttttctttctttttctttttctttgtgtgtgtgtgtgtgtgtgtgtgtatgtgtgtgtgttgggacagggtttccctctgttgcccaggctggtcacaaactcctggccttaagtgaccctcctgccttgacctctcaaagtgctgggattacagatgtgagccactgagcccagccctaggaaacagcctcttaagccaagtgcaatgactcttgaactccccagagcctctgtgcatgctacctcgacttcagcttcacagatgtatgcaactgcgggatcaggttaggggcactcacttaccggcagtcccaaagctctggagagtctgtgctgagggaatggtccatgttaaagcaaagcagaacaaccactctgccttttgtattttatacttgttttttttttgaaacagggtctctctgtgtcactcaggctggaatgcagtggtgtgatcatagctaactgcagcctccagttcctgggctcaagtgatcctcctggcagatgggactacaggcgcacaccaccaagcccagataattttttgtatttttttgtagagacagggggtctcactatgttgcccagactggtctccaactcctggcctcaagcaatcctcccgcctccacctcccaaagtgctgggttgcacccggcttgcatttcacacgtttaataaactcaatcagcatgtttcctaccccctagagtgacaatggtgcacattagcatggatttcttatagatcgagaccaaagacctaattacttatctatagaccaatcttggagaggaaaggcagactccaagggttaattcggggtccaggaaccacagaaggaaggtctccttggatctcgtttgagcctgaagtagctcagtctatgacagacaccatcagagggcagaggcacaggtgaacgcagcagtcggaactttgtcagagcagcaaaggacatcttaggaaatgaggcttgcaaagcagccttgggttattgagaaagctctctcagcgtggattctcagggctctgggatcttctctgccttgcaggtgcctctttgttttttgggaggaagcaggtgggtctcatgtgtcagggcagtaaggagcaggaatgaatggatgaaacaaatctgttggggtgggtagcggctgtgctctggggagccaagagagagacagggggatggtgctggtttcagacaagatagttgagcaggaacttgaaagagaaaaggagagtggatcgtggggacctgagaagctggaattctccctggggaatcggccactgccaacgtgagggctggggttaggagcatgcctatggtgatggagaagcctgggggaggtgcctggttgatggggcaagaggagccatctggagagaaggaaaagcctggagtctccttccgggcttgcttaaggactagggaggggcaggacatgagatgatgttggaggattctgagcaggggatgggcctaggtgggaggtggggcagaaggagagctggacgaggacatggtgagaggtgatgttggctcatccaggaaggacggccaggaggaagcagagggaaaggggcatgcaaaggtccagaggcaggagcaacggggaacatccagggaaggagggaagggcaggggatttggagatggggcaccctgagagagggatccaggcagcaggcagacacgacagcctgagcttcaccccagctcacggttggccctgggagggctttgagcagaagaggggcaaacatcagcaatatgaggccacactgcagacgttctgggccctgcacacgcctccttgcaggcaaggcggccagcccacaaggtaatttaattcctggtgcctgtgggcgtcctgcaaagagccagttggcgtcggaacgctcttctccaaaacctgtgccagtgcccccagcgcagacctggtgtgaaggggacctttggagaggtctcatgagcaatgccgcgtgctctgccccacaggttacttcaatgatgtggaccgtgatgacggacgctacccgcccaggcccaggccacggccgcctgcaggtaggtgccgagcctccccagatgcgacacattgaatttgcacagagagggtgggatgagaggcctgaagttggggatgagagagctgaggttggggcagagttggtgacgagcagacgataagctggtgcaggggatgacagagaaggccccatggccgcatcagtggggtttgcggtctgggcatctgtccgcctctccaggctgggggactggatggaaacaaaatgaacaggcagaactggagggtccactgaaacacttgcggtcatttctgtttagacttgtatatgtgtaagtgtgggtgtacatgtccagacacacctttatatatctgcatgcttatcaatcttcatttgtgtgtatatagatgtttatgtatctttatatttgtgtgtatatatgcttttaaatatatataaatgcatctacatatgtaggtatatggtttttttcatgtgtgtatatacatgcttttgtatatatacagtacgtggatacctttctctgtttttatatatgtatatcctgactttatatatatccttatatatatctttacataggtacatgttttatatgtgtatatatatctttatatttatatgcagatatatgctttttatatatatttatgtatatgtatatcgtttaatatatctttttaaaaatatatcttcatgtatatctttaaatacatatacattttatatacattttaatattttatgtgtatgttatataaatatatatctttacatatataattaaatatatgcctttatttatatacatctttatatatgtacatatatacctttacatgtatgtgcctttatttatatatgtatatatttatatatacacttttatatatacatatgtgtatatctttatatgtgtgtataaatgcctttatatacgtacacatatacctttatgtgtatatacttttatatgtgttatgtatgtacacacaactttatatatacatgtgtatatatctttatataggtatataaatgtctttaaatatgtatatacatatcttttgtatttatttatttttttttgagacggagtctcgctctgtcgcccaggctggagagcagtggcacaattttggctcactgcaacctctgcctcccgggttcaagtgatgttctgcctcagcctcctgagtagctgggattacaggcgcctgccagcacgcctggctaacttttgtatttttagtagagacggggtttcaccattttggccaggctggtcctgaactcctgacctcgtgatccacctgcctcagcctctcaaagcgttgggattacaggcgtgagccactgtacctggtctatatgtatatcttctaatgtatctttatatatatctttaatatatctttatatacatgtacattttatatacatttttatattttatgtatgttatataaatatatacatttatacatatataattatatacctttatttatatatctttatatgtacatatatacctatatatgcttttatatatgtatgtgtacatttatatatacacttttatatatgcatatgtatatgtctttatgtgtataaatatcttcataaatatatttatatatctatacataacctttatatatgtataaatatcttatataaatatatattttatgtgtatatatgcattatttgtataaacacatatttgtaaatgtctttccatatatatgcatatatagcttacatatgtttctatactgttatatataggtgtatacctttacatatgtatgcatactgttttatatatgtgtatataggtcccttcatgtatatatgtatatacatttaggtatatgtgtgtgtgtgtgtgtgtgtatatatatatacacctttatatatgtacatttatctttatacacacagacatatataaacacttctaatataaagttttctctgtaattggaggtgaatgtctatcaataatctttcatatagaaatacaagtacagactataggagacagagatgcatacaacattgggctgaagagtgtgatgtttgaggctttattttcaagcatgtgaggtttctggcctgtttagttctgcaattttattttagaagacataaaggacttgtcccagatattttgcaaagctggacctgcatctttcggacaaccagattgcatccagtcatcttttctgccgtgtttacttgcaataaataaagagcgctgtcttaggatttattacaataacaatcaggaataaactaaaaattactagttatttttgaaaggagaagctgagaacatttacgattgagaccatctgctggaaggtcctcctaatccggcgtcggcgtggctgatctcatatcagtttctcggcaggaagcgggtgcgcctgcgtgaatttggagtccccagggtaaatgttagtcccgtgacggcaaagtgtttttgatagctagagctcagtgttggcatgagttttcccacggggaagaggaagctttggtggggccacccttgactctcccctgctggtcactctttggagctctcttggcagtgacacgttcacacgacttgttgccattcccaatgagctggacagaccaacacctgcaggaaaccccacgctcagacacctgaacatccctcaactctaccttctctgtctaacaggaggtggcggcggtggctactccagttatggcaactccgacaacacgcacggtacccctacatctgggcatgcgatggtgggtggagggtgggaggggtcatctttctagggctcccgcttgcactctgccctgggccttctacctggagtctttggtgagtagggtgctgtgtgctggtgcctggtcttctgagaacctgtctgtgctgggctgttctgcttctgttccccaggagggtgggtgcagccacacatacacacacgcatacacacatgcacacacacacacacacacacacccctttaggtaaaagtaaacagagcaaagaactatacaactaattagagaaagagagcatccaacaaactggagagcatccaacaaattctttaggggcgcagctcgcttacttcaagcagaatagaaaacactttcaatggctgggcgcggtggctcatgcctgtaatcccagcactttgggaggctgaggtgggaggattgcttgagcccaggagtttgagaccagcctggacaacatggaaaaaccctgtctctacaaaaaatacatatatgcaaaaattagccaggcgtggtggcatgtgcctgtagttccagctactcaggaggcagaggtaggaggatcacttgagcccaggaggtcgaggcttcagtgagcagacagagataagatcgtgccactgcactccagcttgggtgacagactgagatcctgtctcaaagaaaaagaaaagaaaagaaaagaaaaaaagcaagagaactcttttggtcggtgcttatgcccagagtgaaagccgtgttctacagaagccataaacaggctcttggcttggttgagtttttctcatggagaccaggggaccttgaaaccctcagatcctctccggtttggaaaacgactgaagcaaaatgtcatcactgagaaagaaaacaataacaaaacactctgtaggttgattttaaaccatcatctccgttttaacattttccctttgttaagagttttgtacaccttcaatgaattgagtaaccatcttttcttttttttttttttttttttgagacagagtttcacttgttgcccaggctggagtgcagtggtgtgatctctgctcactgcaaccttggcctcccgggttcaagtgattctcctgcctcagcctcccaagtagctgggattacaagcatgtgccactacacagggctaatttttgtttttttagtagagacagggtttcaccatgttggtcagattggtcttgaactcttgacctcaggtgatccatctgcctcagcctcccaaagtgctgggattacaggcatgagccactacacctggctaatttttgtatttttagtacagatggggtttcaccttgttggtcaggctggtcttgaactcctgacctcaggtgatccgccctcttcagcctcccatagtgctgggattacagacgtgagccaccatgcccggccttgagtaaccatctttttggttaaaactaatatgtgccaagagctctggtaatgtgggaagtacttttttttctttttctttctttttttttttttaagatatggtctcattaggctttgtgagagccaaggctgttggccccctaagttttctctgaatcactgacatgaggcagcttaattaacaggagaaaaagcgtataaatttattgagtggatatacacgcaaaccttcagaaccaagactcaaccaccaatgggatgcaaaagcttatagaccatcttttttaactttgatgttaggttcaggggtccttgtgtagggttgttacataggtaaattgtttgtcaccggggtttggtgtacacattatgtcatcacccaggcaataagcatagtacctgataggtagtttttccatcctcactctactcccaccctctgccctcaagtaggccctggtgtctggtgttcccttctttgtgtccatgttgtcaatcgagaaaaatgacgagacgagcgtaaaagatttatttgccaaagttaaggttaagggcgcgccccaggagacaggtctgtggccttctccgaagatgattttgaaggctgcaaatttaaaggggaaagggtgggggtagggaaaaagagttattcatgcttttgtctggctcagtgaatctgtgtttttttacataagatggcatagacaaatggggcagagggaaaatgcagggaatctgcatgttgcataagataatctggacaaaatggggcaggggagcaatcacatatgatttgtgtctgctgggcgggggtgactgcaaagctgtcgatttgcatattgtcatggtgaaatcttcacagctcactaggattttccttgtgggcaaaatatgggggagacgtgtagcttttcatcttgtagccattttatttaggaaccaaaagggggaggcaggtttgtgtgacccagttcccagcttgacttttccctttgactaaatgagttcaggatcacaaaatttaatttcctttcacaatgcgtactccgtgtttagctcccacttgtaaatgagaacacatggtatttggttttctgttcctgcattagtttgctcaggagaatggccaccagctcgatccatgttgctgcaaaggacatgatcttgttcttttttatggctgtgtatatgggccacattgtatatgggccacatttcccttatccagtctaccattgatgggaacctaggctgattccatgtctttactatttgagtttgctatttgttgttctttgcaggaagaatgtgggctcagagcatggccccaaataggtgacgttggtaaagcaggtttaacgggtggcaagccaggtgatgagagggagacaggaagaggcctgcttagcaagggggtccttgttatgcagatgaaggttcccaggtagcagcgctcagagacgaccatggtaaatgtttcttttcagacctgtaaaggtgtcagagtctccgtttctctctcctacatccaggaaaagcttagaaagggaaggcctggctgcaacagcaaagatcctctacagatgccaatttccccacctcagtctgctggccctggagcggcaatttcaaaataaggcaaagcaatatattttggagtaaaatattttgatgtccgtcatcttcgttacctcggaagcgagtgttgtcatcagatccatttaacaaaatgaaagcaatgcatgacgctcgactgtccacttcaaaggagcaatagctgtggccctataggtagcccatcctcagaactcactccctatgacacagacaagcttcaggatgggagggggctcatgacaaagtgctcattacctggggtcaagaactgtctacttttggccgggcatggtggcccacgcctgtaatcccagcactttaggaggccaaggtgggtggatcccttgagttcaggagttcaagaccagcctgggcaaaatagtgaaaccctgtctctacaagaaaatacaaaaattagctgggcatggaagtgtgcgcctgtggtcccagctactcgggaggtgtaagtgaccctggaagtttgaggctgcagtgaaccgtgatagcaccactaccttccagcctgggccatggagtgagaccctgtctcaaaaaaaaaaaaaaaaaaaaaaaggacactaaaaaagaattgaccaccttcaactcaacgtactatgagatgagttccttccaccatctttctggaactagctaaggggttccccttacctactacctaggtagacctgatttattaagacgggaatcgcaatagagaaagagtttaattcacacagagctgactgaacgggagcatgtgaagcagctatgctgtctggggtacatacctggggttcattgttgcacgctgagaaagaattcaggacacagacacatgtggttgggttaaggagttgaaagtttaatagaagaaaggagagaggagagcagctccttgcaagagagagagggagagagagaaagagagagagagaaagagaagcatctgaaaaagttgggaggttgtggaccgcagcagcttttgtaggcaggctggaggaggtggtgtctgatttacatagggcttacagactggttcgatcaggtatgacttctacatagtgcgtggggaaggctggtggccccaccctaattttgttatgtaaatgggctttccagttggtcagtgccatcttgtctgctacttactgtacatggggctgacaaagaggagggaagatgaagctgccatcttgaacgtgtctaggccctagttcctgccggcattcacccatgtaagctcctagctggcttgtctatgtctgcagctcaactttattttttattttttatttttttttgagacggagtctcgctctgtcgcccaggctggagtgcagtggcgtcatctcggctcactgcaagctccgcctcccgggttcacgccattctcctgcctcagcctcccgagtagctgggactacaggcgcccgccaccacgcctggcaattttttctatttttagtagagacggggtttcaccgtgttagccaggatgatctcgatctcctgacctcgtgatccgcccgcctcggcctcccaaagtgctgggattacaggcgtgagccaccgcgcccggccacagctcaactttacaggctgctctttgttagaaaatgatttggggctgcttttcattaaaaagaaaagccttaccaaggactcccatacccttgctatgtgcctaagtaattaactaattccttcttaactcctatatcaactggaggttttgcttttttttctttaaacagggtttcattttgttacccaggctggactgcagtggtgaaatcatagctcactgcagcctcaacctcttgggctcaagcgatcctcccgcctcagcctcctgtgtagctaggaccacaggtgtatgccaccacacctgcctaatttttaaaaaatttttgtagagatggggtctcactatattgctcaggctggtcttcaactcctggcctcaagtgtttctccgacctcagcctcccaaagagctgggattacgggcatgagccactgcacctagccaagactggagttttatgactcaaatcagcttcccccaaaatttggacactgggctttttaacgtgtaatttggctggtaggagacccgggcgtggggagtgctgagtggttggttggaggtggaatgacagaggacggacatgggttctttttgttgtcttctgttcttgtgtgggacggcagagctcgctgagccgcattaccagtctgggtggcgccggctggtgcatctcaatgaagggtttaaaaaatgtctcaacttcaaccttaggttttacaatagtgatgccatccctaggagcaactgaagaggtttggaatcttgtggcctccggctgcatggctcctaacctattaatataatttctaatcttgtgactaatttgttagtctttcaaaggcagtctgatccccggggaagaagggagtttgtttcagaaaagggctgttatctttgtttgaatgttaagctggaacttcctcctatggttatctgagtctgtgttcaggaatgaactagggctgttcgagggctacaggcacgatgcagtcggttaggtcagatctctttcactgtcgtaattttctcactgttataatttttgcaaaggcggtttcaatttaactgaaaatgtcaggcaaagaccaaatttaatatttttacagaaagccactgggagtagttttttattgttttattatttatttatttagagacagagtctcactctgttgcccaggctggagtgcagtggtgcaatcatagctcactgcagcctcaaactcctgggctcaagcgatcctcccacctcagcctcccgaggagctggggctacaggcacacaccatcatacccagctaaatttttaagaaattttttgtagagatggggtctcaccgttgtaactgcccaatgggtttaccttgccccctgcctaaacagggccgatttatcaagacagaggaattgtaatggagaaagagtaattcatgcagagccagctgtgcccgagaccagagttttattattactcaaatcagtctccccaggcattcagggtccagagtttttaaagataatttggcgggtaggggcttgggaagtggggagggctgattggtcaggttgcagagggaaccataggggggtgaagtgaggttttcttgctgttttctgttcctgggtggatggcggaactggttgagccagattaccgggctggctggtgtcagctgatccatccagtgcagaggctgcaaaatgtctcaaacaccgcgcttacgttttacaatagtgatgttacccccaggagcaatttgcagaggttcagactcttgagccagaggctgcacgacccctaaaccataatttttcttttcttttcttctttttttgtttttttcgagacagagtatcactctgttgcccaggcttgagtgcagtggtgtgatctcggctcactgcatcctctgcctccctggttcaagcaattctcctgcctcagcctccccagtaactgggactacgggcacatgtcaccatgcccggctaattttcatatttttaccagagacggggtttcaccatattgttccggccggtctcgaactcctgacctgaggcgatccaccctcatcggcctcccaaagtgctgggattataggcttgagccactgcgcccagccctaaactataatttttaatcttgtagctaatttgttagtcctacaaagtccaactggtccccaggcaagaaggaggtgttttcaggaaaaggctgtgatcagttttgtttcagagtgaaaccatgaactgaattccttcccaaagttagttgggcctatgcccaggaatgaacaaggacagcttaagggttagaagcaagatagagtcggttaggtctggcctctttcactgtcatcatttcctcagttacaatttttgcaaaggtggtttcgccacgttgcccaggctggtcttgaactgggctcaagcgatcctcctaccttggcctccataagtgctgggattacaggcctgcaccaccacatccggcccaccttggagcgtgttatataaagcgagccgtccccacacccctacagcctacgaatgagccttttcaccccatgcacgattctctgaaactgctctctgtaaggagctattcgggacacgttcttttgttctctggcatactcatcaggtagaaagaagtgattcagcaagcggctcccctgagagccctgatcgtttcctgttttcctgtgaagttagtctcgggaggtctgcgctgtgccatttttgggggaccattatctggctcccgaatggatcaaagcttactggtcagggggctgctgtatccctggggcaaaactgccagaaaatagcaggtagccctgtggtccttggcagggccagggcccggtggaagcagcagctgggccaagaacatcaggcgtgcatgaggcacagcccagttttgggagcatgacgcttgttttcgaggatgcctgtgctccccttcctgcctggacccctgctctccagccccggcagagcgaggctgtgagtcagcgctcggattagcatcagcatggaggtgccggctgggatgcaagccgccgccatgggatgagtcacgcggcttctccccgaatccccaaaggaggcagagcgtgttaggcttgttctggcttcatgcagagcactgaggggtgagggctgaccgtggctggccgcggagggaagcccaaagtctggcctccctgcggagactggggagaaaatgttgcgctcgtcgtttttaaatactgggggacaagtttcccttgtctgctaaggctgccattgtaaattacaagagtcaggagggctgaagcaaaagggatttcttctcccacagtcctggaggctggaagtctgagatcaaggtgtgagcagggctggttcctcctgaagcctctctccttggctcgtcgacatcatcatctccctgtgtcctcacagggtcgtccctctgtgtgtgtctgtgttccaatctcctctccttatgaggtgtcttagtccatttcaggctgctatcacagaatactatagactgggtggcttagaaacagcagacattgattctctcaccgtcctagaggctggaggtccaagatcaaggtgtgagcagggctggttcctcctgaggcctccctccttggcttgtagacaccatcttctccctgtgtcctcacagggtcgtccctctgtgtgtgtctgtgtcctcatctcctcttcttataaggtctgtagtcctattggattagggcccaccctagtgatctcgttttattttaatcacctctctaaggacgttgtgttcaaatacagtcacagtctgatgccctgggggttaggactgcgacctgtgaatttggagggggatatagttcagcccatagaacccactatccacataagtcattccacttcaaaatcagcacaaagcattagttttaaaaatctcaaatctgtatttttaaaaattgctcttaacacattagaaaaatatagaaaaactttttttgctgtttttctgagacaaaatctcactctgtagcccagcctggagtgcagggacgtgatcatagatcattgcagcctccacctcctgggctcaagcaatcttttgcctcagtcgtctcccaagtagtagctgagactacaggtgcacatcaccacacccagctattttttttttttaagtagaaacggggtctcactatgtttctcaggctgggctccaaatgagctcaagtggtcttaccgccttagcctcccaaagtggtaggattacaggtgggagccaccacacccaacctggaggaactctttttttttaaaattttaaataaattactatttgtggcctgcgttttcatcctattctctttttttttaaccaacatttgctggcatttttttttatgccgaagaaaacacctttgcccatctatgtcaggcctccagaccctcagggatgtacatctaatgcaccttcagccaccggtgtaaacagtaaacaggggccagatggcgcctgtgcaccttccctggccttgggagagcattggaatctctgcagcttttaagagcatcttgcttcaggtttgctgacctgcttgcttctgtaagatcatgcagacttcctgagcaatatctagcatttcatggtctcttttctatcctgcaggaagagggggctatagactcaactctcgttatggaaatacttatggtaaaggaattatgtcttacagaatatgtgaggcaaaactgtccatttgcaaataactaacacactgtctgcactgatgggaagctgatgctttcatccagtgcacaaccaactggccgttcgagtctctcatttgcattttccttggtcatccatgctggggggagatgttgtgcatgccctgaggacttcatttcttcaaaggaactatggcccacttacaggtgttactgggtgcatgtgtgtgcacgtgtgtgtgtatacatatgtgttcacacacaggtatgcttgtgtgtattgtgtgtgcatgcatgtgtacatgtgcatgtggattttgtaatcatgtgcataagtgcatgtggatttcatgtgcatgtgtgcaagtgtctgtgcacacatgtggattgagcacatgcatgtttgtgtatgtgcacagatgtgttggcatgtacttgtggattttgcatgtgtgcatgcttgtgcttgggttgcatgtgcattgcatgtttcccatgtgtgtccattcacatgcatacatttaggggtgtgcaagcacatgtgtgcatgtggatagatgcaggagtgtgcatctgggtgtgctcgtgtggtatgtgcatactgcacgaatatatcatgtgcatctgtgcatgtggattgtgtgtatacatgcgtgtgtacaggcatgcacacacacacatgaatgtgtttgtgtgtgcatatttgtgtgtacatgcatgtgtttatgcatacaggtgtaaacatgtgcacacatcggtgtgtgcatgtgcacacatgtgtacatgtgtatgtttaggcgaattgtgctttatatgtgcttttgttgcctgtgtgtgtggtatgtgcatgtgtgtgtatgtggggatgtgtgggatgtgcatgtgtgtggatgtgcacattgcattgtgcttctgtgttgcatttgtatttacatgttgcacatgtgtgtaaatgcatgtgtgtgtgcacgtgtgtatgcgtgcttgtctgcctgtgtgttgcacgtttgttgcatgctgcatgtgtgtatgcatgtgcacacacatttgtgcatgtcagtgtgtgttgcatgtgcttgtgtatgaatggcgtgcgtgtgtgcatgtgtgtccatggggttgtcagcctgtgtgtgttttgcatgcgcatgtatgtagactctccaatcctgaaattaaagctgcatctccctctccctggtattatccccattctgctaatgaccattagacatggcatacacattcacattcctcctccttatgctgcttggctgtccccctccccccacaagaatgtaaattccctgaaaacagggatctgtgtgctgtgttcacagtcgcatcctcaacagtgcccggcaatataaggccctccataagctctgctgaataaacacgaacatccttttccgcttacaggtggagatcaccattcaacgtatggcaatccagaaggtaactgattgactcacccggtcccaacctttaataagagcacactctcctagatcagtgctgggaggagctgtgtgggcttctgtttcccaacctcatgactttcacggagcactcatactttgtatgtatataaagtagctcctgaataaaaatatctgaccttcagcacaggaccaatcagagttcagagaaaggagaggcaagcattggttttcactgcagaagatgccccttagctctcaaagcaaggctgtgaatgagtgctgagactattacatttctcccagtaccaccattactcccctttctttgaccagcactaacttgaaacccaagaaggacaggagaaaggaaggtatgaacactctgcccaaagaagccatcagagtgcactgtcaatcccgtctcaggtcaaaggagggagaacttgaagcccagaaggctgactttgtgtcctgtattgttgggagaacaggttccccattccctaagggtcatattcttagagatttgggctgacacctgcttgagtttaagttgagagtaaacgcactcaaccccaaggctcttgtgagttttcaattatgggggaggagaaagtgattgaaggtgacctctacctttcaatgatcatgcagagtactagtatcaatatttttggggtatgttggcatccttagaaaaatttatggtttcacctttttccctctgtggtgtaaagtgaggtccagagatggaaagggcaaggcaaataaacaagtaattgcagtcaaatctgatgaataatttcctggaacatatgggatcctgtagcaaggcagaagggatactcctagactaggttaggtgagggaggtagggtttcctggagagaacaatatccaagccaatcccccaaaatatgggtgggaggtgcccaggagaagagtgaggtgtcagggaagatggtgcactaggtagagctggatacacacgtggggacaccggaaattgtgtagccaggatgtggaatgcaacgggaaccagggaaggatgcaatggtgaccaggaaagacctccaggttagcagaggtggagtctgcacttcatagaaccttcatgggaaggagcctgcccctgttgatatgtaggtgaagaatggacctgagggggctcactaagacccagggagacaccctttcagaccagttcagtactccctggaaatgatgacaggctgaattaaagcctgggcaaaggaggcaaagagaagcagtcagcttggatgaccacttggtaatgacaattgattgtacttgattgatttgtaagagatgagagagaggaaaaggtatgtatcagtcagctatgctgtgtcacaaaaaaccccaaaacttagtagctggaaataacaaccatttattatgttcgtgattatgtgagtcagcaatttgggctgacaccattctagtggtcctcctggtctcttctgaactccctctcttgtgtgcagtcaactgtaggtgtggccagcgctttgaccatgtttcctgggtcttcttatgtatctgggactttaggtggaatggctcatctcagcttcatgtgggctctcacatccctccaggaagccaggccaggcttcatcacatggtgaccagacagggtaccaagagcatgaagagaagcgtgcctgggcttagagccaccatgccttcacttgtgtgacattctgttggctaaagcctggattttcagaatgaagatgcagctccacctctggatggggaacactgtgaaatcatactgtggagcgtgttcatgtagggaggggaagaatagagggctgtctctcccaggaggcagggtgtggcgggcggcagcatcagccgtagagcaggttcttgcgttcagtgacaacactcttccccccagcatggcagcctcattcgtggagcagtcttgtgtccctcacctatgccatgccatgtattggcccaggtgttcaaccctgtctgaagaaagccatgcatggaaagggtggctatttcaaatggaaacggtgatttcttccttttttccctttggaagtgttgatttttgtcacatcaagctccttcttgttctttgtgcaggagtgccaaagctctggagcaatttgccatcgaggcattgaggatgcttgtgtctagtgtgtgcttgggtctagagttccagcatgcctttgaaagcaagcctatctggcagtttttagtggaacaatatttttgcatgagtgggcattctacatctaaaaaggcacaaaatagttttgacatgtgcctgtcatcccaactactcaggaggcggaggcaggaggatcacttgagcccaggagttcaggacgagcttaggcggcatagtgagaccccatctctaaaaaaataaatcaggccaggcgcggtggctcccctctgtaatcccaacactttgggaggctgaggcgagtggatcacctgaggtcaagagttcgagaccagcctggccaacatggtgaaaccccatctctactaaaaatgcaaaaattagttgggcatggtggcatacacctgtagtcccagctattcgggaggctgaggcaggagaatcgcttgaacccgggagaaggaggttgcagtgaactgagatcacgccactgtattccagactgggcgacagagcaacattccgtctcaaaaaataataagaaataaataaataaataaataaataaaattaattaaaaggcatacatgaattgacttcaacaaacaaacaaaaatgccaagtgcctcgtctgtgcaaatcctggccttggatgtcttcagtggtaaaatgtggttgacaagcttggctctttgtgaaaacagaattacttcctaaggtttttttttctttttttttaaattaagtttctcttttttttctgtgaatacaagggtgggaagggacgtgatggagaagttactagatagatgcaaaagttattgcagtttttgtcattactttcaatggcaaaaaccgcaataacttttggaccaacctaatatttaagcagttttcctgcagccatgtttttttctcggatgagcttgctttttctccactcctgcaggcaatatggtagcaaaaatcgtgtctcccatcgtatccgtggtggtggtgacactgctgggagcagcagccagttatttcaaactaaacaataggagaaattgtttcaggacccatggtaagtttggctctaaacattgttttgcttgttactaagcctgatttaaaaaaaaaaattactttcagatgtctgtcactagcaaggttatttctggttaagttcaatatacataacttgcctaataatgtgattttttaaaatttatttttattctttttgagacagagttacactgtgttgcccaggctggactgcagtggcaggacctcggctcactgcaacctctacctcctgggttcaagagattctcttgcctcagcctcccgaacagctgggactacaggcatgcaccaccacgcctggctaatttttgtatttttagtagagatggggtttcaccatgttggccaggctggtcttgaactcctgacctcaagtgagctgcccgccttggcctcccaaagttctgagattacaggcgtgagccaccgtgcctggccaacaattgggttttcatggtcaggtgtgagctgtaccttcctctaaaccttgttacaatgaggctggcacattatctgtctaatgtaaaagaggaggagaaaaaaaggaaagaaaaagaaacaaacaaacaaaaattaccaacctacattgcaagactataagcatgacggttggtttaactacctgttctgttttgtattcagtgaaattttcgtcacaggcgagtcaggaaaaatacctgggttgaatgtgaatgttttgcccagaaccccacccgcaaagaaaactaccgaaacactgaattataagcctctctgaaattccgaaggtgcgctcagaccataggggagaggaaagatctgctgtggcttcctggttcaatgccggctccacactcctgggtttgaagaatcacttgggatttgagagcagaggatgccctaaagaaatctctgaaacaacagtcagggattgttttatagcctaaagagtgactcagatctttaactgggtgtctctggaggcttggtttaaacctcaggccacccacgtcagaatctgtctggagtttgcccagggccctctaactcataccttctttgtgtccccgaaggaaaccagaaaggggtgcccattcctacggtgtttgctttaggatttgcatttggcctcaaaaatcctaaaaccttcccatgcgctccctctgctggtgaatgggcagtatcaaccgttagctaatgaacctccgtttggggtgagcctccgtctacattacgccccgtcctgaaattttaggaggaaactgagtttctgaaaaactgccttattttcctggcaacctgagagcagattcttgggttcagtgacaacactctttcacccaacatggcagccatcattaacgaacaccacgtgttaacttcagtagcttttgtggcagtgatttgtaagcctttgttaaccaagggctgaaactgagtaagcagagagaggcacccatctccacaagcacaaaatgtaagggcggggtacaggggtcccccacaaactcaataatcaaggcaaatatattttagtgcaatattttagaaggaaaatcattggaatgggggccagttgagtttctgaaataggtgtagttttaaaaacgtggatgatgcctgccccatttatctgaggtggaaggaagcacgtttttgctaaagaggtataatgtcttgaagctctttcatgccttttggctgcctggtaagtatttttgtctactttctccattgtacttcgatgataccctcaccaggtattcccaagcaccaagtttatcttcccctcccttaaagttcctgagatcagaaaggaggatgtagacagagtgagctgatgttagggagatctcttcaagggtgagcagtgacatttatgtggatcctgggcctatatcacctcgctggctgtaaagcctttatactatctaggaaatatgtgcatgacagcaaatacgtatgggtttggtatcaaatggggctcagagctctgcgaacttgactctaaagttccaggctgctgctaatggtacccagctgtccacctctccttagttaggtcattaattttctctgtctcctaaaggatgacgtacatggtatactaaccatatccatggtgatgtggtgcagtgcacaacctgtggaactgtgtacctgctgaggccatacactgaagcttgcacactttgtagagaaagagttgtagtaacagagctacacagatagaagcagatgtctgtcacttgatgtggacttttaagaatcatactttgcttttattttataaagtggagcaaatgacaacatcacttcagaagttataaagaccaacaaggccatattcgaaaaaagaagttcctacaaatattagttttaaccaaaaaggaagttactcaattcatttaagatcatcaaaatccttaacaaatggcaaaatgtcaaaaacaatgttttcaaaacgaatatttgtttccagatatgattttaacagtttttaaatattttctatttttaatttttcctgctttattgaggtatagttgacaaataaacattgtatatatttaagatgtacaacttcatttctgcatcatttatttgttctaatctatctccttctgccgaatgtaaagcaggtgtcatgtagacagcacatagtctgatcttggttttcttttttttaaaatagatttttcattcttctagctttattaaagtatgatagacaaacattgtatatatttaagatgtgcaacttcatttctgcttcatttttttctgttctaatcttccttctcctaaatctagagcaagagtctcttgtaacagcatagaattggatcttggttttctttttctctgtttaataagacttttttttttgcccccacaatgacatttgtttctaatcttcctttcagaaccagaaaatgtctgaagatgttaagatcccctgattactttgagaaaaacaactaaaacaagaaccgtgtttatcactgttgtggagatttccttttattcttgacacaatttgatgacctaaagtgtgttttcttctgtgtaaagtacatgagctgcctcactaagcattcccaactcattg

SEQ ID NO: 2918 - DNA, 59291 bp, human
ttgaagacatcgcctcccttccttccaagctgggagaccagaagtcaacaacaggagggtggagaggccgggtctcacaatccgcttggctggggagtccactgaggttcttgcatcctgaagcaaaccatggagagctggtggggacttccctgtcttgcgttcctgtgttttctaatgcacgcccgaggtaagaggcattttgctttgagggagatctgcctgggcatggatttttctattcttgctttaagaaactctttccaaaggagttgctatgaagtgaatggggataatttgcccaatgggattagaaaggagactaagagcgatgggtggctgagaggggagggagaagacgggctgctcccatttggaatctgggaattagatccagaagggcaggatgttagctgataccatctagatattcgccatattttcctgttttgatccatgtgtcccaagcgtttaaaaaatgacctatttaactccatgattcaagcatgactgggtgtgtgtggaatgtcagtcatttctttctgattttaaaaattagttctgaccatttccatacagtaaaagtagagttgaaactacttcatcccgtggggcagattaccagagattcgtttgccggaagggttgcatttattcagatttttaaatcttttcctaaacactgtcattcattcttgcaaattaaaaccacctgaattgttcacatcaaaaacttcgatataaacttgcaggctggctgtcccagatccaagattagatttttcagttccgtacgaggacctctttaagaaactccaatgaactcataaagtacaggatttgaacaacggttgagtaagtttctttggtcattttcatgtggcgatttcagagaagggaacacctgggcgcatcttaagagagagaagtatttctgttaggagttaaaacacatcattcagatgtccctgtggcagcatttcctgtttatcctatttaaagacatggacgtcattaagattggagttggttgtttatgggcggaggcggtgtcgggatggatagatcctggtggacatagtctaggatctgcagtgagaattttttattattctgtgctgtcttcagatctcacctagtaagtggacaatgtggccatgcattcattagcttctgtttacagggagatgttcaacagtaaacccacctccccagaaaagtacttccaggagtttgtatcattcacagtaagagccaaaggttaaccatatccccttgggcaaatcaacttctacaaagtgcggatacagacagttcccaacttaccatggtttgacatgatggttcaatttaagatttttcaactttacaacggtgtaaaattggtatgcattcagtacaaacgaaaactgtactttgagtacccatacaacttttcttttttttttttgagatgtcgtgtcgtttcattctgttgcccaggctggagtgcagtgacacaatctgagctcactgcaacctccacctcctacgttcaagcaattctcctgcctcagcatctcaagtagctgggattataggtgcccaccaccacacccagctaatttttctatttttagtagagactgggtttcaccatgttggccaggctggtcttgaatcttgacctctggtgatccaccggcctcccaaagtgctgggattataaatgtgagccaccatgcccggccccatacagccattctgtttttcactttcagtacaatgttcaataaattatgtgaggtatgcaacacctcattataaagttgactgtgtgctagatgatttgtccatccgttggctgatgaaaagtgttctgagcactctgaaggcaggtaaggctaagctatggcgtttggtagggtagttgtattaaatgcacttacaacataaaatattttcttttttttaatgtgttttaatttttttgagggaggggcccactgtgtcacctagactggagtgcggtggttccatcatagctcactgcagtcttcaccccaggggttcgaacaaacctcccacctcagcctccagagtagctgggactacaggcatttgccgctgtgcctgactagtttttaaaactttttgtagagacgggatctcactatgttgtccaggctggacttgaacatctcagctcaaacgatcctcctgccttggcctccccaaatcttgagattacaggcatcagccaccataccctgtcctgcgctaaattctttgactgacggcagcacttcctatgcactaggcatggattaacttagttgattgtccctcagccctatgacgggagtgtcgtgcctgatgtcattttacagatggtgtattagtcagggttctctagagggacagaactaatgcaatagaaatatatatagagagaggagtttattaagtattaactcatatgatcacaaggtcccacaacaggccgtctgcaggctgaggagcaaggagagccagtccaggttccaaaactgaagaacttggagtctgatgttccagcatccaccatgggagaaagatgtaggccagaagactaggccagtgtctcttttcacatttttctgcctgcttatattctagccacagcggcagctgattagatggtgcccacccaaattgagggtgggtccgccccttccagtccactgactcaaatgttaatctcctttggcaacaccctcacagacacacccaggatcaatactttgtatccttcaatccaatcaagttgacattcagtattaaccgtcacagatatgggtaaactgaggcactgaggatttggacgggggcagccggcagcggaatctgagctgtcctgtagctctgtctgggaagactccagtgagcatcccgctctatcccaagccttgtcttctgaaaatcagaatcatccctcctccaagtgttacaggaaaggggtccggatccagacgccaagacggggttcttggatctcgctccataaagaattcagggctagtctgtaaactgaaaacaagtttattaggaaagtaaaggaataaaagaatggctattccgcagagcagctcttagagctactgcttgcccatttttatggttatttcttagtgatatgctaagcaaggcttggattattcatgcctcccctttttagaccatgcagagttcctgacattgccgtggtatttgtaattgtcatggtgctggtgggagggtaacactgaggacaaccagaggccactctcatcaccatctgggttttggtgggttctggccggcttctttactaccacctgttttatcagctaggtctttatgacctgtatcttgtgcagaccttcagtctcatcctgtgactcagaatgccttaatcatctgggaatgcagcccagtaggtttcagccttctattgcccagcccctattcaagatggagtcgctctggttccagtgcctctgacacaagtagcgccccttagggaggttacaggagggactggaaggaaagtgaggtctggatcagggcccttctgtgtaaataagatgatgtacatgcagcagctgggtatgtcctgggtaaaaattagttaaatgcacagacgaccctgtttcatccccagccatcaccagctggaaatggggcacattcccaagatcccaaaaacattctgcaaggctggtgcgatgattgctatgaagtacttaagaaaacagattattgttcaggatcaatagctaatgcatgtggggcttaatgcctctgtgacgggttgatgggtgcagcaaaccaccatggcacatgtttacctatgtaacaaacctgcacgtcctgcacacgtatcccggaacttaaaataaaataaagaagacagaatattgttaatggttaatatgctgtaaatcattatgatgattactaaattatcaatacaaaagaagataatagcaagacggccatattcctaatagaggttgacattttagcagccctacatttccactgtatttaattagtatttgccgtccaatccagaggggcatgaaggagcacgagacaaaatcaggtcttctaacagctgagaagaagctgagaaccagaagtggaaaccccaaagggcagtgtatgaaatgtcatttattgaggggaaaaaaaagaaaatgacagagttcgatagaagaaataagcactagtgtttacataatcagtagggtgactttagtttacaataatctattgtagacttcaaaatagaagagtcggaatggttctaatatgaaggaaagacaaatatttaaggtggatggatatcccaagtaggctgatttgatctttacaaattatataaatgtattaaattattacatgtaccctgaagctatgtacatctgttatgcatcaattaaaaataaattaaaagaaaaggatatatgtccaggatatacaccagctaagacagtctcttccaagtctattgtacattattcccttatcagatttgaaacctgagagttccctgacgccccctcacaggatgtgcaacaggggtgtgtttgatctgtttgaccgccacacactgaaacctcttatgggaggcagaacttgcagacgggcaggtgcagcagctagtgtgagtgtttttgagctctgggccccacggtagcatctagggatgggtgcctgcgacccccgaagccctagtgggcgttttacggtgctcttttagctctgccatccgcacgtggcttaagtgttagccagctcagtgccgtcttggtacccgggttcttgtccagcatccaggaagaatcaggtcacacgaaccagctgaaggatggtaaatgcagaagagtttgttgccagatggagatgactcttagcgggatggttggggagttggaaaggggatggagtgggcagatgatcttcccctggagtttggttgtcctgcggctaatctcttctccaaccatccccagctgaacacctctcagtgttcagatgttccttctcttctctccttctctgctgtgctgctctttggttcctcaccttttctgctcatctgtctgtctgcacatggggtctggggtttggggttatatgggtacaggacaggcaggcatggtgggtcaaaaggcaacatttgggcacaaaaataggaatgcctgtttccatttaggactacaggtttccaggcttgagggcggggcctttgctggggaactgccctcttgtatctagtatcttcaggcctcctgtccgtatcaacatgacttaaaatgtgtgtgcatttgtatagagctgtgtttctatgtaaagactaaaaaagacttatgaaaaagatcactcagagctctgaacagtagcaaatcatatttctgagtacttcctgttgagtaaaggtaagtgaggattgtgccaagtatttttcattacttgctgcattaggttgtcacaggctgtttagtttacttctaaaaattgggatatggggaagttgtgggccgggcacagtggctcatgtttgtaatcccagcagtttgggaggccgagttgggcagatcacttgaggtcaggagtttgagaccagcctggccaacatggcagaacgctgtttctactaaaaatacaaaaattagccaggcatggtggggggtgtctgtaatcccagctattcaggaggctgagacaggagaatcgcttgaacccaggaggcggaggttgcaatcagctgagatcataccactgcactccagcctgggtgacagagtaagactccatctcaaaaaaaaaaaaaaaaaaaaaaaaaggaaaaaaaagttatgatgatcgcctaaggtgagaagccataccacgccagcgtacagaaccccaaaccacgccagcctcatcctacgtctcagttatatttttcttgacttgcttccattctggtgccccctctctccctgccccctccttccctgcaaaggatctagcaaatttgtaggtgtggaaagggaaccacaaatgggtcatttccctgccattgtcacctggagcgtgtagccatttcgtgcagtgattctctgtctttgatgtgcaggtcatcaccttgaagggaggaggtattaaaagcgccacccagtccccacccactgaggtctttattcagcaggtgtgggtcaggcatttgggagctgggagacctgcattttaagaagcaccccaggtgatgcccaagcggagctatgtgcttcttttaagagatgatgactccgtgtgcaaccgtgtggttacctttgcgtggagtctcatggatcactgccacagtggggaggcagctctgtgctctccaattcggtgatgtgtcattcactctatgcaggcccaaggtgacacccccagatacaggtgctgccatccagccattctcaaccagggatcatgtttatccacagggacacttgtcgatatcttgaggctttgcgttgccacactgatagcagggatgctgctggcatctagtgggtggagcccagggatgctggtcaacaccctgcagtgcacaggacgccccacagaaaagaatgatccaacctcatatgtcagtaggactgaggctgaggaatcttgccttagcatgagagatcctgtctgtctgtctgcctatctctagatctatctatcgtctaccattatccatccacctatctgtctctattatatacacctatcatctacctaatctatctgtcaatgattttctgtcatctattatctatctatttatctatctttctacctacttctctatccaactctcatctctattacctatctatgtatctatgtatctatctatgtatctatctatccatccgtctatcaatctatctatttatctagcagtccatcatctatctgtgacattcttctgctacccagggataattgtgttcctcgagtaacacttggcaatgtctggaaacaattttggtagttgcactgggatgggtgttctcgcattcggtgggtggagacaaggcatgttgttcaacaccttacagtgcacaggacagcacccatgacagagagttacgcagccccaagtgtcattagtgctgtagtggagaacctgctgttagttataacttctaaccctgcgaaaggggacaggttggaaatgtcatgctcctgtacgctgtaggaggtatagttgtctggaggtatagttgtctggaggtatagttgtcctgtacagtataggaggtacggtatagttgtctgggcatttctaaatggatcttactgtcagaatgcacttgtaggatcttttccccatagggcatagagccatggcacatataacccagaagctgagcattccatagtttccttcttggagtaggaaggggctgtgcagaaaaagtctatggctgtttggcacctgagtgtgaagacatctggcaaatattggagccaattagcagacaagcacggagtccaagaaatgtctcccctttcttggataacaactgacccttcctgtgagggcccccctcattccagccattttcctctttctcattggcacacagggggtagaaaagtggggttctgcctgcaggtggggctctgccagacacggcaaagctcctggggattcccccgatggatcaggggccagaggcacctaaacctgtgagcgatgtgtgcagccacggtgctgaggctgggaaactctgctgtagtctgtgaatcccaacctctgggaatgcttcagaatcagattctgggctgatctggaatctgcatgtggctggattctggtctgatccaggcatggaggcgtgtgcctgtaatcccagctactcgggaggctgaggtgagagaactgcttgaacctgggaggcagaggttgcagtgagctgagattgtgccattgcactgcagtgagctgagattgcaccactgcactccagcctgggcaacagagcgagactctgtctcagaaaaaaaaaattaaggaagagtattattgagagcgtaggccaggcgcgtgatgttgctgagatgaaactgtctctctagattcccaaaccctggttatctccactgaaccaggctgtccaatggcatccccattgtaattgaccatgttccatggtttaaatctgttgtgagccaaattgtaccctcctcaattttacaaatggaagtcctaacctgcaggacctccaattgtgactgtgtttggagatggggtctttaaagaggtgattcaggctgggtgcggtggctcatgcctgtaatcccagcactttgggaggctgaggctggcagatcatgaggtcaggagatggagatcatcctggctaacacggtgaaaccccatctctactaaaaatacaaaaaaaaaaaaaaaattagctgggcgtgcctgtagtcccagctacttgggaggctgaggcaggagaatcgcttgaacctgggaggtggaggttgcagtgagccgagatcgcactactgcactccagcctgggcgacagagcgaggctctgtctcaaaaaaaaaaaaaaaaaaaaaagaggtgattcaggcaaaatgaggtcactaggttgggccctgatccaacaggactgcagaccttataaaaagacgagatgaagacacagacatgcacacagggacgatcctgtgaggacttagggaaaagatggcatccacaagccaaggagagaggtctcagtaggaaccagccctgcccacaccttgatctcagacttccagcttccaggcctgtgggagaatcaatgtccactgtttaaacagcctggtctgtgggactttgctatggcagcagccacagtggacaaacacatttgtattccaatgaatgagttacctctgtaagggttgaattgtgcgtctccaaaatttatatattgaaggcctaatccctaggacctcagaacatgactgtgtttggtgatggggtctttaaagaggtgagaagggtacaatgagctcaggaggttgtgccctgatccaataggactggggtccttataaaaagagtagataaggacacagacacacacagagggatgaccctgtaaagacacagggagaagagggtgtctacaagtcaagaagagaggcctcaggaggaaccagctctgcccatgccttgatctcagaattccagcctccaggactgtgggagaataaaagtctgtggtttgtaagccacccagcctatggtattctgtgatagcagcctgcaatggactaagacatctcataagaagagcagatgaggacacagacatgcacatagagggatgaccacgtggggacacagggagaagatggtgtctacaagcccaggacagaggcctcaggaggaaacagccttgcccatatcctgatctcaagacgtccagcctccagggctgtgggagaatcaatgtctgttgcttataagccacccagtctatggtatgctgtgacagcagcctgaaatggactaagacacctcataagaagaggagatgaggacacagacgcacacagagggatgaccacgtggggactcagggagaagacggcatctacaagcccaggagagaggactcaggaggaaccggccctgcccacaccttgatctcagacttccagcttccaggactgtgggagaatcaaggttgttgtttaagctgcccagtctttgggattgcattgtaacaactctgggaagccattaccaagtctctgtcctgcaaagtgagatccatggatctgcagccttgacatcccctgggagctgatgagaaacactgtgtcttgggcccagacagacctgctgaagcatagtctgtgtgtcacccatgtcctgagggatccgtgtgcatgccactctgggaagacgggtttataacacaccgtcaaccagtgcctcattgcatggtctgcggtattttcctcgagttttccttgcaccaaagatgtcttgctttttgtgatgaatgatcattccttcctcttcgacgacaaaatacttcgatctctgcagacaccgtctgttgtgttacagacagacactgaggcctgaattctcattaccaatgtctgctctaatagagcttcaatctgcaactgcataatatggtcactgggaagtcaagaacggggccagttggttgaccttctggggagaggctgggctgcttggatgctgagaccgtggagggttcatgggttccgaggagcagatcatgcaccagggcggcctgctcagctctggtgtctgcagccccggtgagcttgagcattagggagtccctggatattcatgttgaggtgtggaggaggagactccagctgtgtttgatttcctgtcctgctggaaatataaacttcttaaccaattagagaacagaatggatttcatcttatccatggggctaaagtagaattcagcccttggcaaacaagccccccgggaataagattccccattggggcagcagccttccttgtcactttctgttgcaacctacggtcctaacctagtcatatgatttaattttttttactctgtgaatcatgccgtcctgggagagagtgagatggagcaaggacaaccctcttaggggcctgccaggcactctccctagcatggaaataaaggaaaaccttgagttccttcaagggaaattccaggcacctcgctggccttgagaagtacatggagcagcttgataagcaagaaggtgattgtagtgtagaacaatagccaaggaagttagagcctcaatatgtttagtttcctgtaaagactaaagataacatccttttttgagatggagtcttgctctgtcacccaggttgcagtgtagtggtgcaatcttggctcagtgcaacctccagcacctcctgggttcaagtgattctcatgcatcagcctcccaagtagctgggactacaggtgcacaccaccacgcccacatttttgtatttttagtagacacagggcttccccatgttggccagtctggtctggaactcctgacctcaggtaatctgcctgccctggcctcccaaagtgctgggattgcgggtgtgagccaccatgcccagccaagataacatcttactatatggccctgagttgattttcaggaacccagacccccaccaaataaaaaatgccatctgctggctcatagacgttgggtaagagaaactgaggcctgaattctcattacaaatgtttgttctaaattccttccctggggcatgtggcggtgggaggggggtggaaggggggtgaggggacgtgctggaggaagtcacaccaatggccacaactaacattgatttctgctgaccccaaatgctcagacaaacttggcctccttaaccaatgacaaatcagagaaactttgaatccacattaagcccctgcttccaggtatcccgcctttttagatcaaagcaatgtatagcctgcatgtattatggctttgcctgtaacctctgcctccttgccattgaaaaccctcagctactggccacccaggaggttgggtcttgaggcatcaaggaggttgcttgatgccctctaaatagctcggaataaacgcctcacttcctcacgctgcaatcccaatggcggtgttcggctttactgcacagggccggtggacctaagttgagttagtgggaggtgttcgaaccagggcaactccaggttgagtaggggctgtgtaaaatgaggccgagagctgccgggctgcattcccggatggtcaaggcattctaaggcacaggatgagataggaggttgacacaagaaacaagtcataaagaccttgctgatgaaacagcttgccgtaaagaagtcggccaaattttaccaaatccaagatggcgatgagagtgacctcgggtggtcctcacttgtgtcttcccaccagcaccatgacagtttacaaatgccacggcaatgtcaggaagttaccctatatggtctaaaaagaggaggcatgaatgggccactccttgtttagcatatcctcaagaaagaaccatacaaatgggcaaccagtggccctcggggctgctccgtctatggaggagccattctttattcctctgcttttctaataaacttgctttcattttatggactcgccgcaaattctttcttgtgcaaggtccaagaaccctgtcctggggtctgattccagacctctttccggtcacaagttcagtcacaagaaccattatcatatgctttctatatatacacataggtattttttaattgctgaactggagtcaaagagaaaccttaggatttgcctgaaggaagtcaagatttgtccttctcggggtccctgtgccagctttgtaaaacctcggaactttcccctctgtgggcttcctcaagctgaggagggctctatgggcttagtacccactaagtggcttcatctgcagcagctgacccaagaaagttgatttaaatgaacccacacttcagaggaaaccagtacaatccgatgtaaagaaataaaaaataggccgggggcggtggctcatgcctgtaattacagcactttgggaggccgaggcgggtgaatcacttcatgccaggagttcaagaccatcctggccaacatggtgaaaccccgtcattactaaaaacacaaaaattacctgggcgtagtggcatgcacctgtagtcccagctactcaggagactgaggcactagaagcgctcgaaccagggaggcaggggttgtagtgagccgagagtgcgccattgcactgcagcctgggcaacatagtgagattctttatccaaaaaaaaaaaaaaaaaaaaaaaaggctaggcacggcggctcatgcctgtaatctccgcactttgggaggccaaggtgggtggatcacgaggtcaggagtttgagaccagcctggccaacatggtgaaaccccatctctactaaaaataaaaaaaattagttgggcatagtagggggcgcctgtaatcccagctactcaggaggctgaggcaggcgggagaatcaattgaacctggggggcagaggttgcagtgaacagagattgcgccattgcactgcagcctgggcaacatagtgaggttctgtatgagagaaagagagaaagagggagggagggaaggaaggaaggaaggaaggaaggaaggaaggaaggaaacaattgcttgaaagggctttgtttcaccagggcacgcagatcaaaggacattggattgaataatgaaacagaagagcctgtctgaatttactaatgtggttgcacgtcccgtaatgattgcagttggctctaattcagttccgtggtgtataaattctgctggcaatagctgtaattggggtcagggatttagatagtctctgtgtgttccttttcattttctgctcagagcctgctgggagctgattttcttctttaaagcgaggtaaataattcagtggggagcagaggttttgctgtgggtccattgctctcctgtgctgcgtggcagctgtgctggtggcagctaatattcagtgggcagtggcctcgacattgcattattattcgagcaatggtactgttctttgctttgcaaaattgctgtttgttatattgactttctggggtcgtggcccctgaagcattactgaaaatcatggacatgaagcagatttattaactggagaaaagacatacaaatgtatttaatgtgtatacacgggagcattcagaatgaagaccccaagttacaaggggagattgtctatatttatgctttggttcatccaagtctggacagctgtgtagaaatagggttggacaaaaagggcctgatccaatgctaatggcctgagtggggaaacccagccaggcctgtgtgtctagattcttcttggcctctctctctctctttttttttgagacggagtctcactctgttgccaggctggagtgcagtggcacagtcttggctcactgcaatctccacctcccaggttcaagcaattctcctgcctcagcctcctgagtagctgggattacaggcacgcaccaccacgctcagctaagttttgtatttttagtagagacggggtttcaccatgttggccaggatggtctcgatctcttgaccttgtgatctgccctcctcggcctcccaaagtgctgggattacaggcgtgagccaccgcacccggcctcttcttggcctctctgaacagtgctccttccttccgggtatggggctgggagcttctctgggatggggggtcttaggacgcccaaacaaggcaggtcagggaatttccttatggccacttttttttttttttttttttttttcaagacagattcttgctctgtcacccaggctggagtgtactggtgtgaactcggctcactgcaagctccgcctcccgggttcacgccattctcctgcctcagcctcccgagtagctgggactacaggcgcccgccaccacacccggctaatttttttgtatttttactagagacggggtttcaccgtgttagccaggatggtctcgatctcctgacctcgtgatccgcctgcctcggcctcccaaagtgctgggattacaggtgtgagccaccgcgcccagcctgtgccactctttatacagataggatagagggaaagttagattcctgtttttaggttttatggctggcttcggggggaaaggcgttcttgtttctgggacccgtcttggggaagagggattctagttccttcggtgccttaggggagaatgggactcagagacatgggggctggagaagttccgagagaaacttctgcttctgaggctgctgctgaggcctgcacttggcggtattgtttcgtaagcctgaaccacgtgcaggtctgaatcaacataaagaatttgggtgggaggcaggggaactccaataagaagcatctttgaatccggcaggggtggaatttgggtcccagaggggtttggtgactgcaggctacagaagaatgcttcaaagtgctgtatcacatggctttgctccgaagggtcccgagcacagctttaccgggggctcatgtgtaacgctcggcccacccatccaccaacaggagccacttaatcgacatctccaggatgccagcaaccgaggaccgttgtcatagtcccagcacaaaatgaggctgctttcttcttgggggtttagggatcccagaccacaaggatttgattaaaagccgctcagttcactaactataagcaaagcaaatcagaaatagatctcctgttcctgccccgtcttatgttcccagtggaaaataaaccccgtgaaagcaatggcgtcatgtgcaacccgaccttggagacagagaccccagagttagcgttgtctacctgggacatctcccagcccaggggtcttactccagacccgtgaggaccccaggcgtggctttgctgcaacttccctggagaggagagaggacagggggccctgcctgggagatagatttgctgcctggcatgcgggactggagactgtctcagtgcccaggccgtctgatgctggccggagtccgcctggtttatgtaacgaggtctggatgtgaccaacaacggcctcgtgtgtgtgagtcacgcgtgcagcaacttctggctgtagtgcaacccctgaaaccaagcaaagcctaaagcccccaggctccacttcctctgtgaccctccccacccccaattcctgtcatctctcagggtcatccggagcatctcaaagctgaaggagcctccgctgcaacctggcctcctgctgcaggatgagacgagctgtctgcagccctcccgtgccacctgcctgttttatgcaacagcatttcagagaggagggactgggaggggagagacaacaccgaggcctttggttatttagggcaacagcagggagtggccgggtgcacagattggaggagattaagtggttgctgaggggatgcctgggattgctgggatgggcggagacataacacagtgaaagatattggtcaacggcgaacacagattggaatgtaaattctcagggtgtgtgcatagccgggacgcttaactttggcgtcctggacaggtgtctcgactggaactgctggcagccttggaggggagatgttgcacagatccaagaggctgacacggttcctgtcccccagcccagtctgagcagcttggaccatgatgatcaagagcgctggaggaggccaggtgcggtggctcacgcctgtaatcccagcactttgggaggccaaggcaggtgggtcacttgaggtcaggagttcgagaccagcctggccaacatggtgaaaccctgtctctactgaaaatacaaaagttagctgggcgtgatggcatgcacctgtaatcccagttactcagacggctgaggcacaagaatcgtttgaacccaggaggtgggagttgcagtgggctgagattgtgccactgcactccagcctaggcgacagagagagacgccatctaaaaacaaaacaaacaaaaagaaaacaacaataaagaaaaaataagaagagagctggatggagcaaagatttgctgggttgttcttaaaggcgagcctgtagtgatcgctggtaacagagaacgtcatctgagagggacgtgggggctcccagagtttgagagaaacggccgtgtgggatttgacctgtgatggcaccgccagctcccagcctccagtctgggcccaggggcagctgctgtgtgcaccctgggctcagagttccccttccctccaaggtttgtgactttgtcctgacttagggattcctgtctggggatgcgtcttctgctccggagaggccctaattgcctccacaaggagcggcaaagcctgcccgggtggcatctgactggagccatgccacagcctatacgaatctatgttggagcccttgaaccttcccccagagcaagcgtcaccgaggcagaccgatttttgggagggagacagacatcagagcgggggagacccagtacctagggctcacctggttcccccaggcttagcctcctccagggcttagtgtttgagtgagagattgtcccccctggacaattctgtagattctgactctgctcctgccttgccctgaacttcccagaacctcagtttcttcctttgggaaatatgcatgctggtcataccaacatccttgggtgggcagatgagactcttgggtgcctggcattactgcaacagaactcaatgcatagtaagtgctgactcaatgtgctcctggctgcatcctctacttcctgataaattctctggtggtgttttctctacaaggctagtactggcaggggcaagtgaggaacaagatcaaggtgtgcatatatgtcagcaagagggacccttcaccctcacaaattctgcagtgtgtttttaatgatgtgtcccaaagatgtgaatgttctcttctctctgctgcagacacattcattagattaactgcttttggatcaggtaggaacctcagcttgtccacacaggttgcttcctgaccctgtatttgtcagtgtaggctagctgctataacaaacagcccccaaagaattaaaagtttatctcttgtttgtgttgcagccaggtgaggtggcaaaggtgtcctatgctccatatagtctctcaggcatccaggaccctcacattgttgtgcttcaccttcttctagggcagcccctctcaacctagactctgtgcgtgtgtggaggggtggggggggcgttggggggcggggatatgcctgtcctaagctgtgagtgggacagtccaggagagaagtctatgtgcttggagagaggcttccttcaaagtttcctggccatgagcaggaatgaagctctgacacaggttgcaacgtgaacgcaactcaagagcatcatgctcaatgaaagaagccaggcacaaaataccacatattgtagaattctatttataagaaatttgcagaacagacaattcatggagacagaaagtggatagtggttgtcaggggctggggaggcgggaggggaactaactgctgaatggggacaggggtcttcttttgggtgatgagtatgctctgggactaggtggaggtggtggttgcatctcccatgtagctcatggtcaggttagttttagtgctctgggcgaccctaggcttgcaggaggaggggagcagcatgaggtgaggaacaagggggattctggcctttccatcatggggtgacttatgccctgtttgctcccaataggtcaaagagactttgatttggcagatgcccttgatgaccctggtaagtgccgatatttcaaggggagccttcccttttcagcttggatctaacagcatcagctgtatagttactttggggttggattgggccagtgttgggaatttcttggtcttgagatctctgttctttgcaggagattgcagacaccttgagacaaacctttacacactctctaaaagtctcagactcatttcttggtaggtctgtgcttctaaacctgtggtttaggaatatgctagtattttattattttattttactttattttgttgagatgggagtctcgttctgatgcccagactggagtgcagtggtgcaatcatagcttaccacatagcctcgacttcctggctcaagtgatcctcccacctcagcctcccaagtagctggaacaacaggtgtgtgcccccatgccaagctaatttttttcttttttcttttttgtagaaacggattctcactatgttgcccaggctggtcttgaacccctgggctcaagaaatccttctaccttggtttctcaaaacactgggattacagacgtgcctcaacatgcctggcccagtttctgcttttcttacacttcagttcatatccctcattgtcccacaccccgatcccaatccatggcctccaatctccccagtttctgcttttcttacacttcagttcatatccctcattgtcccataccccgatcccaatccatggcctccaatctcccctcccagagcacacttcattccgttctcccctcaacttctctggttaccttcactgacggggctgtgagtttttcttctccagggcactgaggacctggaatcttcccattctgtgttttcatcagtccaagttcagctagaacctttctggctgaccagaatgctgaaaatatgtgtcctgggccctgcagaaagtcctgcttgaggcagatagtctgattgagattcaggtgtattcagaccgcggtgggtgggagaaagggaaagatttggtttctgatgcaggcacaatggaaccaaacatttattttgaaagaaaaataaacttttgtgtacacagaggaagaatccattgggctttagcattgggaacaactggttgaccagtgcagttacataatggtgtttgttggaggaagagagaatgataaccagatctgatcctaaaaagccaacaacaagatgataggaactcatctctctcccagttttctgcacacagtgatgtttttgctaataattatcctaaaaggcagatacaaaattgttgtcagtgcaacaggaaaatgtaatgactcaccccaacatggagatgccatttctcccatgaagttagaaaaggtgaaggttgaatcctaccctgtcaaggcagattgaggggtgggggttagaggcaggtgtgtggttgcaaccactttggaagcattgggggattatctccaaaattcagactgagtgtgttgcaccagcgtttggtctggataaagaatgaggcatatctgcaagagaaccctgtgcaatagtgaaggaggggctggctggtaggctcagatacagaacaagacatgttattgatctgaaagatcactgacatgtgacccaggagttccacttctagacagatacccaagagaattgggagcagggactcaaacagttatttgtgtacccatgtttgcagcagcaatattcacaataagccaaaggtggaaacaacccaactgtccatcaggggatgaatgaatgaacagaatgtggtccctccaggcaacagaatatgatttggctgtaaaaaggaagggggttctgatgcgtgctacatgagccttgaaactgtgctcagtgaaacaagccaggcacaaaaggccacagggtgtaggatcccattaatatgaaatgtccagaataggcaaattcagagagacagaaagtggattagcgattgttgggctggaagaggggacaaaagggagggactgctcgtggctatggggtctccttttggggggatgaaactgttctggaactagatacaggtggtgattgtacaatattgtgaatatatgaaacaccattgaattgcacactttaaaatgtcaaattttatatgtgagtttcacattaattttttaaaaatcacataaataaacttattttccactcacctgctactaccttttcattgctcacctagaaggctgccagtgcctgcaaacacatctttgaatgcatcgttttgctaccaagagccccccatgaatgggcaggcatgtgcctgttcatccacagcccttcctcatgggaaggaagccccagtgcagaggaaccacagtcacctgcatggcgactgtggggaattcacttttcactgtctatactgcctgggctttaagaaactctgtgagtgtatcactattttaaaaaatagttataattttacattttaaaaaggagacagagaaaggaaggatgggagagagggagggagggtgggaggaggaaggaagggaaaaggaagagaagaaagaaaagaaggaaacaatgaaaggacagaggaaaacagggagggagggaggaaaaaggatggaaacaaggagggaagaaaaggaagaagagagggaacgatggagggaaggaaggaagaagaaaggagaggagataagaaaagactgaggggaggaaggaagaaggagaggaatgaaggaggaagggaagaaaggaggggggaaggaaagaaagaaaaataggagaagaaaggaagaaagaaaaagaataagggaaggacggagggaaggaaggagagagggagaggagaaaggttggaggggaggaaggaagaaaggagggtggggaggaaggaaagaagaagggggaaaaggagagagggaaggaaggaaggaaggagagaaggaaggaaggagagaaggaaggaaggagagaaggaaggaaggagagaaggaaggaaggagagaaggaaggaaggagagaaggaaggaaggagagaaggaaggaaggagagaaggaaggaaggagagaaggaaggaaggagcgaaggaaggaaggagagaaggaaggaaggagagaaggaaggaaggagagaaggaaggaaggagagaaggaaggaaggagagaaggaaggaaggagagaaggaaggaaggagcgaaggaaggaaggagcgaaggaaggaaggagagaaggaaggaaggagagaaggaaggaaggagagaaggaaggaaggagagaaggaaggaaggaagaagggagggcaggaagggagagggaggtggcaggaaggagaaaaggtgatgagaaaccttctattaaaatacaggacatgcgaaaccatatgccccgtttggaggttcaagctctccttcttgcagtctctgcatccccagtgaatgtccgcaccacacacaaacccgtgttccagccgcctcctaccaaggcaatgctaggctgttatgtaaaccatgctttcaaatacggtgtttcctctgtttggaagaagtctggccattgcacagccctgaagctccaattttcccagccatggccgactccacctcctttgagccatcttcctcaaacctcctcctgccctcgtctgcccatccacactgcacacccaggttcactaagcagggcagtcacaggctgcaccctgagcactcctgacctgatatccacatccatgcaatacatatttgctgaatgaataaatgaatgaatgaaagaaagtgagataagccatcattctggaagctgcaagtctttctccttcttttcttttgcctccccctgcctcaccctccaccgtccagccctgtggtggctctacgggcaggtggctcacttacttgtcttggatgttctcagctactttggccatcctgtgggcatcctcacagcctcaagggtggattgtttttgaatggattttaagggtgttttcttgtcttttttctcaattcaacatggaatttgtgtctatatcatttactttgtatggctttgtcactcccttttcacctttcatcagggcgttcatggcctttcttcatgcttccaatgaatcttcaatgcatattgcatttattttctctctttgttcacagaacccaccaagaagccaaactcaggtgagtgtctcttcagctgggaaaaactgaggcaacgtccttgaactgatgcttacggaggggatggttgaggatgttttacagaactgtggggtatatgaaagagatgcaacaactgtaccagatagcagatattgaaagcaaaatgtggtgattagggaaatgcaaatcacaaccacagtgaagcaccacttcgtccccactgagatggctaaaatctaaaatggaaaataacaagtgttggcaaggatgtgatgaaactggaatgtttgtacagtgctggtgggagtctaaaatggtacagccactgtgaacaaatgctttggtggatcctccaaaagttaaatacaggattactctatgaaccagcaattccactcctaggtatgtactcaaaataattgaaaacacgggttccaagaaaaatgtgtacacaaatgttcagagcagcactattcattatagctaaaagatagaaataactcacatgttaatcagtggaaggaatggataaacaaaatgtggtccattcacacaatggaatattatttagccttgaagaggaatgaagcactgaaaattgctacaaagtggttgagcctcaaaaacattttgcaaagagaaagaagccagacacaaatgatcacataatgtatatttttatgaagatgaaatttcaagaataggtgaatccctagaaccagaagcaatgtcgtgactgccaggggctggaggggaaagagagagtgactgcttgataaattccaggtttctttttgggggaacgaaagcattctggaagtacacagaggtgatggctgcacaacactgtgaatattctaagtgcccctgaattattcacttttaaatggttaattatatgtaaatttgacttcaatttatttatttattttcaattaaaaaggtaacctttggctgggggcggtggctcacacctgtaatcccagcgctttgaaaggccgaggtgggcagatcatctgaggtcaggggttcgagaccaacctggccaacatggtgaaacctggtctctactaaatataaaaaaattagctgggcatgatggcacatgtctgtaatcccagctactcgggaggctgaggcaagagaatcacttgaacccgggaggtggaggttgcagtgagccgagatcatgccactgcactccaacctgggtgacagagtgagattccgtctcaaaaaaaaaaaaaaaaagaaaagaaaagaaaagaaaaagaaataattcccggggccgggcgcagtggctcacgcctgtaatcccagcactttgggaggccaaggcgggtggatcacaaggtcaggagatcgagaccatcctggctaacacggtatgttgtacctgagcgagttagaaaaacgctttgagacaaattaagagtcctttataagccagcgaccgagagacggctaatgcttaatagtctctcggtcctgaggaaggggcttgattaacttttagatcttggtttaggaaggggagggctgggggtctagtgaaaaccattttacagaagtaaagtaggcaaaaagttaaaaggataaatggttgcaggaaagtaaacagttccaggtgcaggggctttaagactattacaaggtgatagacgcggggctttgggcgttactaatcagacgaattcccgggaactgcggatgtagctcgccacagtatcttatcagttaactgcattcttggatgtgctgggagtcagcctgcacgagttcagtccttgaggaaggggctgccagtgaaagagccaaggtggagtctggctggctctcttagctaagggagagtccattcaggtggaaagaaggctaggtgagtaaaggaaaagggagagtctaaaaacaggttagtaaaaaccaggttgggcattacaggtgaaaccccgtctctactaaaaaatacaaaaaaaatttgccaggcatggtggcgggcgcctgtagtctcagctacttgggaggctgaggcaggagaatggcgtgaacccgggaggcggagcttgcagtgagccgagatctcccactgcactccagcctgggcgacagagcgagactccgtctcaacaacaacaacaacaaaaagaaataactcccagacttccagcagactccttgactgccatgagagatgtcaggaagtcaatggacgggtgtttataggttgttcaggaaatgttcactatcaagcaagaattgaaaatgcagctaaattgctgttggagagtgatgatagcataaagatttccaacaagaagctctgcaaattttgctgaaaaatcttccaaatgatgctctgccataagaagaaattcacaccctgaatagcacagcaggatgcgaatagcaatgccagccaaagacattgcaaacaagccggtaaaactaagtgattgttagctgtttaaaaaaataataataactggtgttaacaacaaagtgaaacttaacttctgaagatgaggctaccttcacagagaggataagaaaggaagaactgagtaaaagtagttagatattgctggattttgacattttaaggttaagtgttcctgctaaaaataaaaattgaacatataactcctgaactagtggatgaaaatgaagaatgaagaataaaattaaatacaaaaaaaatgaagagtaaaattaaataccaaaattagccaagtgttgtggtgaatgcctgtagtcccagctactcaggaggctgaggtgggaggatcacttgagccccagaggtggaggttgcagtgagctgagattgcgccactgcacttccgcctgggtggcagagccaggctttgtctcaaaaataaaaaaaaataataaattaaaaacctgaatactaaatggaagttaagaaggaaggaattaaaaaagaagaaaagtaaaataaaatagtaggaatagtgaatccttagttatgttagatgttcagtgatttaataaatctgtaaaaagacggagatgagatgatgcaatttaaaatgtttcggctgggcgcagtggctcacgcctgtaatcccagcactgtaggaagccgaggcgggtggatcacgaggtcaggagatcgagaccatcctggctaacacggtgaaaccccatctctactaaaaatacaaataaaatgtttcatgctatttacgagagaagcatttgcaacaaaatgccaaagagaaggtgaaaatagctggaaaaaaaatgcgcaaagcaaataaccaatagaaagaaagccaagttgggctagcaaaatcagacaaaataaccttcgaggtgcaaacaactttgaggcccaaatagaggttcttcccactaaaagaatgattccctgaatgataatggaatcttgacccagcctgcacctcaggttaagttaaaagtggaaatttaaagatctaagtgtgagattttaaaaagcatttccccagaaataccaggatctgtagatggaaatgttattaagaataaagatgtggagctgggcgtggtggctcacgcctgtaatcccagaactttgggaggctgagactggctgatttcttgagcccaggagtttgagactagcctggacaacatagtgagaccccatctttacaaaaaaattaaaaaaaattagtggacatggtggcatgcacctctagtcccagttactcaggaggctgaggtgggaggatcacctgtgcccaggctgaggctgcagtgagccatgatcacgccactgcactccagcctgcgtgacagagcaagaccctgtctcaaaagaaaagaaaaaaaaagaagaaagaaatgaaaaccgtagctcagagacagagaaactgagcaatgcataggttcagaagggtttgaaacagactgaattgtgtcttggcatatgagagaggtcgcagctataaaacaatgagagaagaaaccaaattccacataggcaggactgagacaattggctgttcttgtggatgatacgtgatcaaatctcaacctcatgcgatacttttttttttttttttgagatggagtctcgctctgtcacccaggctgcagtgcagtggtgtgatctcacctccccgcaaacttctcctcccgggttcaagtaattctcgtgcctcagctgggactacaggcatgtgccaccacgcctggctaatttttgcatttttttagtagagacggggtttcaccaagttggccaggctggtctcgaactcctgacctcaggtgatctgtccacctcggtgtcccaaagtgctgggattacaggtgtgaaccaccacacccagcctcatgtaatacttaaaaatgaactacaggtggattacaaacctgaatataaaagaaaacttttttttttgaaaaatagagggaaatgtcttataacctcagagttaggaggtttttcttagatacaatacaaaaagcataaccacgcccatagtcccagctactcaggaggctgaggcataagaatcacttgagctcgagaggtggaggttgcagtgagccgagatcctgccattgcactccagctgaggctacagagtgagagtataaaaaaaaaaaaaaaaaagcataacctttaaaaatgggttagcctatgtctacatttaaataataataataataataatgttccaacttcaggctctgaaaaaagtcaaaagatgagctgtcaactagaagaggctccttactgctcataccaccagggaaagtttaatatgcaaaatgcagtcatccttcagaattcatgggggattagttttaagacgccttcttccccgcagacaccaaaatccacagctgctgaagtctctgatataaaacgtgcagtacttgcatataatgcaagtatatgttcctgtatatttttatttatttatttggagacagaatctcactctgttgcccaggctggagtgcagtggcgtgatcttggctcactgtaacctccacctcccgggttcaagagattctcctgactcaacctcccaagtagctgggattacaggtatgcgccaccacccccagctaatttttgtatttttggtagagacgggttttaaccatgttgtccaggctggtttcgaactcctgacctcacataatctgcccaccttggcctcccaaagtgctgggattacagggatgagccaccgtgtccagcctctggtatactttaaattatctctaggttactcataactcctgatacgctgtaaatgctatgcaaatagttgttatactatattattttttatttgtattactttttattggattgctatattttattttttgaaatattttcaatacaagactggttggatctatagatgcagaaattctggttatagagcacaaactgtgtatagatagctcctaccaaaacagacggatggtgaaaaaaagaaaagaaaagaaaagaaaaagaaaatggaggagagagactatgaggcgactaaaagaagagggatatgatcattccattcgctgacaagaaaaattcaaagaagagggaattatgcaattgaccagctgatgtgtgttagaaatgctcagggtcacacatattcattgaaagccaatttaagccactatttaaatttaaaccgatttaaacaattgggcttttttttttttttctaaaaaaaaaaaaaagtcaattaggccaggcgaggtggctcacacctgtcatcccggcactttgggaggccgaggtgggtggatcacaaggtcaggagtttgagaccagcctggccaacatggtgaaaccctgtttctactaaaaatacaaaagttagctgggcatggtggtgtgtgcctgaggctgtgagactgaggcaggagaatcacttgaacccaggaggcggaggttgcagggagcggagatcatgccactgcactccagcttgggcgacagaccaagactctgtctcaaaaaaaaaaaagaagaagtatattggttccgtctggaaaggtggagcacttgaagcaaaggcaggaagactggaagcagggagagggttttcaggtcacaaacaggtgagagacaaaacagttgccttcttttgagtttctgattagcctttccaaaggaggcgatcagatacgaatctgcctcagggagcagaggggggactttgaatagaatgggaggcaggttggccctaagcagttcccagctggacttttccctttagcttagtgacttgggggtcccgagatttatgttcccttcacagtgtatgagtgagagcacttggaaactgagagtggaagtgtcgcaggccaggtctcactaacacaggcccccacaacacctgtttcagtattgactgagtggttaaatattaaaagccagtgctgttatacaaaggctggaatgtaacaaaagcccaccgagagtttttcccaggactttcccgggccttaaagcatgacaaaataatgaatgaattcttaacaggacccatttaggattaaacaagttttactgggggtctgcagaaactccccaggcctccacaaacaagtttattggggctttgaaggaactctgcaaacctcctggatttagcaggagacaacatgagggtaatcaccccggcacctggacccattagattaagtcaatttactgaggctcctgaggaagatcctcaggactcagaccttagttatagattaaaagaagttaatcacttatgtctttagataaatgcacacacatatctccacatagcttggaaggtatataagctctggaaaactataattttgagttagtctggtgataatttccaggccttctccctgtaacaggttgcagaaataaaaactctcttcctccccagttcatcggtgtttcattattgggctgtgagaaatagcaacccagttgggtccgggaacagaaggtttggtgttatcttcatcacaggcactggactgtcggtaaatttattccatgacaattcttcctaggtttcttttttatattacttgcttccatcatggcagacagctacactggcttcttgccatgaaaacgaacttctagtaacaaaacggaaacctttttttttaagtttcaggtttcaaggttttacttctatctgcaaagtgatttttaaccagacaatggcaatctataaacacaccgtgggcagcaaatcagaacaaactgcaaggtcgatagtcacgctgatgagcttgtttctgcagcctgctcctaagggaaggacaattttcttttctaacagtgcaatgttgtttcctccacagatatctacccaaagccaaaaccaccttactacccacagcccgagaatcccgacagcggtggaagtaagaatccgcaggcctgaaactctttctcaatctggtttgatgatgtttgcctttttatttactagcaggtttagcctggttgcatttgaaatatgtgtgtaatagctcccttactgggaatgtagtttctttcctcactggggggagcaagaaagtccaacggacagaaacaatcttattttccctttgctttgacatctagaaaccactaaggtgtacttgtaaccacccaactggttcactttgttggctgcctagacagagctgatttatcaagataggggaactgcaatggagaaagagtaattcacgcagagccggctctaagggaggctagagttttattattaatcattcagtctctggaacatctggggatcagggttgttaaggataagttggcaggtaggggcttgggaagtggggagtgctgaccggtcaggttggaaagggaaccatagggggttgaagtgaggttttcttgctgttttctgttcctgggtggatggcggacctggttgagccagattaccgggctgagtggtgtcagctgatccatccagtgcagaggctgcaaaatatctcaagcaccgatcttaggttttacaatagtgatgttacccccaggagaaacttggggaggttcagactcttgcagccagaggctgcacgagccctaaagtgtaatttctaatcttgtagctaattttttggtcctgcaaaggcagactggttcccaggcaagaagggggtctttttgggaaaggggcattcttaattttgtttcagagtgaaaccacgaactgaattcgttcccaaggctagtttggctcacacccaggaaagaacaaggacagcttaaaggttagaagcaagatggagttggttaggtctgacctctttcactgtcatcatttcctcagtcataatttttgcaaaggccgtttgatactcaaaggacactttgcattatcatcacagaaagctaatcaggctgagagacaagtcctttctctcacttgttttcagtgctccaaatacctttggcttaaccattcccaaacccccacgtgtgctgtgcactttatgtgttttagagttggtttctccattttttctaacatttggcagacagtttttttccacagatttattacactcatcattgaaaaatatgcaattcaaaaaagaaagagagtgaacgagagagagaagagtggggaggggggtgggcatggagagagaaagagaaagagaaaagaaaggggaaagaagaaaggaaaagatagattctggccattaaagttatcagcagttcaacaaccttaaaaacttaaatgtttgccaggcagagcagcgtgaagctggctaaatcaagaggggttctggaagcttcctggtagtttgctctggctttaaactttcacagcttaacagcgtgtccattcattgcagacacgcacatccagatggacagaaattatctcctcttacaaggaatcattaaaaacagagaccaagacccaagggaggtgacacccacttgaaaaactacacctcaggccgggcgtgggggctcacgcctggaatcccagcactttgggaggccgaggcgggcagatcacctgaagtcaggagctcgagaccagcctggccaacatggcgaaaccctgtctctaccaaaaatacaaaaattagctgggcatggtggcatgcgcctataatcccagctacttgggaggctaagacacgagaattacttgaatccaggagaggaaggttacagtgagccaagattgtgccactgcactccagccggggaacagaatgagattctgtctcgaaaaaccaaaccaaaccaaaccaaaccaaacaaaacaaaaccccaaaacaccacctcacccttaactgcattagttaagccagctagtctttcttttttccccctctttcatgatgaaaatcccaaataccacccacctttttctcctgctatttcctcctagtcttttaaaaaccattgtcctgcggatcatggctatgttgcaaggcactcatgggaattccacagggaacgtgtttcttgctgaaacatacttgggaaacgcccagttaaacagactgccgtgggcttccctcccagagaattcatcaggacttaaaatgtgtggctgggcatggtgggtcacgtctgtaatcccagtactttggtagaccgaggctggtggatcacctgaggtcaggagttcaaggccagcctggccaacatggtgaaaccccatctctactaaaaatacaaaaattagtcgtggcctgtagtcccagcaactcgagaggctgaggcataagaatcgcttgaacctgggaggcagaggttgtagcaagctgagatggcgccactgcactccaggctgggcaacagagcgagactccgtctcaaaaaaaaaaaaaaaaagaataagaaaaaaaaaacttaaaatgcgagatcctttaagatgggccatcttcagagtgtgaacactcagcccctcccacagcaaagtgattcatgaaccccaataggaggaggagtgggggaagagaggctcaggctggggaggtgaccccccatgactcaagcctcaatctcctgatgcttgtcccaacaaagaggaggcttcctttccgactttggtttttcatgttgtgcttaaatccagccacactgatgcctttaacatggcagtcctgaattattaatcaatactgtgtgaatccaaaatatctgagacaggtctcaatcagtttacaaagtttattttgccaaggttaaggacgtgcccgtgacacagcctcaggaggtcctgatgacaagtgctcaaagttgtcaggacacagcttggttttacacattttagggagacaggagatatcaatcaatatgtataagaagtacattggtttgatctggaaatgcgggacaactggaagcaggggcttccaggtcacaggaagatacgagacaactagttgcattcttctaagtccttgatcggccttttactgaaaactcaatttacatgtgagacagggcaaaggaatagtacttatgcctcagtctggcccagtgaatctgcatttttcatcaacaatagggcagaggaagcaatcagacatgcatttgtctcaggggagcagaggggatgactttctgtcccacacctgtgaagatgagctgttggtgtacattgccagggtgaaattccacagaactgttttagggtaaacaaaacagtttactttcctcagattgtgaggacagtatgtagcttttaaaaaacttaaaaaaatttttttgtagctatcttatttagaaagaaaatgggaggcagatctgactaactttttttttccagcttgacttttcccttggcttaatgattttggggtcccaagatttattttcctttcacaattgaacatcagaacatggagtatttaacacaggaaatgagcaaatttaacgtacacacccaaggaaaaggaaaaatgaagctggttggaagttaattatggatagtgtggtatatgagcagaaattccccttaaccagtgttcttgcccaggctagcccaaatgagcccaggctagcctagattcccaagtgtgtatcttgagaacgaggaagagccctagaaaacaatgtgtaacgtccctccaagatggggtgttctggaacaatccctcagacaacgaaggcaattgttgatgggcaacattgggaagaccccagagatggaatgtcctaggcctttccatgttctctttctcattctccctccattgacttgataggtggctgggggatttataagtatttaccacacaccagccagctttctccggatggctccaggcatgcttggagcccagtggtctctttcccttagaatttgatctggaggaacccaaaattctctctgtgtcctttgaaattcagcacatttttcttggcttccatgagctcctgtggcatttctcaggccaactgttgactctgcttcctatgtctgtgcttgtccctttgagagatgtcagcgttgctcaccgattcttttctctgaccccagcagctcctatccatgttgtctttttttttttttttttcagacagagtctcactgtattgctcaggctggagtgcaatggcacgatggcatgatcttggctcactgcaacctccgcctcctgggttcaagcaattctcctgccttagcctcccgagtaactgggattacaggcgtgcaacaccacacctggctaatttttgtacttttagcagagacagggtttcaccatgttggccaggctggtctcaaactcctgacctcaggtgatctgcccaccttggcctcccaaaatgctgggattacaggtgtgagccactgtgcctgtcctcatgttgtcttgaaagtaacaagacaggcacggattctttttgatgcaagctgttatgggatgaattatgtctccccgcaaattcataggatgaagtcctaacccccagtttcctcagaatgtgactgtctttggagatggggcctttaagaaggagattaatgtaaaatgaggtcactagggtgggtccggatccaataggactagtatcctaataagaagagatgaggacttagacacacacagaggaaagattatatgaagacacagggagaagacggcatctacaagcccaggagagaggccttaggaggaaccagcccagaccatatcttgatctcacactcccagcctccaggactgtgggagaatcaatgtctgttgtttataagccacccagtctatggtgttctgtgacagcaacctgaaatggactaagacacctcataagaaggggagatgaggacgcagacacacacagagggacaatcctgtgaggacacagggagaagatggcatctgcaagcccaggagagaggcctcaggaggaatcagcccagcccacacctggatctcagacttccagcctccaggactgtgggagaatcaatgtctgttgtttataagccacccagtctttggtattctgtgatagcagcctgaaatggactaagacatctcataagaagaggagatgaggacacagacacacacagagggacgaccctgtgaggacacagggagaagatggtgtctacaagccaaggagagaggcctcaggagtaagcccaggaatcaatgcagttggaggttctgtgtgtgaatggaggagggaagctcacagatgaaggcgttttgagggaggactgaccttacagtgaggtacccagagacttcctgaaccaagccacgaatatgcagctcgtgctccgggcagtgccttctggcctggaaaccaaagctcccttgtgtccagtccccactcctctgtttggcccccaagtttccataatcccccacagttgtatcattttagagacctcaaaagagagtctaggctgggcgtggtggctcatgcctgtaatcccagccctttcagaggccgacgtgggtggatcacctgaagtcaggatttcaagaccagcctggccaacatggtgaaaccctgtctctactaaaaatacaaaaattagctgggcatggtggtgtatacctgtaatcccagctacttgggaggctggggccagagaatcgcttgaacccaggaggcggaggttgcagggagccgagattgtgccactgcactccagcctgggcaacaacagcaaaactccttctcaaaaaaaaaaaaaaaaaaagagagtctaggcagggcatggtggtccatgcctgtagtcctagctatactcaggaggctgaggtaggaggatcacttgagcccaggaggtggaggctgcagtgagctatgattcaccactgcactccagcctgggcaacagagcaacaccctgtctcaagagagagagaaagggaaagagagagagactattttgagaagtgaaaaaccagtcattctcagcccagatttccagtgttctgagacgtctgtcctgaggaaggactttgagaacagcatccttgccttttttgtgaattaaagtaatttcactcttgagccaatgtggataagcacttgacaggtactggcagtgccaggtaccaggaatatagaatgggtacagaaaataaagtttctagtccagcgacaaaaaggtgctgaagatacagactcatgtcgtgcaaagagcttgcactgattatttcatttcggcttcttgaatagggtcaaaggacatttaagctgagacaggagggacgagctaattaatgcttttccagatgacaaatggattcttcaaatatttagggagagtgtaaagtgatggacagggaacaggaggggtcatgacagaaggaatgccacctgcaaaagtcctggggcagggctgggcacggtggctcatgcgtgtaatcccaacactttgggaggccaaggtgggcagatcacctgaggtcagaagttcgagaccagcctgggcaacatagtgaaatcccatctctactaaaaatacaaaaattggccaggcgtggtggcacacacctgtaatctcagctactcgggaggctgaggcaggagaattgtttgaacccaggaggcagaggttgccgtgagctgagatcacaccactgcactccagcctgggcgacaaaagcgaaactccgtcttaaaaaaaaaagtcctagggcagaaagctcatggtaaacttgaggaacatgcaaaagtcattgcaaaaagttttaagaaattcaaatgaagccaggctcagtgtggctaatgcctatgatgattccagctctttgggaaggcaagacaggacgattgcttaagaacaggaatttgagaccaacctgggcaacatagcaagaccttgtctctacacaaattttaaaaattagccaactatggtggtatgcacctgtagactgagctacatgggtggctgaggtgggaggattgtttgagcctaggaactcgaggctgcggggagctatgattgcaccactgcactgcagcctgggcaacagagcaagactctgtctcaaaacaacaacaacacaaattcaaatgaaacggtgtaactcaagcaagatggaaatacaacacactatcaaaaggtcagatgtttcatcctaacatttatagaagtgactgacttctgtaaatggtgctggcatctgtagtagccctaaacagggaaaggtcaacaacgcactttctgccctgttaatttcagagagccctggacttcttgcgaaagcaccagtggtgtaagtttttgttttttcattgtaagctctgaggtggtattatgaatattgtctacatgattaataagctccgtaaaagcaatgggcagtaacatcttttctgtactttggcattcttatttatagatggtatctacctgaaagatgtcattatttttctgaaatcatactgttgttttccaacagatatctacccaaggccaaagccacgccctcaaccccagcctggcaattccggcaacagtggaggtaatgagtatttatttatttatttttattttattttattttattttattttactattttatttgattctatgttattttactttattttaccattttatttgattctatgttattttactttattttatttgattctatgttattttactattttattttattatttattttggagacagggtctcgctctgttgccctggccagagtgaagtgatgtaattgcagccttgaactcctgggctcaagcaatcttcctccctcagcctttcaagtagttaggactacagatgtgtaccacctacattgcaccacctatatttcaccacctatattggctatatttcaaattttttgcagagacaggatcttgctgtgttgttcaggctattcttgaactcccggcctcaagcaatcctctgcctcagcctcccaaaatgctgggattacaggcaccagctattgtggcccagcctgataatcagtattaaagtccattttagaagtgtttggggccaggcacagtggctcatgcctgtaatcccagcactttgggaagccgaggtgggcggatcacttgaggtcaggagtttgacaccagcctgagcaatatgatgaaaccctgtctctactaaaaatacaaaaattcgccgggcgtggtggtacatgcctgtaatccagctactcaggaggatgaagcaggagaatcgcttgaacccgcaaagcggaggctgctgtgagttgagatcacgccacagcactccagcctgggagacagagcgagcccctgtctcaaaaggaaaaaaaaaaaaaaaaagaagtgcttcacgcctgtaatcccagcactttgggaggccgaggtctcctcaggcagatcacctgaggtcaggagtttgaaaccagcggccaacatggtgaacccctgtttctactaaaaatacaaaattagctgggcagagtgacgcgtgcctgtaatcccagctactggggaggctgaggcaggagaatcgcttgaacccaggaggcggaggttgccttgagccaagattgtgccaatgcacaatctatctaggtgatagagtgagactctgtctcaaaaaaaggcgggggggtggttggatacaagtattatttaatgacttaaaaattctcatctccatggtgaaagaccaattgcttttgaaatgcacagacattgttttgcgaggagttcagttctactatccaccagcacctggggattacatttagttgatagtaaataaatttaaatgtttttgatgacattgactgaaaaataccatgcacactaagacatttcaagttatgatggaggaaggcaattttttcttgtttttttttttgttggtctgtgttctactcacttattcttccctctgcaagagttatctgcggccactttgcctgtgttcctacagcacttcccatctccgccttggcaattgtgtctcacgaacgtgagacactcaggaaagagatgctggtctgtaaagttggaagagtctcagcgattccattggtggggcaaatgtgtgcagattgaggaagctaagatacactgggtgtcttcctctctccacctgctttaaccattgggagttcccctgattgtgattgtttcaggacgttgcttggatgttgtcatattcctagggttcaaggcactccgtgaaatccaaggaaacaagctttgggtatgtcccagtgccttttcccttgggtcttgcaactgaagaattgtgtttcttccctagaaaaacgaacacacttttgcccactcacccacctcctgcaagtctccaaaaccacagcgttgtatcctagactatgttcccccaggaggtggttcctccctctgcattcccgtactccatactgcttgatatgttcttacatgcaacaccgtgcaattgtgtttagttgattcctgtgaattagaatgagaactctacatgggcatggatttttgcctttcattcactgctgcattccctagtctggaaagctgtgcctggcacacaatgagtcctaggtgaaggtcagtgaagtcattaatgcttgagtcccaacaggcaaacagctggattcatgaatgaaagacttaccgctacatcccttcatcagggtgtatagcttcaactccatttcctggaaagctctacaatagttcttcctcctcaaaaggctctggtcttgtgattcatagcattcgtccaccaagacatgaacaagggatctttatgtcagaggttccctgttcaaagctgttttagaggccaggcgtggtggctcattcaggtaatcccagcactttgggaggccgaagtgggaagaccacttgaggtcaggagttcgagaccagcctggccaacatggtgaaaccccatctccattaaaatacaaaaattagccaggcatggtggcatgtacctgtaatcacaactacttgagaggctgaggcaggagaatcacttgaacctgggaggcggagttcagttggagttgcagtgagccgagatcatgccattgcactccagcctgggtgacagaacgagactccatctcaaaaacagtaaaaataaaaaagctgttttaggaaacatcccttttttattattttttctttgagtcagggacttgcttggttgcctaggctgaaatgcagtggcgggatcacagctcactgcagcctccacctcctgggctcaagcaatcctccgactttagcctcctgaatagctgggactacagacacacagcactccacctggctaattttttcttttttctttttctttttctttctttttctttttctttgtgtgtgtgtgtgtgtgtgtgtgtatgtgtgtgtgttgggacagggtttccctctgttgcccaggctggtcacaaactcctggccttaagtgaccctcctgccttgacctctcaaagtgctgggattacagatgtgagccactgagcccagccctaggaaacagcctcttaagccaagtgcaatgactcttgaactccccagagcctctgtgcatgctacctcgacttcagcttcacagatgtatgcaactgcgggatcaggttaggggcactcacttaccggcagtcccaaagctctggagagtctgtgctgagggaatggtccatgttaaagcaaagcagaacaaccactctgccttttgtattttatacttgttttttttttgaaacagggtctctctgtgtcactcaggctggaatgcagtggtgtgatcatagctaactgcagcctccagttcctgggctcaagtgatcctcctggcagatgggactacaggcgcacaccaccaagcccagataattttttgtatttttttgtagagacagggggtctcactatgttgcccagactggtctccaactcctggcctcaagcaatcctcccgcctccacctcccaaagtgctgggttgcacccggcttgcatttcacacgtttaataaactcaatcagcatgtttcctaccccctagagtgacaatggtgcacattagcatggatttcttatagatcgagaccaaagacctaattacttatctatagaccaatcttggagaggaaaggcagactccaagggttaattcggggtccaggaaccacagaaggaaggtctccttggatctcgtttgagcctgaagtagctcagtctatgacagacaccatcagagggcagaggcacaggtgaacgcagcagtcggaactttgtcagagcagcaaaggacatcttaggaaatgaggcttgcaaagcagccttgggttattgagaaagctctctcagcgtggattctcagggctctgggatcttctctgccttgcaggtgcctctttgttttttgggaggaagcaggtgggtctcatgtgtcagggcagtaaggagcaggaatgaatggatgaaacaaatctgttggggtgggtagcggctgtgctctggggagccaagagagagacagggggatggtgctggtttcagacaagatagttgagcaggaacttgaaagagaaaaggagagtggatcgtggggacctgagaagctggaattctccctggggaatcggccactgccaacgtgagggctggggttaggagcatgcctatggtgatggagaagcctgggggaggtgcctggttgatggggcaagaggagccatctggagagaaggaaaagcctggagtctccttccgggcttgcttaaggactagggaggggcaggacatgagatgatgttggaggattctgagcaggggatgggcctaggtgggaggtggggcagaaggagagctggacgaggacatggtgagaggtgatgttggctcatccaggaaggacggccaggaggaagcagagggaaaggggcatgcaaaggtccagaggcaggagcaacggggaacatccagggaaggagggaagggcaggggatttggagatggggcaccctgagagagggatccaggcagcaggcagacacgacagcctgagcttcaccccagctcacggttggccctgggagggctttgagcagaagaggggcaaacatcagcaatatgaggccacactgcagacgttctgggccctgcacacgcctccttgcaggcaaggcggccagcccacaaggtaatttaattcctggtgcctgtgggcgtcctgcaaagagccagttggcgtcggaacgctcttctccaaaacctgtgccagtgcccccagcgcagacctggtgtgaaggggacctttggagaggtctcatgagcaatgccgcgtgctctgccccacaggttacttcaatgatgtggaccgtgatgacggacgctacccgcccaggcccaggccacggccgcctgcaggtaggtgccgagcctccccagatgcgacacattgaatttgcacagagagggtgggatgagaggcctgaagttggggatgagagagctgaggttggggcagagttggtgacgagcagacgataagctggtgcaggggatgacagagaaggccccatggccgcatcagtggggtttgcggtctgggcatctgtccgcctctccaggctgggggactggatggaaacaaaatgaacaggcagaactggagggtccactgaaacacttgcggtcatttctgtttagacttgtatatgtgtaagtgtgggtgtacatgtccagacacacctttatatatctgcatgcttatcaatcttcatttgtgtgtatatagatgtttatgtatctttatatttgtgtgtatatatgcttttaaatatatataaatgcatctacatatgtaggtatatggtttttttcatgtgtgtatatacatgcttttgtatatatacagtacgtggatacctttctctgtttttatatatgtatatcctgactttatatatatccttatatatatctttacataggtacatgttttatatgtgtatatatatctttatatttatatgcagatatatgctttttatatatatttatgtatatgtatatcgtttaatatatctttttaaaaatatatcttcatgtatatctttaaatacatatacattttatatacattttaatattttatgtgtatgttatataaatatatatctttacatatataattaaatatatgcctttatttatatacatctttatatatgtacatatatacctttacatgtatgtgcctttatttatatatgtatatatttatatatacacttttatatatacatatgtgtatatctttatatgtgtgtataaatgcctttatatacgtacacatatacctttatgtgtatatacttttatatgtgttatgtatgtacacacaactttatatatacatgtgtatatatctttatataggtatataaatgtctttaaatatgtatatacatatcttttgtatttatttatttttttttgagacggagtctcgctctgtcgcccaggctggagagcagtggcacaattttggctcactgcaacctctgcctcccgggttcaagtgatgttctgcctcagcctcctgagtagctgggattacaggcgcctgccagcacgcctggctaacttttgtatttttagtagagacggggtttcaccattttggccaggctggtcctgaactcctgacctcgtgatccacctgcctcagcctctcaaagcgttgggattacaggcgtgagccactgtacctggtctatatgtatatcttctaatgtatctttatatatatctttaatatatctttatatacatgtacattttatatacatttttatattttatgtatgttatataaatatatacatttatacatatataattatatacctttatttatatatctttatatgtacatatatacctatatatgcttttatatatgtatgtgtacatttatatatacacttttatatatgcatatgtatatgtctttatgtgtataaatatcttcataaatatatttatatatctatacataacctttatatatgtataaatatcttatataaatatatattttatgtgtatatatgcattatttgtataaacacatatttgtaaatgtctttccatatatatgcatatatagcttacatatgtttctatactgttatatataggtgtatacctttacatatgtatgcatactgttttatatatgtgtatataggtcccttcatgtatatatgtatatacatttaggtatatgtgtgtgtgtgtgtgtgtgtatatatatatacacctttatatatgtacatttatctttatacacacagacatatataaacacttctaatataaagttttctctgtaattggaggtgaatgtctatcaataatctttcatatagaaatacaagtacagactataggagacagagatgcatacaacattgggctgaagagtgtgatgtttgaggctttattttcaagcatgtgaggtttctggcctgtttagttctgcaattttattttagaagacataaaggacttgtcccagatattttgcaaagctggacctgcatctttcggacaaccagattgcatccagtcatcttttctgccgtgtttacttgcaataaataaagagcgctgtcttaggatttattacaataacaatcaggaataaactaaaaattactagttatttttgaaaggagaagctgagaacatttacgattgagaccatctgctggaaggtcctcctaatccggcgtcggcgtggctgatctcatatcagtttctcggcaggaagcgggtgcgcctgcgtgaatttggagtccccagggtaaatgttagtcccgtgacggcaaagtgtttttgatagctagagctcagtgttggcatgagttttcccacggggaagaggaagctttggtggggccacccttgactctcccctgctggtcactctttggagctctcttggcagtgacacgttcacacgacttgttgccattcccaatgagctggacagaccaacacctgcaggaaaccccacgctcagacacctgaacatccctcaactctaccttctctgtctaacaggaggtggcggcggtggctactccagttatggcaactccgacaacacgcacggtacccctacatctgggcatgcgatggtgggtggagggtgggaggggtcatctttctagggctcccgcttgcactctgccctgggccttctacctggagtctttggtgagtagggtgctgtgtgctggtgcctggtcttctgagaacctgtctgtgctgggctgttctgcttctgttccccaggagggtgggtgcagccacacatacacacacgcatacacacatgcacacacacacacacacacacacccctttaggtaaaagtaaacagagcaaagaactatacaactaattagagaaagagagcatccaacaaactggagagcatccaacaaattctttaggggcgcagctcgcttacttcaagcagaatagaaaacactttcaatggctgggcgcggtggctcatgcctgtaatcccagcactttgggaggctgaggtgggaggattgcttgagcccaggagtttgagaccagcctggacaacatggaaaaaccctgtctctacaaaaaatacatatatgcaaaaattagccaggcgtggtggcatgtgcctgtagttccagctactcaggaggcagaggtaggaggatcacttgagcccaggaggtcgaggcttcagtgagcagacagagataagatcgtgccactgcactccagcttgggtgacagactgagatcctgtctcaaagaaaaagaaaagaaaagaaaagaaaaaaagcaagagaactcttttggtcggtgcttatgcccagagtgaaagccgtgttctacagaagccataaacaggctcttggcttggttgagtttttctcatggagaccaggggaccttgaaaccctcagatcctctccggtttggaaaacgactgaagcaaaatgtcatcactgagaaagaaaacaataacaaaacactctgtaggttgattttaaaccatcatctccgttttaacattttccctttgttaagagttttgtacaccttcaatgaattgagtaaccatcttttcttttttttttttttttttttgagacagagtttcacttgttgcccaggctggagtgcagtggtgtgatctctgctcactgcaaccttggcctcccgggttcaagtgattctcctgcctcagcctcccaagtagctgggattacaagcatgtgccactacacagggctaatttttgtttttttagtagagacagggtttcaccatgttggtcagattggtcttgaactcttgacctcaggtgatccatctgcctcagcctcccaaagtgctgggattacaggcatgagccactacacctggctaatttttgtatttttagtacagatggggtttcaccttgttggtcaggctggtcttgaactcctgacctcaggtgatccgccctcttcagcctcccatagtgctgggattacagacgtgagccaccatgcccggccttgagtaaccatctttttggttaaaactaatatgtgccaagagctctggtaatgtgggaagtacttttttttctttttctttctttttttttttttaagatatggtctcattaggctttgtgagagccaaggctgttggccccctaagttttctctgaatcactgacatgaggcagcttaattaacaggagaaaaagcgtataaatttattgagtggatatacacgcaaaccttcagaaccaagactcaaccaccaatgggatgcaaaagcttatagaccatcttttttaactttgatgttaggttcaggggtccttgtgtagggttgttacataggtaaattgtttgtcaccggggtttggtgtacacattatgtcatcacccaggcaataagcatagtacctgataggtagtttttccatcctcactctactcccaccctctgccctcaagtaggccctggtgtctggtgttcccttctttgtgtccatgttgtcaatcgagaaaaatgacgagacgagcgtaaaagatttatttgccaaagttaaggttaagggcgcgccccaggagacaggtctgtggccttctccgaagatgattttgaaggctgcaaatttaaaggggaaagggtgggggtagggaaaaagagttattcatgcttttgtctggctcagtgaatctgtgtttttttacataagatggcatagacaaatggggcagagggaaaatgcagggaatctgcatgttgcataagataatctggacaaaatggggcaggggagcaatcacatatgatttgtgtctgctgggcgggggtgactgcaaagctgtcgatttgcatattgtcatggtgaaatcttcacagctcactaggattttccttgtgggcaaaatatgggggagacgtgtagcttttcatcttgtagccattttatttaggaaccaaaagggggaggcaggtttgtgtgacccagttcccagcttgacttttccctttgactaaatgagttcaggatcacaaaatttaatttcctttcacaatgcgtactccgtgtttagctcccacttgtaaatgagaacacatggtatttggttttctgttcctgcattagtttgctcaggagaatggccaccagctcgatccatgttgctgcaaaggacatgatcttgttcttttttatggctgtgtatatgggccacattgtatatgggccacatttcccttatccagtctaccattgatgggaacctaggctgattccatgtctttactatttgagtttgctatttgttgttctttgcaggaagaatgtgggctcagagcatggccccaaataggtgacgttggtaaagcaggtttaacgggtggcaagccaggtgatgagagggagacaggaagaggcctgcttagcaagggggtccttgttatgcagatgaaggttcccaggtagcagcgctcagagacgaccatggtaaatgtttcttttcagacctgtaaaggtgtcagagtctccgtttctctctcctacatccaggaaaagcttagaaagggaaggcctggctgcaacagcaaagatcctctacagatgccaatttccccacctcagtctgctggccctggagcggcaatttcaaaataaggcaaagcaatatattttggagtaaaatattttgatgtccgtcatcttcgttacctcggaagcgagtgttgtcatcagatccatttaacaaaatgaaagcaatgcatgacgctcgactgtccacttcaaaggagcaatagctgtggccctataggtagcccatcctcagaactcactccctatgacacagacaagcttcaggatgggagggggctcatgacaaagtgctcattacctggggtcaagaactgtctacttttggccgggcatggtggcccacgcctgtaatcccagcactttaggaggccaaggtgggtggatcccttgagttcaggagttcaagaccagcctgggcaaaatagtgaaaccctgtctctacaagaaaatacaaaaattagctgggcatggaagtgtgcgcctgtggtcccagctactcgggaggtgtaagtgaccctggaagtttgaggctgcagtgaaccgtgatagcaccactaccttccagcctgggccatggagtgagaccctgtctcaaaaaaaaaaaaaaaaaaaaaaaggacactaaaaaagaattgaccaccttcaactcaacgtactatgagatgagttccttccaccatctttctggaactagctaaggggttccccttacctactacctaggtagacctgatttattaagacgggaatcgcaatagagaaagagtttaattcacacagagctgactgaacgggagcatgtgaagcagctatgctgtctggggtacatacctggggttcattgttgcacgctgagaaagaattcaggacacagacacatgtggttgggttaaggagttgaaagtttaatagaagaaaggagagaggagagcagctccttgcaagagagagagggagagagagaaagagagagagagaaagagaagcatctgaaaaagttgggaggttgtggaccgcagcagcttttgtaggcaggctggaggaggtggtgtctgatttacatagggcttacagactggttcgatcaggtatgacttctacatagtgcgtggggaaggctggtggccccaccctaattttgttatgtaaatgggctttccagttggtcagtgccatcttgtctgctacttactgtacatggggctgacaaagaggagggaagatgaagctgccatcttgaacgtgtctaggccctagttcctgccggcattcacccatgtaagctcctagctggcttgtctatgtctgcagctcaactttattttttattttttatttttttttgagacggagtctcgctctgtcgcccaggctggagtgcagtggcgtcatctcggctcactgcaagctccgcctcccgggttcacgccattctcctgcctcagcctcccgagtagctgggactacaggcgcccgccaccacgcctggcaattttttctatttttagtagagacggggtttcaccgtgttagccaggatgatctcgatctcctgacctcgtgatccgcccgcctcggcctcccaaagtgctgggattacaggcgtgagccaccgcgcccggccacagctcaactttacaggctgctctttgttagaaaatgatttggggctgcttttcattaaaaagaaaagccttaccaaggactcccatacccttgctatgtgcctaagtaattaactaattccttcttaactcctatatcaactggaggttttgcttttttttctttaaacagggtttcattttgttacccaggctggactgcagtggtgaaatcatagctcactgcagcctcaacctcttgggctcaagcgatcctcccgcctcagcctcctgtgtagctaggaccacaggtgtatgccaccacacctgcctaatttttaaaaaatttttgtagagatggggtctcactatattgctcaggctggtcttcaactcctggcctcaagtgtttctccgacctcagcctcccaaagagctgggattacgggcatgagccactgcacctagccaagactggagttttatgactcaaatcagcttcccccaaaatttggacactgggctttttaacgtgtaatttggctggtaggagacccgggcgtggggagtgctgagtggttggttggaggtggaatgacagaggacggacatgggttctttttgttgtcttctgttcttgtgtgggacggcagagctcgctgagccgcattaccagtctgggtggcgccggctggtgcatctcaatgaagggtttaaaaaatgtctcaacttcaaccttaggttttacaatagtgatgccatccctaggagcaactgaagaggtttggaatcttgtggcctccggctgcatggctcctaacctattaatataatttctaatcttgtgactaatttgttagtctttcaaaggcagtctgatccccggggaagaagggagtttgtttcagaaaagggctgttatctttgtttgaatgttaagctggaacttcctcctatggttatctgagtctgtgttcaggaatgaactagggctgttcgagggctacaggcacgatgcagtcggttaggtcagatctctttcactgtcgtaattttctcactgttataatttttgcaaaggcggtttcaatttaactgaaaatgtcaggcaaagaccaaatttaatatttttacagaaagccactgggagtagttttttattgttttattatttatttatttagagacagagtctcactctgttgcccaggctggagtgcagtggtgcaatcatagctcactgcagcctcaaactcctgggctcaagcgatcctcccacctcagcctcccgaggagctggggctacaggcacacaccatcatacccagctaaatttttaagaaattttttgtagagatggggtctcaccgttgtaactgcccaatgggtttaccttgccccctgcctaaacagggccgatttatcaagacagaggaattgtaatggagaaagagtaattcatgcagagccagctgtgcccgagaccagagttttattattactcaaatcagtctccccaggcattcagggtccagagtttttaaagataatttggcgggtaggggcttgggaagtggggagggctgattggtcaggttgcagagggaaccataggggggtgaagtgaggttttcttgctgttttctgttcctgggtggatggcggaactggttgagccagattaccgggctggctggtgtcagctgatccatccagtgcagaggctgcaaaatgtctcaaacaccgcgcttacgttttacaatagtgatgttacccccaggagcaatttgcagaggttcagactcttgagccagaggctgcacgacccctaaaccataatttttcttttcttttcttctttttttgtttttttcgagacagagtatcactctgttgcccaggcttgagtgcagtggtgtgatctcggctcactgcatcctctgcctccctggttcaagcaattctcctgcctcagcctccccagtaactgggactacgggcacatgtcaccatgcccggctaattttcatatttttaccagagacggggtttcaccatattgttccggccggtctcgaactcctgacctgaggcgatccaccctcatcggcctcccaaagtgctgggattataggcttgagccactgcgcccagccctaaactataatttttaatcttgtagctaatttgttagtcctacaaagtccaactggtccccaggcaagaaggaggtgttttcaggaaaaggctgtgatcagttttgtttcagagtgaaaccatgaactgaattccttcccaaagttagttgggcctatgcccaggaatgaacaaggacagcttaagggttagaagcaagatagagtcggttaggtctggcctctttcactgtcatcatttcctcagttacaatttttgcaaaggtggtttcgccacgttgcccaggctggtcttgaactgggctcaagcgatcctcctaccttggcctccataagtgctgggattacaggcctgcaccaccacatccggcccaccttggagcgtgttatataaagcgagccgtccccacacccctacagcctacgaatgagccttttcaccccatgcacgattctctgaaactgctctctgtaaggagctattcgggacacgttcttttgttctctggcatactcatcaggtagaaagaagtgattcagcaagcggctcccctgagagccctgatcgtttcctgttttcctgtgaagttagtctcgggaggtctgcgctgtgccatttttgggggaccattatctggctcccgaatggatcaaagcttactggtcagggggctgctgtatccctggggcaaaactgccagaaaatagcaggtagccctgtggtccttggcagggccagggcccggtggaagcagcagctgggccaagaacatcaggcgtgcatgaggcacagcccagttttgggagcatgacgcttgttttcgaggatgcctgtgctccccttcctgcctggacccctgctctccagccccggcagagcgaggctgtgagtcagcgctcggattagcatcagcatggaggtgccggctgggatgcaagccgccgccatgggatgagtcacgcggcttctccccgaatccccaaaggaggcagagcgtgttaggcttgttctggcttcatgcagagcactgaggggtgagggctgaccgtggctggccgcggagggaagcccaaagtctggcctccctgcggagactggggagaaaatgttgcgctcgtcgtttttaaatactgggggacaagtttcccttgtctgctaaggctgccattgtaaattacaagagtcaggagggctgaagcaaaagggatttcttctcccacagtcctggaggctggaagtctgagatcaaggtgtgagcagggctggttcctcctgaagcctctctccttggctcgtcgacatcatcatctccctgtgtcctcacagggtcgtccctctgtgtgtgtctgtgttccaatctcctctccttatgaggtgtcttagtccatttcaggctgctatcacagaatactatagactgggtggcttagaaacagcagacattgattctctcaccgtcctagaggctggaggtccaagatcaaggtgtgagcagggctggttcctcctgaggcctccctccttggcttgtagacaccatcttctccctgtgtcctcacagggtcgtccctctgtgtgtgtctgtgtcctcatctcctcttcttataaggtctgtagtcctattggattagggcccaccctagtgatctcgttttattttaatcacctctctaaggacgttgtgttcaaatacagtcacagtctgatgccctgggggttaggactgcgacctgtgaatttggagggggatatagttcagcccatagaacccactatccacataagtcattccacttcaaaatcagcacaaagcattagttttaaaaatctcaaatctgtatttttaaaaattgctcttaacacattagaaaaatatagaaaaactttttttgctgtttttctgagacaaaatctcactctgtagcccagcctggagtgcagggacgtgatcatagatcattgcagcctccacctcctgggctcaagcaatcttttgcctcagtcgtctcccaagtagtagctgagactacaggtgcacatcaccacacccagctattttttttttttaagtagaaacggggtctcactatgtttctcaggctgggctccaaatgagctcaagtggtcttaccgccttagcctcccaaagtggtaggattacaggtgggagccaccacacccaacctggaggaactctttttttttaaaattttaaataaattactatttgtggcctgcgttttcatcctattctctttttttttaaccaacatttgctggcatttttttttatgccgaagaaaacacctttgcccatctatgtcaggcctccagaccctcagggatgtacatctaatgcaccttcagccaccggtgtaaacagtaaacaggggccagatggcgcctgtgcaccttccctggccttgggagagcattggaatctctgcagcttttaagagcatcttgcttcaggtttgctgacctgcttgcttctgtaagatcatgcagacttcctgagcaatatctagcatttcatggtctcttttctatcctgcaggaagagggggctatagactcaactctcgttatggaaatacttatggtaaaggaattatgtcttacagaatatgtgaggcaaaactgtccatttgcaaataactaacacactgtctgcactgatgggaagctgatgctttcatccagtgcacaaccaactggccgttcgagtctctcatttgcattttccttggtcatccatgctggggggagatgttgtgcatgccctgaggacttcatttcttcaaaggaactatggcccacttacaggtgttactgggtgcatgtgtgtgcacgtgtgtgtgtatacatatgtgttcacacacaggtatgcttgtgtgtattgtgtgtgcatgcatgtgtacatgtgcatgtggattttgtaatcatgtgcataagtgcatgtggatttcatgtgcatgtgtgcaagtgtctgtgcacacatgtggattgagcacatgcatgtttgtgtatgtgcacagatgtgttggcatgtacttgtggattttgcatgtgtgcatgcttgtgcttgggttgcatgtgcattgcatgtttcccatgtgtgtccattcacatgcatacatttaggggtgtgcaagcacatgtgtgcatgtggatagatgcaggagtgtgcatctgggtgtgctcgtgtggtatgtgcatactgcacgaatatatcatgtgcatctgtgcatgtggattgtgtgtatacatgcgtgtgtacaggcatgcacacacacacatgaatgtgtttgtgtgtgcatatttgtgtgtacatgcatgtgtttatgcatacaggtgtaaacatgtgcacacatcggtgtgtgcatgtgcacacatgtgtacatgtgtatgtttaggcgaattgtgctttatatgtgcttttgttgcctgtgtgtgtggtatgtgcatgtgtgtgtatgtggggatgtgtgggatgtgcatgtgtgtggatgtgcacattgcattgtgcttctgtgttgcatttgtatttacatgttgcacatgtgtgtaaatgcatgtgtgtgtgcacgtgtgtatgcgtgcttgtctgcctgtgtgttgcacgtttgttgcatgctgcatgtgtgtatgcatgtgcacacacatttgtgcatgtcagtgtgtgttgcatgtgcttgtgtatgaatggcgtgcgtgtgtgcatgtgtgtccatggggttgtcagcctgtgtgtgttttgcatgcgcatgtatgtagactctccaatcctgaaattaaagctgcatctccctctccctggtattatccccattctgctaatgaccattagacatggcatacacattcacattcctcctccttatgctgcttggctgtccccctccccccacaagaatgtaaattccctgaaaacagggatctgtgtgctgtgttcacagtcgcatcctcaacagtgcccggcaatataaggccctccataagctctgctgaataaacacgaacatccttttccgcttacaggtggagatcaccattcaacgtatggcaatccagaaggtaactgattgactcacccggtcccaacctttaataagagcacactctcctagatcagtgctgggaggagctgtgtgggcttctgtttcccaacctcatgactttcacggagcactcatactttgtatgtatataaagtagctcctgaataaaaatatctgaccttcagcacaggaccaatcagagttcagagaaaggagaggcaagcattggttttcactgcagaagatgccccttagctctcaaagcaaggctgtgaatgagtgctgagactattacatttctcccagtaccaccattactcccctttctttgaccagcactaacttgaaacccaagaaggacaggagaaaggaaggtatgaacactctgcccaaagaagccatcagagtgcactgtcaatcccgtctcaggtcaaaggagggagaacttgaagcccagaaggctgactttgtgtcctgtattgttgggagaacaggttccccattccctaagggtcatattcttagagatttgggctgacacctgcttgagtttaagttgagagtaaacgcactcaaccccaaggctcttgtgagttttcaattatgggggaggagaaagtgattgaaggtgacctctacctttcaatgatcatgcagagtactagtatcaatatttttggggtatgttggcatccttagaaaaatttatggtttcacctttttccctctgtggtgtaaagtgaggtccagagatggaaagggcaaggcaaataaacaagtaattgcagtcaaatctgatgaataatttcctggaacatatgggatcctgtagcaaggcagaagggatactcctagactaggttaggtgagggaggtagggtttcctggagagaacaatatccaagccaatcccccaaaatatgggtgggaggtgcccaggagaagagtgaggtgtcagggaagatggtgcactaggtagagctggatacacacgtggggacaccggaaattgtgtagccaggatgtggaatgcaacgggaaccagggaaggatgcaatggtgaccaggaaagacctccaggttagcagaggtggagtctgcacttcatagaaccttcatgggaaggagcctgcccctgttgatatgtaggtgaagaatggacctgagggggctcactaagacccagggagacaccctttcagaccagttcagtactccctggaaatgatgacaggctgaattaaagcctgggcaaaggaggcaaagagaagcagtcagcttggatgaccacttggtaatgacaattgattgtacttgattgatttgtaagagatgagagagaggaaaaggtatgtatcagtcagctatgctgtgtcacaaaaaaccccaaaacttagtagctggaaataacaaccatttattatgttcgtgattatgtgagtcagcaatttgggctgacaccattctagtggtcctcctggtctcttctgaactccctctcttgtgtgcagtcaactgtaggtgtggccagcgctttgaccatgtttcctgggtcttcttatgtatctgggactttaggtggaatggctcatctcagcttcatgtgggctctcacatccctccaggaagccaggccaggcttcatcacatggtgaccagacagggtaccaagagcatgaagagaagcgtgcctgggcttagagccaccatgccttcacttgtgtgacattctgttggctaaagcctggattttcagaatgaagatgcagctccacctctggatggggaacactgtgaaatcatactgtggagcgtgttcatgtagggaggggaagaatagagggctgtctctcccaggaggcagggtgtggcgggcggcagcatcagccgtagagcaggttcttgcgttcagtgacaacactcttccccccagcatggcagcctcattcgtggagcagtcttgtgtccctcacctatgccatgccatgtattggcccaggtgttcaaccctgtctgaagaaagccatgcatggaaagggtggctatttcaaatggaaacggtgatttcttccttttttccctttggaagtgttgatttttgtcacatcaagctccttcttgttctttgtgcaggagtgccaaagctctggagcaatttgccatcgaggcattgaggatgcttgtgtctagtgtgtgcttgggtctagagttccagcatgcctttgaaagcaagcctatctggcagtttttagtggaacaatatttttgcatgagtgggcattctacatctaaaaaggcacaaaatagttttgacatgtgcctgtcatcccaactactcaggaggcggaggcaggaggatcacttgagcccaggagttcaggacgagcttaggcggcatagtgagaccccatctctaaaaaaataaatcaggccaggcgcggtggctcccctctgtaatcccaacactttgggaggctgaggcgagtggatcacctgaggtcaagagttcgagaccagcctggccaacatggtgaaaccccatctctactaaaaatgcaaaaattagttgggcatggtggcatacacctgtagtcccagctattcgggaggctgaggcaggagaatcgcttgaacccgggagaaggaggttgcagtgaactgagatcacgccactgtattccagactgggcgacagagcaacattccgtctcaaaaaataataagaaataaataaataaataaataaataaaattaattaaaaggcatacatgaattgacttcaacaaacaaacaaaaatgccaagtgcctcgtctgtgcaaatcctggccttggatgtcttcagtggtaaaatgtggttgacaagcttggctctttgtgaaaacagaattacttcctaaggtttttttttctttttttttaaattaagtttctcttttttttctgtgaatacaagggtgggaagggacgtgatggagaagttactagatagatgcaaaagttattgcagtttttgtcattactttcaatggcaaaaaccgcaataacttttggaccaacctaatatttaagcagttttcctgcagccatgtttttttctcggatgagcttgctttttctccactcctgcaggcaatatggtagcaaaaatcgtgtctcccatcgtatccgtggtggtggtgacactgctgggagcagcagccagttatttcaaactaaacaataggagaaat

SEQ ID NO: 2919 - DNA, 64446 bp, human; identical to SEQ ID NO: 2913

SEQ ID NO: 2920 - DNA, 62350 bp, human; identical to SEQ ID NO: 2914

SEQ ID NO: 2921 - DNA, 63877 bp, human; identical to SEQ ID NO: 2915

SEQ ID NO: 2922 - DNA, 22700 bp, human; identical to SEQ ID NO: 2916

SEQ ID NO: 2923 - DNA, 62496 bp, human; identical to SEQ ID NO: 2917

SEQ ID NO: 2924 - DNA, 59291 bp, human; identical to SEQ ID NO: 2918

SEQ ID NO: 2925 - DNA, 64446 bp, human; identical to SEQ ID NO: 2913

SEQ ID NO: 2926 - DNA, 62350 bp, human; identical to SEQ ID NO: 2914

SEQ ID NO: 2927 - DNA, 63877 bp, human; identical to SEQ ID NO: 2915

SEQ ID NO: 2928 - DNA, 22700 bp, human; identical to SEQ ID NO: 2916

SEQ ID NO: 2929 - DNA, 62496 bp, human; identical to SEQ ID NO: 2917

SEQ ID NO: 2930 - DNA, 59291 bp, human; identical to SEQ ID NO: 2918

SEQ ID NO: 2931 - DNA, 64446 bp, human; identical to SEQ ID NO: 2913

SEQ ID NO: 2932 - DNA, 62350 bp, human; identical to SEQ ID NO: 2914

SEQ ID NO: 2933 - DNA, 63877 bp, human; identical to SEQ ID NO: 2915

SEQ ID NO: 2934 - DNA, 62496 bp, human; identical to SEQ ID NO: 2917

SEQ ID NO: 2935 - DNA, 59291 bp, human; identical to SEQ ID NO: 2918

SEQ ID NO: 2936 - DNA, 29454 bp, human
ccttcctcttcttgatcggggattcaggaaggagcccaggagcagaggtgagtcctgtgaatgttcatttgtgctggatttgggctccgtgaccaggcatgaatagcgtggtgaacaaagagctccccgttcccttttctgtctctgaataattgcccagtttgttttgataaagcagaaacgtacccgtgacttacaggcctaggaatgcagctctttcctggagaagggggatctgttttctaatctgcaggagaggccttgggcaggccccatgctctgggtcacctcaatgtcacagtttccaaaattaaactcattcaaggctgttatcaccatctctttatttatttaacgtttttctccaagaaaaaatattcatatttttacttataaatacataacattgcgggagaaagaaaaattaggtcgggcacggtggctcacgtctgtaatcccagcactttgggaggtcgaggcgggtggattgcttgagcccaggagtttgagaccagcctgagcaaaagaggaaaccccacctctacttaaaaaaaaaaaaatcaatagccaggcatagtggcatgtgcctgtagtttcagctacttgggaggctgaggtaggaggatcgcttgagcccaagaatttgaggctgcagtgaactatggtcgcaccattgctctccagcctgggtgaaacagccagaccctatctcaaaaaaaaaaaaaaaaaaaaaaaaaggaaaagaaaagaaaaattagaaaaagagcacttttcctaaatctccacacccagagataaaccactgctgggcaggattgctgcaaaaaccatcttcccctagtttgtggtggtttggggttttctcattacatttgtacagtattttgcttttattccgttttctgaccattggcagcatgtcattgtaggtcagaaagcaatgctgagggtattaaaatgctcattttggttttctctccatgtacaattttaaatcaatctctttcccggtgaagatgctattaggttggtgaaacgtaattgcgtcttttgctattacttttagaatatgagaattgtgtgtgctctctagggtaaaacaaacgaacaaataaacaaaaaaacctcacgagcacggcgtacaccttatcccttccttctgtgttctaaacaaagcacaaatgatatctaaggtctttttctcttcgacagacagaaaattattggagatgtagcaattcagtgttagacatccatcaataatgtaagaagtgcattgattcggtctggaaaggccggaaaacttgaagcaaaggcaggaagactgtaagcagggagggggcttccaggtcacagataggtgagagaggaacagttgccttcttttgagtttctgatgagcctttccaaaggaggcaatcagatacgcatctatctcagtgagcaaaggggggactttgactagaatgggaggcagaggccctaagcagttccccgcttgacttttccctttagcttattgacttgcgggccttgagatttattttcctttcacaaagctcattgtctttctcagaagactggttttgtgcctgaatcctgctaggagcaaacacccctcccagcatccccgaaaaggcgttgaggggaaatccctcaaccaatcgcttctctcccactcacaccctggggtttcgcagccctgcggaccttgcccacccctcctctctgccctccccgctcccacaccagctgtgtctatccttggtcaggtttcacctggacagacaccacggccacttctaggctctcagtgcctgctggctccagtgtgtcctcactcactggccgctcggcccttctaaaagtggccaggtcactcccctggttactcagaggcagaaacccaacacatctgcatgctcctgtctctttatcttctatgcatgcccatgtcctgtcaacgaaaagaagcgaactctgtagaatatttgaagagatttattctgagccaaataagagtgaccatggcccatgacacagccctcaggaggacccaagaacgtgtgcccaaggtggtcagggtgcagcttgttttatacattttagggaggcatgaggtgtcaatcaaatacatttaagatacacattggtttggtccagaaaggtggaacaactcaaagtcagggggcttccagcttatacatagatttaaacatttcctggttgacaattggttgagttcatctaaagacctgggatcctaggaggctgaggcaggagaatcacttgaacccgggaggcggagcttgcagtgagccaagatcgcgccattgcactccagcctgggcaacagagcaagactccgtctcaaaaaaataaaaaagaaagattaaaaaaaaaaaaaaaaaaccctgggatccctagaaaagaaatcttcaggttaagagaaaagattgtggagaccaaggttattttgaagtcttgtagcggctgcccttagagacaatagatgacaattgtttcctattcagacttttaaaaggtgctagagtcttagtcaatcttttcaggattggaagggtccggtagaaaaagatgtgaatatctatgtgaatagagattctttacatctttacagatgcaaatttttccccacaaaggacagctttgcagggccatttcaagatatggcaaagaaacatgtttttgggtaaaatattttgattttcttattggtctcatgttatgccagagtcagattggaaagtaagtcacaatatatagttaaatgaaacccttctgatgagaatttttggtttgtagggcatgactctccagaccccttagataggaatttgggcaagataaaaagaaaaatcagagcttcgtcctcagtcccatgcacaagccacatggggtcagaccactgcagtaccctgaaggtgacctcttgctgcctgcaactctaattgttatcttccatctcattcctttcctgctctacaccctgggctctccctcacttctcggcgagactgaggggccgcccctctgtgctttgggggtcgcccgtttccctctgtggacagaacatttccaagtgtgggcaatggtcgccccctctcccggcagcacctacccctagcaatgaaggcgaatgcgtctctccttcatgcagcactcagtgcctgcagagtcctctaggcctttttccttcacactgacactcccagttctgttttcaagtctggacctcctgggctcaagcaaatcctcccacttccgcctcccaaagtgctgggattccaggcatgagccaccacgcgcagcctctcattgtatttctgatcttcataccctctactcagattcttttgtgtatcatccaagctttgatctttccccgcttcccccttccaaatcaggactctctctctgcatttctggacattaggaatcacccctgccctgggctcgggaagcagaagacaaaataatctgcttccggacactgggattctctcatcactttgtgatcactcatgggctatgaaagctgataaaggggatggagaccctatgaccactttcttcctctttctctgaagaccatctggctgtgtattgaaacacgttttacattcttaacatagtattaaacatttttgaagccttttcactcgggaagagcattcctttatagattttgatcattgttttaagatatttttgctattgatatcatgaacgggaatcaaagttcccctaattacttacttactgttttatttataatcaggtcaatttctgctgtcaatgtgattgtggacatctttatgtcttacaggaagtagagagagagacaacatgttacatctgcaccattcttggtaagatacaattatatgcactcattagtagtctcctttctttctttctttctttctcttccttccttcccttctttctcttcttttttttttttttttttttttttttgagacggagtctcactctgtcgcccaggctggagtgcagtggcgcgatctcggctcactgcaagctccgcctcccgggttcacaccattctcctgcctcagcctcccgagtagctgggactacaggcgcctgccaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggcctcttttctttctttctttctctttctttctttctttctttctttctctctctctttcttccttccttcccttctttattttttttcctttcttatatagagacagggtctcaccatgttgctcaagctggtcttaaacacctgggctcaggcaatgctcccaccttggcctcccaacgtgctcagataatgggcatgagccaccacgcctgaccgcttctggatctcttgatggtgctttctcagaatgcactgatagtgatttatcctgcatctggagaatgaagcatgagacccgtgattaatagatgtgctccaggctcccttgatttgatgttgccccaggcagcctcagaaggaattgtatttcattctctgcaaatcaggtgggcatcaaccgctaccatcggccaggtgtctggttttccagggaaaatcagggtttcccctactacaaaccttggagactcagattacatctttactgcatcccactggggattgggacactatggccctgctgtccatgtgcattcccagggtggcatcgatgaaagaggcagcaatgatagtggcaggctgtatgtcaccaacccctgcggaaatgttccctcatggtacgcaactaccagggctttctcctccaggctggaacctccttcacctccaaacccacttctcatcagataccagtgggctaaagaagtcagtcctgggtattttcatctgtgtgctacaatgaacagagggttttcatagactcagaagtagcagctcactgtgttctcaccttgccccaagcttgtgtctcttccttgctctgctgggtggtccaaaccctaaccccagcctccattccctatgttcaacacagtttgcttaaggaagaacaatgaagaagagggaatggagaaggggcaatagctgttctggggacccgatccatccaagaaaccatgactaaggcaggctttctggctgtttttgctttttcttgttgctgttgtagttttgagacagccttgctctgttgccctgcagtggtgcgatctcagctcgctgcagcctcaacctcccaggctcaagcgatcctcccacctcagccttcccaggagttgggactacaggcacgtgccaccacgcccagctaagctgtgtatttcttgtagagatgagttttcaccatgttgcgcaggctggtcttgaactcctgtggtaaagcaatccacccgctgcagcctcacaaaatactgagattacaggagagagccactgcaccccaccaaggctttctgttaatcatgagtttaatcacttaacaacagactttacagcatcaaaaaaaacccaaaaaacttcaaggccaaataaagccatcaacggtatcagttaattgtaaccagagaaaaacaatcaaatgcctaagagatgtcctcaaagctattctgaaatgtgatgataatatcaatacctcttaaaatagtgatgccaacttcccccatacacaagttctgcaaatgagatggacaggagcatgacgcagtctctgacagtttgtgtttcaggagctggctgccagcgatgctcgctgtactgctaagtttggcaccatcagcttccagcgacatttccgcctcccgaccgaacatccttcttctgatggcggacgaccttggcattggggacattggctgctatggcaacaacaccatgaggcaagggacagagaattactcacctggtgcccccaatgcagacaccagaagaaagagaagccactgaaaatgcatataacccttgatcttggcagttcacacttcaagagttctgcacttctgcgttttctaactctccctaatgttactttcttcccatgccagcactaacctcacctcaatccatcctacatatgactgctcatttcatttttatttttatttatttatttttattttttatttttctctgagacaaagtcttgctctgtggtccaggctggactgcactggtacaatcacagctcactgcagccttgacctcccaggttcaagtgatcctcctgcctcagcctcccgagtaattctgggactgcaggtgcccaccatcatgcttgggtaatttgtaagtttcttgtagaggtggggttttgccgtgttgcccagcctcgtctcgaacttctgggctcaagtgatccacacacctcagcctcccaaagtgctggtattgcagatgtaaaccaccatacctggcctcatttcttttctttttttttttttttttgagacagaatctcactgtgttgcccaggctggagtgcagtggtgcgatctcggctcactgcaacctccgcctctgcgattccagtgattctcctgccttactctccagagtagctgggattacaggcgcccgccaccatgcctggataatttttctatttttagtagagacagggttttgccatattggccaggctggtctcgaactcctggcctcaagtgattcacccgcttcagcctcccaaagtgctgggactacaggtgtgagccactgtgcctggcctcatttcattttttaaatatgatttttatccacccagtacataatggacaatgctttagaaatgctatcagccgggcatgactgtaataccagccctttgggaggctgaggcaggaggatcacttaaggccaggagttcaagaccagcctgggaaacatagtgaaatcctgtctctagaaaatataaacattaattttttttttttgagacggagtctcgctctgtcacccaggctggagtgcagtggcatgatcttggctcactgccagctccgtctcccgggtccacgccattctcctgcctcagcctcccaagtagcttggactacaggcgcccaccaccacaccccgctaattttttgtatttttaatagagacggggtttcatcatgttagccaggatggtctcaatctcctgacctcgtgatctgcctgcctcagcctcccaaagtgctgagattacaggcgtgagccaccacgcctggcacattaatttttaaattaaaaaaaaaattagccaggcatgatggcatgcacctgtaatcctagttattcaagagggtgaggtgtgggaggatcacttgagcccaggagtttaaggttgcagtgagctgtgatcagaccactgcactctgggcgacagagaccctgtttcaaaaagtaggctggccgtggtggctcacgcctgtaatcccagcactttgggaggccaaggcaggctgatcacttggaggtcaggagttcgagaccagcctggccaacatggtgaaacccccgtctctactaaaaatacaaaaattagctgggcatggtggcgggcacctgtaatcccagctacttgggaggctgaggcaggagaatcacttgaacccgggagggggaggttgtagtgagactcaaatagtgccactgcactccagcctgggtgacagagtgagactcagtctcaaaatacaaacaaataaacaaacatacaggagaaatcagtgtcgttgcctgtaagcagaagaccaatattgatctctgtctcactcccaaccctatccatctagccaagcccagcacttatgcgggatttcaatcctcccctgctgaaaagctctgcttcagacagacaagtccacaccctcctaatgccaaaatatggcgtgtccatctgtcaagagctagagctagtccgtcctcctgtccgaattccagccttccaccctcatgtagtacttacagtgtgttggcgtccatgaagtcaaaccttcccatgaacactgtgagctccagagaaggtgccctgggctctcagttctgcattccctctgaggtcggtctctcagtaccaacagtgccttgtggaaacttagtcactctatctactcattcatttatttattttagagacaggttgtctctctgtcacccaggttgaagtgcagtgttgcaatcacagctcactgcagcttcaaactcctgagctcaagcaatcctccttcctcagtctcccaagtagctggttctacagacatgcaccaccaatcctggctaatttttctatttttgtagatttttttgtagagacagggtctcgccatgttggcccggctggtcttgaactcctggccctaaacgatcctcccgctgtggctttccaaagtgctgggattacaggcatgagccaccgcgtccagccactcattcctatttaaatgagttgatgtttcctcgaaagttcagaagacattagaaatctttgacattacctttgggtcattcctgagaacatcttgaagcactcagcgatgaccagcagaccttctatgaagtagcatgtagctatgcttatgaaaagcctgtctaattttaacaagtaaagctgttaatttgtccctccataggactccgaatattgaccgccttgcagaggacggcgtgaagctgacccaacacatctctgccgcatctttgtgcaccccaagcagagccgccttcctcacgggcagataccctgtgcgatcaggtcagtctctctttacaactgcactagggtgcagcctggtgtattcgtcacagtttctagttcttacattttggtttttttattttttatttaaatagagactggggggtgttctctctatcttgcccatgctggtcttgaaatgctgggctcaaaagatccccgctccttgacctcccagagtgctgggattacaggcatgagccaccgtgcccaggcagcttttatattctgatgctttgacatcttagggctttgctgaccttggcaggactggccctcccagggctagccaattcttagagatagcaaacaagtcacctgggagtgcacctttcatgcataaaccaaacagtccagagcccacacccccaaccatcacttttatgagattttcatatatggggctactctctccttgccctaatccccccagaatcaggtaccagctttctagggacagcccctgcagatgaaagcccacggaaattgtacaacctggccagtcttaagccggcttaccctaccttgcccattactttccaaaaaagaaaaacaataaataagaaaggctttttccatgctttcccctcactccctctgcctcctgaccaaccctggagcttccccatatagtcacacagcatggctcacccctgcgtcctcttgaactgtgagtaataaactatcagaaactgtgagtaataaactatctctccaatgacagtcatctcctgatctgttggccttgccatagctgaatgataaaaccttaataataataatacataacacctacattttaaagcacttgggtagaggctgggcacggtggctcatgcctataatcccagcactttgagaggctgaggcaggcagatcacctgaggtcaggagttcaagaccagcctgaccaacatggggaaactccgtctctactgaaaatacaaaaattagctgggcgtgatgatgagtgcctgtaatcccagctacttggaaggctgaggcagtataattgcttgaacccgggaggcggagattgcagtgagccgagatggcgccactgcactccagcctgggtgacagagcaagactctgtcccaaaacaaacaaacaaacaaaaaaacccttgggtagagatttggaatgtctggagagcagaataaaattttatcagtggctaccaaccttgtcagtacgttagaatcatccagaggatattcccaccatcccaaagcccaagttccacccaagaccaatgaaaattagcacccctggggtgataaccaggcgtcagaatattttgaagctccccacacgattccaatgggcagacaactttgagaacctttagattatatcaagagtttgatgaaattataaaatcatttttagttcaggcacaatggctcatgtttctaatcccaacactttaggaggctgaggtgggaggatttacttgagtctaggagttcaagaccagcctgggcaacatagtgagaccccgtctctgccaaaaaattaaaaatattagctaggcatggtgatgagcccctatagtcccagctacttgagagactgaagtgggaggatcagttgagcccaggagttcaaggctgcagtgatctatagtcatgccactgcactcaagcctgggtgacagagtgagaccctgtctctgcaaaaaatttaaaaattagccaggtgtggtggtgcacacctgtagtcccagctactcaggtagctgaggtgggaggatcgtttgagcccaggtggttgagactgcagtggacattgattacaccactgcattccagcctggacgacagaacaagaccccatctttaaataaattaattaacaaacaaaaaaccatttaaatttttagtcctttttcactgaattatattgcttataacctgcacataacaggaaagtccatcttctcgctaaggttttcaataaattaatcatttactttgctgccaaaaatgcaatccactaggcaaagtcatataggaagtccattttcaatttaattttaagtaagagagatttttaccaagtgttctatttttgaataaataataaataacaaacaggaaaaaaaatgtggaacagtaattctttctcttaataattgctcaaagggatggtttccagcattggttaccgtgttcttcagtggaccggagcatctggaggtcttccaacaaatgagacaacttttgcaaaaatactgaaagagaaaggctatgccactggactcattggtatgtacgtttttaaaagtggtaagcacatgacttttatatggaagggacattcagctaaagagtttggaaaggaaagtgggtgaggtgctgtgggatttcccactagacagaaagctgcatgtatctaggaaccatgttcctttccaggttgttttctgcaaagtagatactcaagaaataccagctcaggcaaggtggctcatgcctataatcccagtactttgagaggccgaggcggaaggattgcttgagcccagaagtttgaaacccgcctgggcaacatagcaagaccccacgtctacaaaaaaatacataaaaataaattaaaaaataaataaaatgtgctcatgcctatggcatatgttccaagctccattgcacaacacataattgcttctttgttctgtgggatcctctcccacccttcacatggactttttgtcttagacatgaatgtcttagactgaacaccttcagctcttttctggttggtttatggatcaacttggctagtttagtgctgccatctaaatgtttgtgtccccctaaaattcctatgttgaaacccttaccccccaggtgatggtggcaggaggtgaagcctttgggaagtgatgaggtcgtgaaggtggagcctcatgtgtgggattagtgcccttacaaaagtgactctggtcaggcgcggtggctcatgcctgtaatcccagcactttgggaggccaaggtgggtggatcgcttgaggccaggactttgagaccagcctgggcagcatggcgaaaccctgtctctacgaaaaagaaaaagaaagaaagaaaaggaacatcaacttaatgaaatatttggcatctcaaacaatgttctcgtaggccatgataaaaaaaaataagaaaaaatatattcttgcatcaaaaatttctgtaatgctacctatttttccccttggtgtgtatgaaaatgtctttactagatttagtacctccctgtcagcttccataactaacatggttatttttctacaagtcaacaaacatgtcatgtattggatgaaaaataaaattaatgacaacagttccttgagaggagaccaagttgccattatcattattgtgttatagtaatgattgttatcaacagttccatttattgataacaaacaacatgactagtggatacaatgagtataaaattcaataaactatatttctaaaaattaaaaattataaaatgttctttgtttaattttttaccaaaaaaaaaaaaaaaacaaattctggggagattcagtcatcgctgtcaaacaaaggtgtattttttccaatagactttttttttttttttaaacagggtactcactctgttactcaggctagagggcaatggtgcagtcacagctcactgcagtctcgacctcccagactcaagtgatcctcccaccttagtctcccaagcagttggtactacaggcttgcaccaccatgcccggttaattttttcttttttttctttttttttttttttttttttgtagagatggggtcttcccatgctacccaggctggtctccagcaatcctgggcacaaggaatcctctcacctcggcctcccaaagtgctgggattatagttgtgaaccaccatgcctggccaactataatttttctaagacagaagagtctatccttaagggatatccattgggaaatcatgaggttttccagatggcagacagcattggggtggttgacatctctttgtcaacaccatagtagtggctacatggaagcaaagactatattcctttgactgaatttgaaaggtgtgccttgcaaaacccaccacccacttcaaccatggccactatgatagtggtttctcaaagagagaacaattccaaagtccagaagtcttttgcccatgctgctgatatcacatggtgctttccggccttcatcattgcactgcaaaacaaggtgcaatagactaaataatggtcccagagatgtcaggccctaacctctgaatctagcaaatattagcttatatgcaaaaagagtctttgtaaatgtgattaagtgaacaatcttgaggtgagaagatgatcctgaattatccagctgggcccactgtgcaaggacaaggcttcgtttaacatggaggtagaggaagattgggccacagagaggagaaagcagtgtgattaaagtgaggcgaccacaagccaagggatagctggagccaccaggagctgggagaggcaggaaggatcctcccctagagcctctggagagagtatgtgtgtgtctgtgtcctactatcctcttcttataggacacaagttctatcagattaaggcctgtattagtctgttctcacgctgctaataaagacatacccaagactgggtaatttataaagaaaagaggtttaatggacttccagtttcacatggctggggaggcctcacaatcatggtggaaggcaaaggagaagcaaaggcatgtctttcatggcggcaggcaagagggcatgtgcaggggaactcccatttataaaaccatcagatcttgtgagactcattcactaccatgagaacagtgtaggggaaaccacctccatgattcaattatctccacctggctccactcttgacacatagggattattacaattcaaggtgagatttgcatgaggacacagccaaaccatatcagtgcccaaactaatgacctcattttacattaattatcctttgaacaccctgtctccaaacacagtcacattctgaggtcctgggtgttagggcttcaactcatgaatttgaggcaggccaggatccagctcacaatagagtcattgcagatataatcaagtaaagatgaggtctctacagtgggccctactgcgatgactgctgtccttatgagacaagagattaggtcgcagacacacacagaggacaacgccatggaaacatggagatggagactggagtgatgcggccacaagcccagggaggcctggagccctcaggagctgggagaggcaggaaggatcctcccctagagcctccaatttgagtgtggcctggagacactttgatctcagactcctggtctctaggactgggagaggatagatttctgttgtattaagtgaacagttttacagtaatttgttccacctgtcacgggtaactaatattttggttaaagctgacacatggggtcctcattcccctgaaacgatgaggccagattgtggtgcaaataacagctaatgctgcccacacttctttgcaatctcctggccccccagtgtctaacagagtatcaggaatgtgacaaacagtcaatatcgacatgtccagttatgctcagatgcttgtcacatcaacatcctttttgcctctcaggaaaatggcatctgggtctcaactgtgagtcagccagtgatcattgccaccaccctctccatcatggctttgaccatttctacggaatgcctttctccttgatgggtgattgcgcccgctgggaactctcagagaagcgtgtcaacctggaacaaaaactcaacttcctcttccaagtcctggccttggttgccctcacactggtagcagggaagctcacacacctgatacccgtctcgtggatgccggtcatctggtcagccctttcggccgtcctcctcctcgcaagctcctattttgtgggtgctctgattgtccatgccgattgctttctgatgagaaaccacaccatcacggagcagcccatgtgcttccaaagaacgacaccccttattctgcaggaggttgcgtcctttctcaaaaggtcagcagaaaagggtcagcttcctccaagcactcagctttggaatgaaaacgcatcctaaatagtcttcttcagtcaggcatggtggctcattcctgtaatcccagtgcttttggaggctgaggtgggaggatcgcctgaggtcaggagttcgagaccagcctggccaacatggtgaaaccccgtctctactaaaaatacaaaaattagcccaatgtggggctttacaggtgcatgcctgtaatcccagctactcgggaggctgaggtgggagaatcccttgaacctgggaggtggaggttgcagggaggtgaggtcacatcactgcactccagcctgggtgacacagggagaacctgtctcaaaaaaaaaaagtcgttttctttaattgacgtttgaagaatgggatagccatgacctagaaggacaattttttggtaagaatggggcatagatgagggtcagtggagccctgtgacttgccttgtgtccattaaaacattgttacagctgagctgggcatagtggtacacacctgttatcccagctactcgggagactgaggcaagaggataatttgaggccaggagttagagaccagcctggacaacacagcaagaccccatttccacaaaaattttaaaaattagctggctgtggtggcatggacttgtaggcccagctacttgggaggctgaggcaggaggatcacttgagcccaggaggttgaggctatgtagtgaggctatgaagggagcctgggcgacagagcaaggccttgtctcaaaaagaaattgttacaggtcagctggaatttgctactactctggggtcagtcttattccattagcatcctcggatcaccacagacactatttaagtaacctgcatcacctgaagggctttataatcaattataaacttaaaaaaaagtctatcttcagaagtcagatgtcttttggcagaattcagcctgcggtcaattttatggcaaggaaaattcctgtgtgggaccaggagaaatgggatgaaactagttctcagtactacacagctattttcatgctccccaagggcattctagtaaagatggtaacaccatcaaaagtcaccttacctggtgacaatgaggttgtcatcatctcctacaacattcttagataatttttttctttttttttttgagacagagtctcgagctatggcccaggccggactgcagtggtgcaatcttggctcactgcgacctccgctcctgagttcaagcaattcctgtacctcagcctcccaagtagctgggattacaggcatgcaccaccatgctcagataacttttatatttttaatagagatgggttttgccatgttggccaggctggtcttgaactcctgacctcaagtgatctacccgccttggcttcccaaagtgctgggattacaggcgtgagccactgcatccagcctcttagagagttcttcatggcaatacctaatgtatgacagaaaggacattgacaattagcttgcaaattaaagcagggtaagactgttgtgttctttttgattttaaatgtgacaggatctggctatgttgcccaggctggtctcgaactcctgggctcaagtgatcctcctgcctcagcctcccaaagtgctgagattacaggcatgagacaccatgcccagcctgacgtgttctaattaaggctaacaccttcaccattgctcttaggcttcaaggatctagattagaccatgaaggccgggtgaagggagggagaagctaaaacactgctttcaaggaggacaatggaaataatatgaataacccaatatgcctcatttgtaaagtgtgttttttataactattttatgtcctaatcctcactacgtgatagcaattataaagaaaatggaatgtgtggcaccacttattctataagctaaagcttgaggttaaaaatagatattgaaataattgaacaaaataaaagtcatgtcagtaacctacagttcttttaactttgcattaagcagtagagttagaacattataatattcgggggggaaaagatgcattagatcagtgtgggtttttatttatttatttatttattttgagacaggatttcaatccggttgtccaggctgaagtgcagtggcgcaatctcagctcaccgcaacctcctcctcccagggtcaagcaatcctcccaccccaccctcctgagcagttgggagtacaggtgcatgtcaccacatcccgctaatttttgtatttttagtagagatggggtcttgctatgtttcccatgctggtcttgaactcctaggctgaagcaatgctcctgcctcagcctcccaaaatgctgggattgcaggtgtgagccaccacgcctggcccagtgtggatttttaaatagatttcagaagggaagggaaaagtcatgatgttaaagagtcttaaacaagacgtgtgttgtggtgcatgcctgtgatcccagctacttgggaggctgaggcaggagaattgcttgaacctgggaggcagaggttgcagtgagctgagatcgtgccactgcacccccgcctgggcgacagagccacaatccgtctcaaaatgaaaaacagagagaggtaacagaccagaaaggcatggtggctcacgcctgtaatcccaacactttggaaggccgagatgggcaggggcaggtcacttgagccgaggagttcaagaccagcctagtaaacatagtgagaccctgtctctacaaaaaaaaaaaaaaaaaaaaaaaaaaattagctgggcctgttagcacatgcctgtggccccagctacttgggaggctgaggtgggaggatcacttgagcctgggagattgaggctgcagtgagctgagatcatgtcactgcactccagcctgggtaacagagcaaggccctgtctttaaaatagccaaaaaaaaaaaaaaaaaaaaaaaaggaagattgttaaatataagaattaattttccgttgaagaagagttttgagtgtttctttttggtgagcagagttgagaagacatttgagtaatgatgtgacaagtgagatccgtatttagtatctacaggacttcaatctctgttttaccaaaaaagtcaccttaattgcttcgtatttatttttaggaataagcatgggcctttcctcctctttgtttcctttctacacgttcacatccctcttatcactatggagaacttcctcgggaagagtctccacgggctgtatggggacaacgtagaggagatggactggatggtaggtaagtgcacttccagggaaaatgggctgcttcccttccagcaatagaagcaggaaaggaaacaaagaatgagaaggttaaagacagaagatgcagaatagcgattgcagtgcgattggattttaagagtgcaaaatattatagcacagatcttcactgcattagcagagggtgaattccataacacatgcacgggaggcaatgcgattcggccaaagatgtccacatcttaatcccatgtggcagaaagctgtccactccctagacagaataatggctgcagagacatccacgtcctaatcttgatgtggtagacataaaaatggccccaaagatagccactttctaatccccatgtgggagacagaataatggccccaaagatgtccacatcctaatccccatgtgctagacagaataatgactccaaagatgtccacgtcttaatccccatgtgttagagagaataatgacctcagagatttccacgtctgaattcccaagtggcatacagaattttggccccaaagatgtctacgtcctattgccatgtggtagacaaacaaaagaaagagcagataaaattcctctccgctgtagagtggctagtggctccactgcactgaaaataggactaaatttcctcctatcacctacaaaagccccatgacctgctgctgcccagatcctagtctgacctctacccaacccccttgtcctccccacctgctgcattctggccacgtggacgccacacagtatctttcacatttgtcccctgtcagggcttccacacctgctgttccctcctggaatgcttcctcaggcttcactggctcctcttcagagcctgccctgacgcacccctaaagtagctcctccccaatcatcttctcccccattctcctgtggtccttttttgttttgcctttgttttcctcctcctcttcctcctttctcctcctccccctcttcttcttcttcttcttcttattcttcttcttcatattcctcctcctcctcctccttcttcttcctcttccacttcttcctcttcttcttctttcttctttctgtcttctttcttctttttttcctaacacagcatcaccattgcttctcttcgtgaccatgtgttaggtaggttgattttccatttcccccaggggaatataaactcctgtggggccggattgtcttgcctcattccctcattatatttcctgggtttagaacaggatggaaggggaatattgcttgagtgagtcagggctgggtgagcacctgtatatgggcacagcacatccctgcctcccaaaaaagaacttaggaaccgcagggtttaggtggtggtgggctgcgaatcccaggatcctcagaataattgccatcagagatttgggtgaacgacgtatttaaaaaaaaaaaattgtttcctcaacaagctaggcatggaaggagaaaaagttaattgtgtgtgtgtgtgtggcagggtctcactttttgttttgtttttttttttttgttttttttgttttttttttgagaccgagtctcactctgttgcccaggctggagtgcaatggcacggtctcagctcactgcaacctccgcctcccgggttcaagcaattctcctgcctcagcctccggagtagctgggtttacaggcacccgccaccatgcctggctaatttttgtacttttagtagagatggggtttcaccatgttggccaggctggtctcgaactgctgaccttgtgatccgcccgcctcagcctcccaaagtgctgggattacagggatgagccactgcgcctggccgacagggtctcactcttacccaggctggagtgcagtggtgcaaccgtggctcactgcaccctgccttcccaggctcaagcaatcctcccacctcagcctcccaagtacctgggaccacaggtgtgcactaccacacccggctaatttttttattatttgtagagacaagttcttgctgtgttgttcaggctggtctcaaactcataggctcaaagagcctcccacctcagcctctcaaattgctgagatttcaggcatgagccactgtgcccggccaactgtgagtgacattaatgacatgagttcccttgtgtgtggctgcaagaagctcagggtcacttttgaggactggtctgcattttcagtctatgctttcttctcaggaatattcacatgcctcacttttttttttttttttttttttttttttttgagaccgagtctcactctgtcacccaggctggagcgcagtggcgtgatctcagctcacagcaatctccacttcccgggtttaagctattctcctgcctcagcctcccaagtagctggtactacaagcatgtgccaccacgcccggctaatttttgtatttttagtagagatgtagtttcatcatgttggccaggctggtctacaactcctgaccccaaatgatcctcctgcctcggcctcctaaagtgctgggattacaagtgtgagccactgtgcccagcctgcatgctgcacttttaagtttttgatattttgtccttgtacgttgcctaaaattctgaccaaaggatggggtgcatataaagtcatacatcaatctccaacaaaggatatcaaaattatccaacagctgacttccattatgcgttaaaactaaggcttcattcttgtggctagcccccgaatgctaaagcatacacttcagagctgcatttctgatatttttccatttcgacggccccaaaaacatctgttctttgcaggacggatccttgacactttggacgtggagggtttgagcaacagcaccctcatttattttacgtcggatcacggcggttccctagagaatcaacttggaaacacccagtatggtggctggaatggaatttataaaggtaagactgagatgctcccagatcttcatcttgcaagtttatctcttccctgcaattcccagcagggcaatctattccaggagggtcaatattattgctcagggacagtgatttttcctatccagggcaaaagtggtaatttgacatactccagtttgaatttttgttcctggaccaaactgagggtcaggctgcttattctggtggttcaaaaatgagatgcagatgaactgggagaggagggagtttatttctgtaaccggttacagggaggtctggaaattgttgccagaccaactcaaaattacaaagttctccagagcttctatttctaagctgtatgtctgcgtgtaagtgtgcactcatctaaagacattagtgatgaacttcttctaatctgtaactaaggtctgagtcccggagaccctcctctggagactaagtaaattgacttaatctaaatgggtccaggtggccgggcacggtggttcatgcctgtaatcccagcactttgggaagccgaggtgcgtggatcacctgaagtcaggaatttgaggccaacctggccaacatggtgaaacctcgcctctactaaaaatacaaaaattagccgggcatggtggcacacgcctgtagtcccagctactcaggaggctgaggcagaagaatcgcttgaacctgggaggcggaggttgcagtgagctgagatcgcgccactgcactccagcctaagcaatagagagagtctccatctcaacaacaaaaataataaaataaataaataaacaaataaataaatgggtccaggtgccagggctgattacccttaccttgtctcctgctaaatcgcggaggtctggggagttgtttcagacctctaataaaacttgtttaatcctaaaagggtcctgctaagaattccttggttatcttgtcacgcttcaaggcccaggagaggcctgggcagaactcctggggggcttttgtgacatcccggcctttgtatacaggcgctggttgtttcagcttttgctatttaacttcaccactcgtcagtgctgaaacagttgttacggaggcctgtgttagtgagacgtggcctgccacgtttttgtgcacaattaaggaatttttagtagattatcagagttgtgtaaccatcatcatgtcgatgaaaagagctaaactctgtaaaacatttgaagaggtttattctgagccaaataggagtgaccatggcctgtgacacagccctcaggaggtcccgagaacgtgtgcccaagatggtcaaggcgcagcttggttttatacattttagggaggcatgagacagcaatcaaatacatttaagagacacattggtttggtccagaaaggtgggacaactcaaagccacggggcttccagcctacaggtagatttaaacatttcctggttgacaattcgttgtttctctaaagacctgggatcaacagaaaggaatgtctgggttaagataaaggattgtggaggccaggcacagtggctcacacttgtaatcccaacgctttgggaggccaaggcgggtggatcacttgaggttaggagttcgagaccagcctggccaacatggtgaaactctgtctctactaaaaatacaaaaattagctgggtgtggtggtgcgtgcctgtaatcccagctacttgggaggctgaggcaggagaatccgttgaacctgggaggcggaggttgcagtgagccaagactgtgccactgtactccagcctgggcgacaaagcgaaactccatctcaaaaaaaaaaaaaaaaaaaaaaaaagattgtggacacccaagttcttatttgcagaggaagccttcaggtactaggcttcagagacaagaggttgtaacatgcttcttatcagacctaaaggctgtgtggatgttaatgccagagaggaatcatgaggcatgttcgactcccgcttcctgtcacggcctgaaacagcctctcaggttaagtttttaaagagctctgggtgaggaggaagtccattcagatggttgggggtccttagaattttatttttgttttacaatcactattttcattcgtaaaatttattgttattatttttatttatttttattgagacagtctggctctatctcccaggctggagtacagtggtacgatcttggctcaccgcaacctttgcctcctgggctcaagtgatcctcctgtctcagcgatcataagtagctgggactacaggtgcatgcaaccactcctggctaatttttgtatttttgtagagatggggttttgccatgttgcccaggctggtctcaaactcctcacctcaagtgatcctcccacgttggcatcccaaggtgctgggatgacagcaggcatgagccaccacatgtggtccaccactgtttatttcagaacatttcatcacctcacaaaaaaatcctctactcatagcagtcactcccttttcccccgtgctaacatccatcacccaaaaacttatttttgatttgtttattatttaatttttaaaattatcttttgtaaagatagggtcttgttatgttgcccaggctggtctgaaactcctgaactcaagcagtcctcccagctgggcctcccaaagtgctgggattccaggcgtgagccaccatgcctggccacaaaattattttgtatcattgtatattttcctactctagacatttatgtaaatgaaatcatgcaatatgtggagtttttttgtttttacttagcatgatgcctctgaggttcatctgtgttgtggaaatgtttcattcctttccatggctgaatatattccattgtgtggactcaggtttgaattttaccttcagacaatgcatccaagaaggataaggccaggcgcagtggctctcacctgtaatcccagcactttgggagaccgaggcaggcagatcacttgaggtcaggagtttgagaccagcctggccaacatggtgaaacctcatctctactaaaaatacaaaaattagccaggcgtggtggtgcacgcctgtaatcccagctgaggaggctgaggcaggagaattgcttgaacctgggaggtgaaggttgcagtcagctgagattgtgccactgcactctcgcctgggtgacagagtaagactctgtctcaaaaaaaaaaaaaaaaaaaaaaaaggtagaagggtagacacctagctggccacattatattcaaacctgtattccattgtttccaaacacgccattctttcgtgtaccacaaagatgctaaaatgtgctgccccgtgtacatgacttcacactgttgtgcttacacattttgtcttctccctgcttagagagctttatttttcagtccttgaaagagcctttttaggctaatattggcaaatatacctatgatgtatatttgctttgaagtagatggatccatcagtctagtacatatgtaaaacgggatatataaatgccaactacatccactaatgccttcccacaacaacttcacattgaaggcctgactcctcagaaaccttctttatctcattgccattgacgttaatgtatcctctacccaatctggttctctgtgccatcaagaatgtcagtattataaactggcggagctttaaacaacaggaatttatcctgtcccagccctggagaccaggagtttgagatcaacgtgtctcagggaaatgttcccgccagaagctctaggggaggctcctccctgcctctgccaactcctgggggccccaggtgtccctgagcttgtggccacatcactccagtctctgcctccgtctctatgtggccttctcctctgtgtctgtgtctcctcttctgtctcttagaatgctgtcattggacttagagtccatccttctccgcgacgatcttgagatacttaattgcatctacaaggacccctttttaaaataaggtcccattcacagaatctggggatcagggtgtggatatatgtttcaggaggactaaagtgcaatccattgcaattgaatccacttctttctggatgctctaggggaggctccttcctgcctctcccagttaccgggggctccaggcatccctgggcttgtggccgcatcactccagtctctgcctctgtctccacgtgaccttcttctctgtgtccgtgtctcctcttctgtctcttagaaggacatctgtcattgcatttagggccaccctaatccaggattatctcaaggtccttaacttgattatatctgcaaaccccctatttccaaataaagtctcatttataggctctgggagatatgacatgaacatgttttggggtcactgttcaatacgttatagttgtatccactttcttcttgaggctctaggggaggatccttcctgctgctcccagcgcctgggggttccaggagtccctgggcttgtggccacatcactccagtctttgcctccgtctccacatggccttctcctctgtgtctgtgtcttctaagaacaagagtcatttgtagtgaaggacctaacttaatccaatgcacactaaccaataacaaggttaataaaaaatataaaatcaaacctctacaggggaactacatgagattgaatgttttaatgtcactaaaacagagagagagagagagagaaattgagagactcagggagagagaaacttcaaacaagtgaaacaagcagaaaagttaaatcagccaggctgagcatctatttctggtttttaaccactttcttttgtttctgttcaaacccaggtgggaagggcatgggaggatgggaaggtgggatccgcgtgcccgggatcttccgctggcccggggtgctcccggccggccgagtgattggcgagcccacgagtctgatggacgtgttccccaccgtggtccggctggcgggcggcgaggtgccccaggacaggtacagaacaacccaaagaaacaattcagctttgcacagacacagcaacacttatggcaaatgaacatgtcactttggctttgcagtaaggcgtccctgaaattgttccccgaccaaaccgagggtcgggctgcttattctcatggcccaataacgagatgcaaatgaacgaggaaagaaaggagttttatttctgtaaccagatacggggagaaggctggaaatgatcactagaccaactcaaaattacaaagttttccagagcttctataccttctaagctgtatgtccacatgtaagcgtgcatccatctaaagacataagtgattcaacttcctttcatctagaactaaggtctgagtcctgaggaccttcctctggagcctcagtaagttgacttaatctagatggttccaggtgctggggtgattacccttatcttgtctcctgctaaatcatggaggtttggggagttcttttagaccccccaataaaacttgtttgtggaggtctggggagttccttcagatccccaataaaacttgtttaatcctaaatgggtcctgttaagaatcccttcattattttatcgcgcttcaaggtccaggaaaggcctgggtagaactcttagtgggcttttgttacattccagcctttgggtgctggctctttcagcttttttttcttctttttttttttttgagactgagtctcactcagttgcccaggctggagtgcagtggtgcgatctaggctcactgcaacctccgcctcctgggttcaagcgatcctcctgcctcagcctcccgagtagctgggattacaggcacacaccagcacacctggctaatttttgtgtttttagttgagacggggtttcaccatgttggccaggctgatcccgaattcctgacctcaggtgatccacccgcctcgacctcccaaagtgctgggattacacgcacgagccactgtgcctggccaattaattactttttagccaaaggtgacgtttggtggtgactaacgtgggcagctgctgcattcttcttctaagcgtgctaatgcacacacatgccttccatccatctgcgttcacacccagactttccctccactgatacaacataaggagagtgcaccacctggggctgggactggtggatgctggagggacaaatgtccagagtccctgttccaaccctgagccatgccatgttccttcctgcagagtgattgacggccaagaccttctgcccttgctcctggggacagcccaacactcagaccacgagttcctgatgcattattgtgagaggtttctgcacgcagccaggtggcatcaacgggacagtgagtaggggagccccttcctaacacccttagggaaagagtccctctgtgcaggaaagcaccatgccctagaacaggctagggatggagctgcattccagagtccatctccatgtctccgcacttccgtttttctccacgagctttttaaatttagtttttgtcaatatgtgtccctctcattccagcgacatgccttctgagatcacctgccaatcgtcttaaaacgatggggagtcgttacctatagtttcagcaccatgtatgggctatatttcattctttcttccctgcactatatgaagtgcaacttttatcatcatcacacacacgtatgtgcatgcatacacacacgcacgcacacatgcttgcacacacatgtgttcaagacttttctagtctcttttttttcttatttttttgtaattatttttttgagactagtctttgtcgctcaggctggagtgcaactgcagtctcccgggttcaagtgattctcctgcctcagcctcctgagtagctgggattacaggtgcccaccactacacctggctaatttcttgtatttttagtagagatggggtttcaccatgttgggcaagctgttcttgaacccctggcctcaagtgatccaccctcctcggcctcccaaagtgctgggatgacaggcatgagccaccacgcctggtctccaatttttctttattaagttgaaacaaggtctcagtatgttgcccaggcaactcctgggctcaagcaatccacccatcttggcctcccaaaatgctgaaattgcaggtgtgagccaccacgcccagccttttgtagtctattttatgcatctagatgtgcttccaaatgttttaatcacctgaccttaacacgacttcatcttctttgtgaacaattacaggcgcactcctgtaatcccagctacttgtgaggctgaggcaggagaatcacttgaacccaggaggcggaggttgcaccactgcactctagcctgggcgacagagcaagactctgtctcaaataaaaaaaaaaaaaaagaaaagaaaagaaaagaaaagaaaaaactgactgagtgcaattcacaggcacttcgtgctttcacagtgttgtgcaacctccacgtctatgtagctccagaacattttcatcacgccaaaagcagacactgttcctatcagcagtcactctccatttcacaccctgcagaccctggaaaccactactctacttcctgtcattatgtgtttccctatccttgacattcaatgtgaatggaatcatgcaatgtgtgctcttttgtaacttctttctctgagcgtagtattttgaaagttcgttgatgttgcagcctgtgtcattgtgtcattccttctcatagctgcagagtatgccatgtaagatgtaccatgttttgtttatctgtccatccatcgatggacgcttgggttaggcctaccttttagccctatgaagatgccattctccagcaaggcaccctatttctctatgccaactctgtaatgattatctttccaccaggaggaacaatgtggaaagtccactttgtgacgcctgtgttccagccagagggagccggtgcctgctatggaagaaaggtctgcccgtgctttggggaaaaagtagtccaccacgatccacctttgctctttgacctctcaagagacccttctgagacccacatcctcacaccagcctcagagcccgtgttctatcaggtgatggaacgagtccagcaggcggtgtgggaacaccagcggacactcagcccagttcctctgcagctggacaggctgggcaacatctggagaccgtggctgcagccctgctgtggcccgttccccctctgctggtgccttagggaagatgacccacaataaatgtctgcagtgaaa

SEQ ID NO: 2937 - DNA, 29473 bp, human
cctttgggagagaaccttcctcttcttgatcggggattcaggaaggagcccaggagcagaggtgagtcctgtgaatgttcatttgtgctggatttgggctccgtgaccaggcatgaatagcgtggtgaacaaagagctccccgttcccttttctgtctctgaataattgcccagtttgttttgataaagcagaaacgtacccgtgacttacaggcctaggaatgcagctctttcctggagaagggggatctgttttctaatctgcaggagaggccttgggcaggccccatgctctgggtcacctcaatgtcacagtttccaaaattaaactcattcaaggctgttatcaccatctctttatttatttaacgtttttctccaagaaaaaatattcatatttttacttataaatacataacattgcgggagaaagaaaaattaggtcgggcacggtggctcacgtctgtaatcccagcactttgggaggtcgaggcgggtggattgcttgagcccaggagtttgagaccagcctgagcaaaagaggaaaccccacctctacttaaaaaaaaaaaaatcaatagccaggcatagtggcatgtgcctgtagtttcagctacttgggaggctgaggtaggaggatcgcttgagcccaagaatttgaggctgcagtgaactatggtcgcaccattgctctccagcctgggtgaaacagccagaccctatctcaaaaaaaaaaaaaaaaaaaaaaaaaggaaaagaaaagaaaaattagaaaaagagcacttttcctaaatctccacacccagagataaaccactgctgggcaggattgctgcaaaaaccatcttcccctagtttgtggtggtttggggttttctcattacatttgtacagtattttgcttttattccgttttctgaccattggcagcatgtcattgtaggtcagaaagcaatgctgagggtattaaaatgctcattttggttttctctccatgtacaattttaaatcaatctctttcccggtgaagatgctattaggttggtgaaacgtaattgcgtcttttgctattacttttagaatatgagaattgtgtgtgctctctagggtaaaacaaacgaacaaataaacaaaaaaacctcacgagcacggcgtacaccttatcccttccttctgtgttctaaacaaagcacaaatgatatctaaggtctttttctcttcgacagacagaaaattattggagatgtagcaattcagtgttagacatccatcaataatgtaagaagtgcattgattcggtctggaaaggccggaaaacttgaagcaaaggcaggaagactgtaagcagggagggggcttccaggtcacagataggtgagagaggaacagttgccttcttttgagtttctgatgagcctttccaaaggaggcaatcagatacgcatctatctcagtgagcaaaggggggactttgactagaatgggaggcagaggccctaagcagttccccgcttgacttttccctttagcttattgacttgcgggccttgagatttattttcctttcacaaagctcattgtctttctcagaagactggttttgtgcctgaatcctgctaggagcaaacacccctcccagcatccccgaaaaggcgttgaggggaaatccctcaaccaatcgcttctctcccactcacaccctggggtttcgcagccctgcggaccttgcccacccctcctctctgccctccccgctcccacaccagctgtgtctatccttggtcaggtttcacctggacagacaccacggccacttctaggctctcagtgcctgctggctccagtgtgtcctcactcactggccgctcggcccttctaaaagtggccaggtcactcccctggttactcagaggcagaaacccaacacatctgcatgctcctgtctctttatcttctatgcatgcccatgtcctgtcaacgaaaagaagcgaactctgtagaatatttgaagagatttattctgagccaaataagagtgaccatggcccatgacacagccctcaggaggacccaagaacgtgtgcccaaggtggtcagggtgcagcttgttttatacattttagggaggcatgaggtgtcaatcaaatacatttaagatacacattggtttggtccagaaaggtggaacaactcaaagtcagggggcttccagcttatacatagatttaaacatttcctggttgacaattggttgagttcatctaaagacctgggatcctaggaggctgaggcaggagaatcacttgaacccgggaggcggagcttgcagtgagccaagatcgcgccattgcactccagcctgggcaacagagcaagactccgtctcaaaaaaataaaaaagaaagattaaaaaaaaaaaaaaaaaaccctgggatccctagaaaagaaatcttcaggttaagagaaaagattgtggagaccaaggttattttgaagtcttgtagcggctgcccttagagacaatagatgacaattgtttcctattcagacttttaaaaggtgctagagtcttagtcaatcttttcaggattggaagggtccggtagaaaaagatgtgaatatctatgtgaatagagattctttacatctttacagatgcaaatttttccccacaaaggacagctttgcagggccatttcaagatatggcaaagaaacatgtttttgggtaaaatattttgattttcttattggtctcatgttatgccagagtcagattggaaagtaagtcacaatatatagttaaatgaaacccttctgatgagaatttttggtttgtagggcatgactctccagaccccttagataggaatttgggcaagataaaaagaaaaatcagagcttcgtcctcagtcccatgcacaagccacatggggtcagaccactgcagtaccctgaaggtgacctcttgctgcctgcaactctaattgttatcttccatctcattcctttcctgctctacaccctgggctctccctcacttctcggcgagactgaggggccgcccctctgtgctttgggggtcgcccgtttccctctgtggacagaacatttccaagtgtgggcaatggtcgccccctctcccggcagcacctacccctagcaatgaaggcgaatgcgtctctccttcatgcagcactcagtgcctgcagagtcctctaggcctttttccttcacactgacactcccagttctgttttcaagtctggacctcctgggctcaagcaaatcctcccacttccgcctcccaaagtgctgggattccaggcatgagccaccacgcgcagcctctcattgtatttctgatcttcataccctctactcagattcttttgtgtatcatccaagctttgatctttccccgcttcccccttccaaatcaggactctctctctgcatttctggacattaggaatcacccctgccctgggctcgggaagcagaagacaaaataatctgcttccggacactgggattctctcatcactttgtgatcactcatgggctatgaaagctgataaaggggatggagaccctatgaccactttcttcctctttctctgaagaccatctggctgtgtattgaaacacgttttacattcttaacatagtattaaacatttttgaagccttttcactcgggaagagcattcctttatagattttgatcattgttttaagatatttttgctattgatatcatgaacgggaatcaaagttcccctaattacttacttactgttttatttataatcaggtcaatttctgctgtcaatgtgattgtggacatctttatgtcttacaggaagtagagagagagacaacatgttacatctgcaccattcttggtaagatacaattatatgcactcattagtagtctcctttctttctttctttctttctcttccttccttcccttctttctcttcttttttttttttttttttttttttttgagacggagtctcactctgtcgcccaggctggagtgcagtggcgcgatctcggctcactgcaagctccgcctcccgggttcacaccattctcctgcctcagcctcccgagtagctgggactacaggcgcctgccaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggcctcttttctttctttctttctctttctttctttctttctttctttctctctctctttcttccttccttcccttctttattttttttcctttcttatatagagacagggtctcaccatgttgctcaagctggtcttaaacacctgggctcaggcaatgctcccaccttggcctcccaacgtgctcagataatgggcatgagccaccacgcctgaccgcttctggatctcttgatggtgctttctcagaatgcactgatagtgatttatcctgcatctggagaatgaagcatgagacccgtgattaatagatgtgctccaggctcccttgatttgatgttgccccaggcagcctcagaaggaattgtatttcattctctgcaaatcaggtgggcatcaaccgctaccatcggccaggtgtctggttttccagggaaaatcagggtttcccctactacaaaccttggagactcagattacatctttactgcatcccactggggattgggacactatggccctgctgtccatgtgcattcccagggtggcatcgatgaaagaggcagcaatgatagtggcaggctgtatgtcaccaacccctgcggaaatgttccctcatggtacgcaactaccagggctttctcctccaggctggaacctccttcacctccaaacccacttctcatcagataccagtgggctaaagaagtcagtcctgggtattttcatctgtgtgctacaatgaacagagggttttcatagactcagaagtagcagctcactgtgttctcaccttgccccaagcttgtgtctcttccttgctctgctgggtggtccaaaccctaaccccagcctccattccctatgttcaacacagtttgcttaaggaagaacaatgaagaagagggaatggagaaggggcaatagctgttctggggacccgatccatccaagaaaccatgactaaggcaggctttctggctgtttttgctttttcttgttgctgttgtagttttgagacagccttgctctgttgccctgcagtggtgcgatctcagctcgctgcagcctcaacctcccaggctcaagcgatcctcccacctcagccttcccaggagttgggactacaggcacgtgccaccacgcccagctaagctgtgtatttcttgtagagatgagttttcaccatgttgcgcaggctggtcttgaactcctgtggtaaagcaatccacccgctgcagcctcacaaaatactgagattacaggagagagccactgcaccccaccaaggctttctgttaatcatgagtttaatcacttaacaacagactttacagcatcaaaaaaaacccaaaaaacttcaaggccaaataaagccatcaacggtatcagttaattgtaaccagagaaaaacaatcaaatgcctaagagatgtcctcaaagctattctgaaatgtgatgataatatcaatacctcttaaaatagtgatgccaacttcccccatacacaagttctgcaaatgagatggacaggagcatgacgcagtctctgacagtttgtgtttcaggagctggctgccagcgatgctcgctgtactgctaagtttggcaccatcagcttccagcgacatttccgcctcccgaccgaacatccttcttctgatggcggacgaccttggcattggggacattggctgctatggcaacaacaccatgaggcaagggacagagaattactcacctggtgcccccaatgcagacaccagaagaaagagaagccactgaaaatgcatataacccttgatcttggcagttcacacttcaagagttctgcacttctgcgttttctaactctccctaatgttactttcttcccatgccagcactaacctcacctcaatccatcctacatatgactgctcatttcatttttatttttatttatttatttttattttttatttttctctgagacaaagtcttgctctgtggtccaggctggactgcactggtacaatcacagctcactgcagccttgacctcccaggttcaagtgatcctcctgcctcagcctcccgagtaattctgggactgcaggtgcccaccatcatgcttgggtaatttgtaagtttcttgtagaggtggggttttgccgtgttgcccagcctcgtctcgaacttctgggctcaagtgatccacacacctcagcctcccaaagtgctggtattgcagatgtaaaccaccatacctggcctcatttcttttctttttttttttttttttgagacagaatctcactgtgttgcccaggctggagtgcagtggtgcgatctcggctcactgcaacctccgcctctgcgattccagtgattctcctgccttactctccagagtagctgggattacaggcgcccgccaccatgcctggataatttttctatttttagtagagacagggttttgccatattggccaggctggtctcgaactcctggcctcaagtgattcacccgcttcagcctcccaaagtgctgggactacaggtgtgagccactgtgcctggcctcatttcattttttaaatatgatttttatccacccagtacataatggacaatgctttagaaatgctatcagccgggcatgactgtaataccagccctttgggaggctgaggcaggaggatcacttaaggccaggagttcaagaccagcctgggaaacatagtgaaatcctgtctctagaaaatataaacattaattttttttttttgagacggagtctcgctctgtcacccaggctggagtgcagtggcatgatcttggctcactgccagctccgtctcccgggtccacgccattctcctgcctcagcctcccaagtagcttggactacaggcgcccaccaccacaccccgctaattttttgtatttttaatagagacggggtttcatcatgttagccaggatggtctcaatctcctgacctcgtgatctgcctgcctcagcctcccaaagtgctgagattacaggcgtgagccaccacgcctggcacattaatttttaaattaaaaaaaaaattagccaggcatgatggcatgcacctgtaatcctagttattcaagagggtgaggtgtgggaggatcacttgagcccaggagtttaaggttgcagtgagctgtgatcagaccactgcactctgggcgacagagaccctgtttcaaaaagtaggctggccgtggtggctcacgcctgtaatcccagcactttgggaggccaaggcaggctgatcacttggaggtcaggagttcgagaccagcctggccaacatggtgaaacccccgtctctactaaaaatacaaaaattagctgggcatggtggcgggcacctgtaatcccagctacttgggaggctgaggcaggagaatcacttgaacccgggagggggaggttgtagtgagactcaaatagtgccactgcactccagcctgggtgacagagtgagactcagtctcaaaatacaaacaaataaacaaacatacaggagaaatcagtgtcgttgcctgtaagcagaagaccaatattgatctctgtctcactcccaaccctatccatctagccaagcccagcacttatgcgggatttcaatcctcccctgctgaaaagctctgcttcagacagacaagtccacaccctcctaatgccaaaatatggcgtgtccatctgtcaagagctagagctagtccgtcctcctgtccgaattccagccttccaccctcatgtagtacttacagtgtgttggcgtccatgaagtcaaaccttcccatgaacactgtgagctccagagaaggtgccctgggctctcagttctgcattccctctgaggtcggtctctcagtaccaacagtgccttgtggaaacttagtcactctatctactcattcatttatttattttagagacaggttgtctctctgtcacccaggttgaagtgcagtgttgcaatcacagctcactgcagcttcaaactcctgagctcaagcaatcctccttcctcagtctcccaagtagctggttctacagacatgcaccaccaatcctggctaatttttctatttttgtagatttttttgtagagacagggtctcgccatgttggcccggctggtcttgaactcctggccctaaacgatcctcccgctgtggctttccaaagtgctgggattacaggcatgagccaccgcgtccagccactcattcctatttaaatgagttgatgtttcctcgaaagttcagaagacattagaaatctttgacattacctttgggtcattcctgagaacatcttgaagcactcagcgatgaccagcagaccttctatgaagtagcatgtagctatgcttatgaaaagcctgtctaattttaacaagtaaagctgttaatttgtccctccataggactccgaatattgaccgccttgcagaggacggcgtgaagctgacccaacacatctctgccgcatctttgtgcaccccaagcagagccgccttcctcacgggcagataccctgtgcgatcaggtcagtctctctttacaactgcactagggtgcagcctggtgtattcgtcacagtttctagttcttacattttggtttttttattttttatttaaatagagactggggggtgttctctctatcttgcccatgctggtcttgaaatgctgggctcaaaagatccccgctccttgacctcccagagtgctgggattacaggcatgagccaccgtgcccaggcagcttttatattctgatgctttgacatcttagggctttgctgaccttggcaggactggccctcccagggctagccaattcttagagatagcaaacaagtcacctgggagtgcacctttcatgcataaaccaaacagtccagagcccacacccccaaccatcacttttatgagattttcatatatggggctactctctccttgccctaatccccccagaatcaggtaccagctttctagggacagcccctgcagatgaaagcccacggaaattgtacaacctggccagtcttaagccggcttaccctaccttgcccattactttccaaaaaagaaaaacaataaataagaaaggctttttccatgctttcccctcactccctctgcctcctgaccaaccctggagcttccccatatagtcacacagcatggctcacccctgcgtcctcttgaactgtgagtaataaactatcagaaactgtgagtaataaactatctctccaatgacagtcatctcctgatctgttggccttgccatagctgaatgataaaaccttaataataataatacataacacctacattttaaagcacttgggtagaggctgggcacggtggctcatgcctataatcccagcactttgagaggctgaggcaggcagatcacctgaggtcaggagttcaagaccagcctgaccaacatggggaaactccgtctctactgaaaatacaaaaattagctgggcgtgatgatgagtgcctgtaatcccagctacttggaaggctgaggcagtataattgcttgaacccgggaggcggagattgcagtgagccgagatggcgccactgcactccagcctgggtgacagagcaagactctgtcccaaaacaaacaaacaaacaaaaaaacccttgggtagagatttggaatgtctggagagcagaataaaattttatcagtggctaccaaccttgtcagtacgttagaatcatccagaggatattcccaccatcccaaagcccaagttccacccaagaccaatgaaaattagcacccctggggtgataaccaggcgtcagaatattttgaagctccccacacgattccaatgggcagacaactttgagaacctttagattatatcaagagtttgatgaaattataaaatcatttttagttcaggcacaatggctcatgtttctaatcccaacactttaggaggctgaggtgggaggatttacttgagtctaggagttcaagaccagcctgggcaacatagtgagaccccgtctctgccaaaaaattaaaaatattagctaggcatggtgatgagcccctatagtcccagctacttgagagactgaagtgggaggatcagttgagcccaggagttcaaggctgcagtgatctatagtcatgccactgcactcaagcctgggtgacagagtgagaccctgtctctgcaaaaaatttaaaaattagccaggtgtggtggtgcacacctgtagtcccagctactcaggtagctgaggtgggaggatcgtttgagcccaggtggttgagactgcagtggacattgattacaccactgcattccagcctggacgacagaacaagaccccatctttaaataaattaattaacaaacaaaaaaccatttaaatttttagtcctttttcactgaattatattgcttataacctgcacataacaggaaagtccatcttctcgctaaggttttcaataaattaatcatttactttgctgccaaaaatgcaatccactaggcaaagtcatataggaagtccattttcaatttaattttaagtaagagagatttttaccaagtgttctatttttgaataaataataaataacaaacaggaaaaaaaatgtggaacagtaattctttctcttaataattgctcaaagggatggtttccagcattggttaccgtgttcttcagtggaccggagcatctggaggtcttccaacaaatgagacaacttttgcaaaaatactgaaagagaaaggctatgccactggactcattggtatgtacgtttttaaaagtggtaagcacatgacttttatatggaagggacattcagctaaagagtttggaaaggaaagtgggtgaggtgctgtgggatttcccactagacagaaagctgcatgtatctaggaaccatgttcctttccaggttgttttctgcaaagtagatactcaagaaataccagctcaggcaaggtggctcatgcctataatcccagtactttgagaggccgaggcggaaggattgcttgagcccagaagtttgaaacccgcctgggcaacatagcaagaccccacgtctacaaaaaaatacataaaaataaattaaaaaataaataaaatgtgctcatgcctatggcatatgttccaagctccattgcacaacacataattgcttctttgttctgtgggatcctctcccacccttcacatggactttttgtcttagacatgaatgtcttagactgaacaccttcagctcttttctggttggtttatggatcaacttggctagtttagtgctgccatctaaatgtttgtgtccccctaaaattcctatgttgaaacccttaccccccaggtgatggtggcaggaggtgaagcctttgggaagtgatgaggtcgtgaaggtggagcctcatgtgtgggattagtgcccttacaaaagtgactctggtcaggcgcggtggctcatgcctgtaatcccagcactttgggaggccaaggtgggtggatcgcttgaggccaggactttgagaccagcctgggcagcatggcgaaaccctgtctctacgaaaaagaaaaagaaagaaagaaaaggaacatcaacttaatgaaatatttggcatctcaaacaatgttctcgtaggccatgataaaaaaaaataagaaaaaatatattcttgcatcaaaaatttctgtaatgctacctatttttccccttggtgtgtatgaaaatgtctttactagatttagtacctccctgtcagcttccataactaacatggttatttttctacaagtcaacaaacatgtcatgtattggatgaaaaataaaattaatgacaacagttccttgagaggagaccaagttgccattatcattattgtgttatagtaatgattgttatcaacagttccatttattgataacaaacaacatgactagtggatacaatgagtataaaattcaataaactatatttctaaaaattaaaaattataaaatgttctttgtttaattttttaccaaaaaaaaaaaaaaaacaaattctggggagattcagtcatcgctgtcaaacaaaggtgtattttttccaatagactttttttttttttttaaacagggtactcactctgttactcaggctagagggcaatggtgcagtcacagctcactgcagtctcgacctcccagactcaagtgatcctcccaccttagtctcccaagcagttggtactacaggcttgcaccaccatgcccggttaattttttcttttttttctttttttttttttttttttttgtagagatggggtcttcccatgctacccaggctggtctccagcaatcctgggcacaaggaatcctctcacctcggcctcccaaagtgctgggattatagttgtgaaccaccatgcctggccaactataatttttctaagacagaagagtctatccttaagggatatccattgggaaatcatgaggttttccagatggcagacagcattggggtggttgacatctctttgtcaacaccatagtagtggctacatggaagcaaagactatattcctttgactgaatttgaaaggtgtgccttgcaaaacccaccacccacttcaaccatggccactatgatagtggtttctcaaagagagaacaattccaaagtccagaagtcttttgcccatgctgctgatatcacatggtgctttccggccttcatcattgcactgcaaaacaaggtgcaatagactaaataatggtcccagagatgtcaggccctaacctctgaatctagcaaatattagcttatatgcaaaaagagtctttgtaaatgtgattaagtgaacaatcttgaggtgagaagatgatcctgaattatccagctgggcccactgtgcaaggacaaggcttcgtttaacatggaggtagaggaagattgggccacagagaggagaaagcagtgtgattaaagtgaggcgaccacaagccaagggatagctggagccaccaggagctgggagaggcaggaaggatcctcccctagagcctctggagagagtatgtgtgtgtctgtgtcctactatcctcttcttataggacacaagttctatcagattaaggcctgtattagtctgttctcacgctgctaataaagacatacccaagactgggtaatttataaagaaaagaggtttaatggacttccagtttcacatggctggggaggcctcacaatcatggtggaaggcaaaggagaagcaaaggcatgtctttcatggcggcaggcaagagggcatgtgcaggggaactcccatttataaaaccatcagatcttgtgagactcattcactaccatgagaacagtgtaggggaaaccacctccatgattcaattatctccacctggctccactcttgacacatagggattattacaattcaaggtgagatttgcatgaggacacagccaaaccatatcagtgcccaaactaatgacctcattttacattaattatcctttgaacaccctgtctccaaacacagtcacattctgaggtcctgggtgttagggcttcaactcatgaatttgaggcaggccaggatccagctcacaatagagtcattgcagatataatcaagtaaagatgaggtctctacagtgggccctactgcgatgactgctgtccttatgagacaagagattaggtcgcagacacacacagaggacaacgccatggaaacatggagatggagactggagtgatgcggccacaagcccagggaggcctggagccctcaggagctgggagaggcaggaaggatcctcccctagagcctccaatttgagtgtggcctggagacactttgatctcagactcctggtctctaggactgggagaggatagatttctgttgtattaagtgaacagttttacagtaatttgttccacctgtcacgggtaactaatattttggttaaagctgacacatggggtcctcattcccctgaaacgatgaggccagattgtggtgcaaataacagctaatgctgcccacacttctttgcaatctcctggccccccagtgtctaacagagtatcaggaatgtgacaaacagtcaatatcgacatgtccagttatgctcagatgcttgtcacatcaacatcctttttgcctctcaggaaaatggcatctgggtctcaactgtgagtcagccagtgatcattgccaccaccctctccatcatggctttgaccatttctacggaatgcctttctccttgatgggtgattgcgcccgctgggaactctcagagaagcgtgtcaacctggaacaaaaactcaacttcctcttccaagtcctggccttggttgccctcacactggtagcagggaagctcacacacctgatacccgtctcgtggatgccggtcatctggtcagccctttcggccgtcctcctcctcgcaagctcctattttgtgggtgctctgattgtccatgccgattgctttctgatgagaaaccacaccatcacggagcagcccatgtgcttccaaagaacgacaccccttattctgcaggaggttgcgtcctttctcaaaaggtcagcagaaaagggtcagcttcctccaagcactcagctttggaatgaaaacgcatcctaaatagtcttcttcagtcaggcatggtggctcattcctgtaatcccagtgcttttggaggctgaggtgggaggatcgcctgaggtcaggagttcgagaccagcctggccaacatggtgaaaccccgtctctactaaaaatacaaaaattagcccaatgtggggctttacaggtgcatgcctgtaatcccagctactcgggaggctgaggtgggagaatcccttgaacctgggaggtggaggttgcagggaggtgaggtcacatcactgcactccagcctgggtgacacagggagaacctgtctcaaaaaaaaaaagtcgttttctttaattgacgtttgaagaatgggatagccatgacctagaaggacaattttttggtaagaatggggcatagatgagggtcagtggagccctgtgacttgccttgtgtccattaaaacattgttacagctgagctgggcatagtggtacacacctgttatcccagctactcgggagactgaggcaagaggataatttgaggccaggagttagagaccagcctggacaacacagcaagaccccatttccacaaaaattttaaaaattagctggctgtggtggcatggacttgtaggcccagctacttgggaggctgaggcaggaggatcacttgagcccaggaggttgaggctatgtagtgaggctatgaagggagcctgggcgacagagcaaggccttgtctcaaaaagaaattgttacaggtcagctggaatttgctactactctggggtcagtcttattccattagcatcctcggatcaccacagacactatttaagtaacctgcatcacctgaagggctttataatcaattataaacttaaaaaaaagtctatcttcagaagtcagatgtcttttggcagaattcagcctgcggtcaattttatggcaaggaaaattcctgtgtgggaccaggagaaatgggatgaaactagttctcagtactacacagctattttcatgctccccaagggcattctagtaaagatggtaacaccatcaaaagtcaccttacctggtgacaatgaggttgtcatcatctcctacaacattcttagataatttttttctttttttttttgagacagagtctcgagctatggcccaggccggactgcagtggtgcaatcttggctcactgcgacctccgctcctgagttcaagcaattcctgtacctcagcctcccaagtagctgggattacaggcatgcaccaccatgctcagataacttttatatttttaatagagatgggttttgccatgttggccaggctggtcttgaactcctgacctcaagtgatctacccgccttggcttcccaaagtgctgggattacaggcgtgagccactgcatccagcctcttagagagttcttcatggcaatacctaatgtatgacagaaaggacattgacaattagcttgcaaattaaagcagggtaagactgttgtgttctttttgattttaaatgtgacaggatctggctatgttgcccaggctggtctcgaactcctgggctcaagtgatcctcctgcctcagcctcccaaagtgctgagattacaggcatgagacaccatgcccagcctgacgtgttctaattaaggctaacaccttcaccattgctcttaggcttcaaggatctagattagaccatgaaggccgggtgaagggagggagaagctaaaacactgctttcaaggaggacaatggaaataatatgaataacccaatatgcctcatttgtaaagtgtgttttttataactattttatgtcctaatcctcactacgtgatagcaattataaagaaaatggaatgtgtggcaccacttattctataagctaaagcttgaggttaaaaatagatattgaaataattgaacaaaataaaagtcatgtcagtaacctacagttcttttaactttgcattaagcagtagagttagaacattataatattcgggggggaaaagatgcattagatcagtgtgggtttttatttatttatttatttattttgagacaggatttcaatccggttgtccaggctgaagtgcagtggcgcaatctcagctcaccgcaacctcctcctcccagggtcaagcaatcctcccaccccaccctcctgagcagttgggagtacaggtgcatgtcaccacatcccgctaatttttgtatttttagtagagatggggtcttgctatgtttcccatgctggtcttgaactcctaggctgaagcaatgctcctgcctcagcctcccaaaatgctgggattgcaggtgtgagccaccacgcctggcccagtgtggatttttaaatagatttcagaagggaagggaaaagtcatgatgttaaagagtcttaaacaagacgtgtgttgtggtgcatgcctgtgatcccagctacttgggaggctgaggcaggagaattgcttgaacctgggaggcagaggttgcagtgagctgagatcgtgccactgcacccccgcctgggcgacagagccacaatccgtctcaaaatgaaaaacagagagaggtaacagaccagaaaggcatggtggctcacgcctgtaatcccaacactttggaaggccgagatgggcaggggcaggtcacttgagccgaggagttcaagaccagcctagtaaacatagtgagaccctgtctctacaaaaaaaaaaaaaaaaaaaaaaaaaaattagctgggcctgttagcacatgcctgtggccccagctacttgggaggctgaggtgggaggatcacttgagcctgggagattgaggctgcagtgagctgagatcatgtcactgcactccagcctgggtaacagagcaaggccctgtctttaaaatagccaaaaaaaaaaaaaaaaaaaaaaaaggaagattgttaaatataagaattaattttccgttgaagaagagttttgagtgtttctttttggtgagcagagttgagaagacatttgagtaatgatgtgacaagtgagatccgtatttagtatctacaggacttcaatctctgttttaccaaaaaagtcaccttaattgcttcgtatttatttttaggaataagcatgggcctttcctcctctttgtttcctttctacacgttcacatccctcttatcactatggagaacttcctcgggaagagtctccacgggctgtatggggacaacgtagaggagatggactggatggtaggtaagtgcacttccagggaaaatgggctgcttcccttccagcaatagaagcaggaaaggaaacaaagaatgagaaggttaaagacagaagatgcagaatagcgattgcagtgcgattggattttaagagtgcaaaatattatagcacagatcttcactgcattagcagagggtgaattccataacacatgcacgggaggcaatgcgattcggccaaagatgtccacatcttaatcccatgtggcagaaagctgtccactccctagacagaataatggctgcagagacatccacgtcctaatcttgatgtggtagacataaaaatggccccaaagatagccactttctaatccccatgtgggagacagaataatggccccaaagatgtccacatcctaatccccatgtgctagacagaataatgactccaaagatgtccacgtcttaatccccatgtgttagagagaataatgacctcagagatttccacgtctgaattcccaagtggcatacagaattttggccccaaagatgtctacgtcctattgccatgtggtagacaaacaaaagaaagagcagataaaattcctctccgctgtagagtggctagtggctccactgcactgaaaataggactaaatttcctcctatcacctacaaaagccccatgacctgctgctgcccagatcctagtctgacctctacccaacccccttgtcctccccacctgctgcattctggccacgtggacgccacacagtatctttcacatttgtcccctgtcagggcttccacacctgctgttccctcctggaatgcttcctcaggcttcactggctcctcttcagagcctgccctgacgcacccctaaagtagctcctccccaatcatcttctcccccattctcctgtggtccttttttgttttgcctttgttttcctcctcctcttcctcctttctcctcctccccctcttcttcttcttcttcttcttattcttcttcttcatattcctcctcctcctcctccttcttcttcctcttccacttcttcctcttcttcttctttcttctttctgtcttctttcttctttttttcctaacacagcatcaccattgcttctcttcgtgaccatgtgttaggtaggttgattttccatttcccccaggggaatataaactcctgtggggccggattgtcttgcctcattccctcattatatttcctgggtttagaacaggatggaaggggaatattgcttgagtgagtcagggctgggtgagcacctgtatatgggcacagcacatccctgcctcccaaaaaagaacttaggaaccgcagggtttaggtggtggtgggctgcgaatcccaggatcctcagaataattgccatcagagatttgggtgaacgacgtatttaaaaaaaaaaaattgtttcctcaacaagctaggcatggaaggagaaaaagttaattgtgtgtgtgtgtgtggcagggtctcactttttgttttgtttttttttttttgttttttttgttttttttttgagaccgagtctcactctgttgcccaggctggagtgcaatggcacggtctcagctcactgcaacctccgcctcccgggttcaagcaattctcctgcctcagcctccggagtagctgggtttacaggcacccgccaccatgcctggctaatttttgtacttttagtagagatggggtttcaccatgttggccaggctggtctcgaactgctgaccttgtgatccgcccgcctcagcctcccaaagtgctgggattacagggatgagccactgcgcctggccgacagggtctcactcttacccaggctggagtgcagtggtgcaaccgtggctcactgcaccctgccttcccaggctcaagcaatcctcccacctcagcctcccaagtacctgggaccacaggtgtgcactaccacacccggctaatttttttattatttgtagagacaagttcttgctgtgttgttcaggctggtctcaaactcataggctcaaagagcctcccacctcagcctctcaaattgctgagatttcaggcatgagccactgtgcccggccaactgtgagtgacattaatgacatgagttcccttgtgtgtggctgcaagaagctcagggtcacttttgaggactggtctgcattttcagtctatgctttcttctcaggaatattcacatgcctcacttttttttttttttttttttttttttttttgagaccgagtctcactctgtcacccaggctggagcgcagtggcgtgatctcagctcacagcaatctccacttcccgggtttaagctattctcctgcctcagcctcccaagtagctggtactacaagcatgtgccaccacgcccggctaatttttgtatttttagtagagatgtagtttcatcatgttggccaggctggtctacaactcctgaccccaaatgatcctcctgcctcggcctcctaaagtgctgggattacaagtgtgagccactgtgcccagcctgcatgctgcacttttaagtttttgatattttgtccttgtacgttgcctaaaattctgaccaaaggatggggtgcatataaagtcatacatcaatctccaacaaaggatatcaaaattatccaacagctgacttccattatgcgttaaaactaaggcttcattcttgtggctagcccccgaatgctaaagcatacacttcagagctgcatttctgatatttttccatttcgacggccccaaaaacatctgttctttgcaggacggatccttgacactttggacgtggagggtttgagcaacagcaccctcatttattttacgtcggatcacggcggttccctagagaatcaacttggaaacacccagtatggtggctggaatggaatttataaaggtaagactgagatgctcccagatcttcatcttgcaagtttatctcttccctgcaattcccagcagggcaatctattccaggagggtcaatattattgctcagggacagtgatttttcctatccagggcaaaagtggtaatttgacatactccagtttgaatttttgttcctggaccaaactgagggtcaggctgcttattctggtggttcaaaaatgagatgcagatgaactgggagaggagggagtttatttctgtaaccggttacagggaggtctggaaattgttgccagaccaactcaaaattacaaagttctccagagcttctatttctaagctgtatgtctgcgtgtaagtgtgcactcatctaaagacattagtgatgaacttcttctaatctgtaactaaggtctgagtcccggagaccctcctctggagactaagtaaattgacttaatctaaatgggtccaggtggccgggcacggtggttcatgcctgtaatcccagcactttgggaagccgaggtgcgtggatcacctgaagtcaggaatttgaggccaacctggccaacatggtgaaacctcgcctctactaaaaatacaaaaattagccgggcatggtggcacacgcctgtagtcccagctactcaggaggctgaggcagaagaatcgcttgaacctgggaggcggaggttgcagtgagctgagatcgcgccactgcactccagcctaagcaatagagagagtctccatctcaacaacaaaaataataaaataaataaataaacaaataaataaatgggtccaggtgccagggctgattacccttaccttgtctcctgctaaatcgcggaggtctggggagttgtttcagacctctaataaaacttgtttaatcctaaaagggtcctgctaagaattccttggttatcttgtcacgcttcaaggcccaggagaggcctgggcagaactcctggggggcttttgtgacatcccggcctttgtatacaggcgctggttgtttcagcttttgctatttaacttcaccactcgtcagtgctgaaacagttgttacggaggcctgtgttagtgagacgtggcctgccacgtttttgtgcacaattaaggaatttttagtagattatcagagttgtgtaaccatcatcatgtcgatgaaaagagctaaactctgtaaaacatttgaagaggtttattctgagccaaataggagtgaccatggcctgtgacacagccctcaggaggtcccgagaacgtgtgcccaagatggtcaaggcgcagcttggttttatacattttagggaggcatgagacagcaatcaaatacatttaagagacacattggtttggtccagaaaggtgggacaactcaaagccacggggcttccagcctacaggtagatttaaacatttcctggttgacaattcgttgtttctctaaagacctgggatcaacagaaaggaatgtctgggttaagataaaggattgtggaggccaggcacagtggctcacacttgtaatcccaacgctttgggaggccaaggcgggtggatcacttgaggttaggagttcgagaccagcctggccaacatggtgaaactctgtctctactaaaaatacaaaaattagctgggtgtggtggtgcgtgcctgtaatcccagctacttgggaggctgaggcaggagaatccgttgaacctgggaggcggaggttgcagtgagccaagactgtgccactgtactccagcctgggcgacaaagcgaaactccatctcaaaaaaaaaaaaaaaaaaaaaaaaagattgtggacacccaagttcttatttgcagaggaagccttcaggtactaggcttcagagacaagaggttgtaacatgcttcttatcagacctaaaggctgtgtggatgttaatgccagagaggaatcatgaggcatgttcgactcccgcttcctgtcacggcctgaaacagcctctcaggttaagtttttaaagagctctgggtgaggaggaagtccattcagatggttgggggtccttagaattttatttttgttttacaatcactattttcattcgtaaaatttattgttattatttttatttatttttattgagacagtctggctctatctcccaggctggagtacagtggtacgatcttggctcaccgcaacctttgcctcctgggctcaagtgatcctcctgtctcagcgatcataagtagctgggactacaggtgcatgcaaccactcctggctaatttttgtatttttgtagagatggggttttgccatgttgcccaggctggtctcaaactcctcacctcaagtgatcctcccacgttggcatcccaaggtgctgggatgacagcaggcatgagccaccacatgtggtccaccactgtttatttcagaacatttcatcacctcacaaaaaaatcctctactcatagcagtcactcccttttcccccgtgctaacatccatcacccaaaaacttatttttgatttgtttattatttaatttttaaaattatcttttgtaaagatagggtcttgttatgttgcccaggctggtctgaaactcctgaactcaagcagtcctcccagctgggcctcccaaagtgctgggattccaggcgtgagccaccatgcctggccacaaaattattttgtatcattgtatattttcctactctagacatttatgtaaatgaaatcatgcaatatgtggagtttttttgtttttacttagcatgatgcctctgaggttcatctgtgttgtggaaatgtttcattcctttccatggctgaatatattccattgtgtggactcaggtttgaattttaccttcagacaatgcatccaagaaggataaggccaggcgcagtggctctcacctgtaatcccagcactttgggagaccgaggcaggcagatcacttgaggtcaggagtttgagaccagcctggccaacatggtgaaacctcatctctactaaaaatacaaaaattagccaggcgtggtggtgcacgcctgtaatcccagctgaggaggctgaggcaggagaattgcttgaacctgggaggtgaaggttgcagtcagctgagattgtgccactgcactctcgcctgggtgacagagtaagactctgtctcaaaaaaaaaaaaaaaaaaaaaaaaggtagaagggtagacacctagctggccacattatattcaaacctgtattccattgtttccaaacacgccattctttcgtgtaccacaaagatgctaaaatgtgctgccccgtgtacatgacttcacactgttgtgcttacacattttgtcttctccctgcttagagagctttatttttcagtccttgaaagagcctttttaggctaatattggcaaatatacctatgatgtatatttgctttgaagtagatggatccatcagtctagtacatatgtaaaacgggatatataaatgccaactacatccactaatgccttcccacaacaacttcacattgaaggcctgactcctcagaaaccttctttatctcattgccattgacgttaatgtatcctctacccaatctggttctctgtgccatcaagaatgtcagtattataaactggcggagctttaaacaacaggaatttatcctgtcccagccctggagaccaggagtttgagatcaacgtgtctcagggaaatgttcccgccagaagctctaggggaggctcctccctgcctctgccaactcctgggggccccaggtgtccctgagcttgtggccacatcactccagtctctgcctccgtctctatgtggccttctcctctgtgtctgtgtctcctcttctgtctcttagaatgctgtcattggacttagagtccatccttctccgcgacgatcttgagatacttaattgcatctacaaggacccctttttaaaataaggtcccattcacagaatctggggatcagggtgtggatatatgtttcaggaggactaaagtgcaatccattgcaattgaatccacttctttctggatgctctaggggaggctccttcctgcctctcccagttaccgggggctccaggcatccctgggcttgtggccgcatcactccagtctctgcctctgtctccacgtgaccttcttctctgtgtccgtgtctcctcttctgtctcttagaaggacatctgtcattgcatttagggccaccctaatccaggattatctcaaggtccttaacttgattatatctgcaaaccccctatttccaaataaagtctcatttataggctctgggagatatgacatgaacatgttttggggtcactgttcaatacgttatagttgtatccactttcttcttgaggctctaggggaggatccttcctgctgctcccagcgcctgggggttccaggagtccctgggcttgtggccacatcactccagtctttgcctccgtctccacatggccttctcctctgtgtctgtgtcttctaagaacaagagtcatttgtagtgaaggacctaacttaatccaatgcacactaaccaataacaaggttaataaaaaatataaaatcaaacctctacaggggaactacatgagattgaatgttttaatgtcactaaaacagagagagagagagagagaaattgagagactcagggagagagaaacttcaaacaagtgaaacaagcagaaaagttaaatcagccaggctgagcatctatttctggtttttaaccactttcttttgtttctgttcaaacccaggtgggaagggcatgggaggatgggaaggtgggatccgcgtgcccgggatcttccgctggcccggggtgctcccggccggccgagtgattggcgagcccacgagtctgatggacgtgttccccaccgtggtccggctggcgggcggcgaggtgccccaggacaggtacagaacaacccaaagaaacaattcagctttgcacagacacagcaacacttatggcaaatgaacatgtcactttggctttgcagtaaggcgtccctgaaattgttccccgaccaaaccgagggtcgggctgcttattctcatggcccaataacgagatgcaaatgaacgaggaaagaaaggagttttatttctgtaaccagatacggggagaaggctggaaatgatcactagaccaactcaaaattacaaagttttccagagcttctataccttctaagctgtatgtccacatgtaagcgtgcatccatctaaagacataagtgattcaacttcctttcatctagaactaaggtctgagtcctgaggaccttcctctggagcctcagtaagttgacttaatctagatggttccaggtgctggggtgattacccttatcttgtctcctgctaaatcatggaggtttggggagttcttttagaccccccaataaaacttgtttgtggaggtctggggagttccttcagatccccaataaaacttgtttaatcctaaatgggtcctgttaagaatcccttcattattttatcgcgcttcaaggtccaggaaaggcctgggtagaactcttagtgggcttttgttacattccagcctttgggtgctggctctttcagcttttttttcttctttttttttttttgagactgagtctcactcagttgcccaggctggagtgcagtggtgcgatctaggctcactgcaacctccgcctcctgggttcaagcgatcctcctgcctcagcctcccgagtagctgggattacaggcacacaccagcacacctggctaatttttgtgtttttagttgagacggggtttcaccatgttggccaggctgatcccgaattcctgacctcaggtgatccacccgcctcgacctcccaaagtgctgggattacacgcacgagccactgtgcctggccaattaattactttttagccaaaggtgacgtttggtggtgactaacgtgggcagctgctgcattcttcttctaagcgtgctaatgcacacacatgccttccatccatctgcgttcacacccagactttccctccactgatacaacataaggagagtgcaccacctggggctgggactggtggatgctggagggacaaatgtccagagtccctgttccaaccctgagccatgccatgttccttcctgcagagtgattgacggccaagaccttctgcccttgctcctggggacagcccaacactcagaccacgagttcctgatgcattattgtgagaggtttctgcacgcagccaggtggcatcaacgggacagtgagtaggggagccccttcctaacacccttagggaaagagtccctctgtgcaggaaagcaccatgccctagaacaggctagggatggagctgcattccagagtccatctccatgtctccgcacttccgtttttctccacgagctttttaaatttagtttttgtcaatatgtgtccctctcattccagcgacatgccttctgagatcacctgccaatcgtcttaaaacgatggggagtcgttacctatagtttcagcaccatgtatgggctatatttcattctttcttccctgcactatatgaagtgcaacttttatcatcatcacacacacgtatgtgcatgcatacacacacgcacgcacacatgcttgcacacacatgtgttcaagacttttctagtctcttttttttcttatttttttgtaattatttttttgagactagtctttgtcgctcaggctggagtgcaactgcagtctcccgggttcaagtgattctcctgcctcagcctcctgagtagctgggattacaggtgcccaccactacacctggctaatttcttgtatttttagtagagatggggtttcaccatgttgggcaagctgttcttgaacccctggcctcaagtgatccaccctcctcggcctcccaaagtgctgggatgacaggcatgagccaccacgcctggtctccaatttttctttattaagttgaaacaaggtctcagtatgttgcccaggcaactcctgggctcaagcaatccacccatcttggcctcccaaaatgctgaaattgcaggtgtgagccaccacgcccagccttttgtagtctattttatgcatctagatgtgcttccaaatgttttaatcacctgaccttaacacgacttcatcttctttgtgaacaattacaggcgcactcctgtaatcccagctacttgtgaggctgaggcaggagaatcacttgaacccaggaggcggaggttgcaccactgcactctagcctgggcgacagagcaagactctgtctcaaataaaaaaaaaaaaaaagaaaagaaaagaaaagaaaagaaaaaactgactgagtgcaattcacaggcacttcgtgctttcacagtgttgtgcaacctccacgtctatgtagctccagaacattttcatcacgccaaaagcagacactgttcctatcagcagtcactctccatttcacaccctgcagaccctggaaaccactactctacttcctgtcattatgtgtttccctatccttgacattcaatgtgaatggaatcatgcaatgtgtgctcttttgtaacttctttctctgagcgtagtattttgaaagttcgttgatgttgcagcctgtgtcattgtgtcattccttctcatagctgcagagtatgccatgtaagatgtaccatgttttgtttatctgtccatccatcgatggacgcttgggttaggcctaccttttagccctatgaagatgccattctccagcaaggcaccctatttctctatgccaactctgtaatgattatctttccaccaggaggaacaatgtggaaagtccactttgtgacgcctgtgttccagccagagggagccggtgcctgctatggaagaaaggtctgcccgtgctttggggaaaaagtagtccaccacgatccacctttgctctttgacctctcaagagacccttctgagacccacatcctcacaccagcctcagagcccgtgttctatcaggtgatggaacgagtccagcaggcggtgtgggaacaccagcggacactcagcccagttcctctgcagctggacaggctgggcaacatctggagaccgtggctgcagccctgctgtggcccgttccccctctgctggtgccttagggaagatgacccacaataaatgtctgcagtgaaaagctg

SEQ ID NO: 2938 - DNA, 33587 bp, human
agtgcgtgtctgttttggcaggaagaagacgtttcttccaaggagcagcctccccgctacatccagccagtgtcgcccttacacagctgcatgtcaggtaactggccttcctggggcttcttcttacaggccggcttttgcacgtgcagagacgctccaggggatattcttttatgctaaactgcgtcttttcaaacaagtccctgtcaatgttttaaaagtaatttgctttcaaaaaataataataatcatcagtgaaaatctcaagtacagattttacatgggagatttccaaacgtaatgcgtaaaaaaaaagcaacgagggaagatgcaccaaatgggagacattgcatccacactagattcttatcttagagatgctgaaggcacgtgcactgaacatcgaagagacaccggaggtgaaaagcgaaactgggtttgggaacagggcccaggcgaagcgttgaacacaggctcgcagcccggggctgaagctcagggcgggaaaggagggctgggattccttctccccggaagagaatcaaaggctatattgtcagtcttgcatgggtgtttcctcgtctgcttcttttatctttatttctattgcattgtattatattttactgtattctatattttattattttgttttattttaaattcagacaggatcttgccgtgttgtccaggctggtctcaaactcctggcctcaagtgatcttcccatctcggcctcccaaaggccagagtgtgccagctgggattacaagtgtgagccaccgcgcccagcctcttgtctctttctaaagataccttgtgtctttagaataaaaaagtagaaagttttattcagtagtaaaaattaaatctggaccaaaatgtttaacattccaagggttaaagtgcagagttctttggaaaagaaaaatctgcttttattgtgtcactaaatacataaatacatcagttcagaggtaggccacagacttgatatctaaccgtacgtcatatgactgttcaaacatgtttgagggtcctatatttagacaccaatataaccagcccgataaaacaaacacaaccagtcatgttccccaggcaagtcagaagcagcccataatatgctttttccttgaaaaatcatgtacatatatatgttatatgcatatatgtacttgttttatatgtatatatgtactatacatacacacataaacatttttactttaaaaagtacatatattaacgttacatgtatatacgtacatgttttataggtatatatgttatgtatacatatatgtatgtatatatacatgcatgtacatgtatacattatatacatataagcatacatatatgaacacataaacatgtatgtagatgtctataggtacatgtttatatgttatatgtttatatttatacgtgcatattataacatgtatttatatgtagatgtgtacgtatatgtacatgttttatgtatctatacatatatgtacatatatattttaaagtatatattatttttgtaaagaaaagcatgcatattttaataaagaaaaattatgctttattatatatttatatattatatttatatattttattgttttgttttttttttctagagataggctctcactttgttgctcagacttaacttgaactcctgggctcaagcaatcctcccacctcggcctccctaagtgctgggattataggcgtgagccaccacacccagccttatttacatattttatgtgatacatttatactatgtatgatgtacaaaagttatactatattatatataataattatgaatatataaattaaaatataggtgaaaatattcctttaggccccctacgaggaaatgacttaagatttgttgccaaaaatcacaaagtgaaagcaattaccattagggcacacacctgtggcaggaaaagaaaacatttctgacacccctcctaatactcgttttgagacatgccaccaaaaccgtccacttgtaaaaatgagtcaggctggagtgtgccagcgtgtcagctcctcatcccagaagtagggtggtttccacccccacataaggaggaagtgagatcaggtaggctatgtgacttctcacagacccagcatgtggctgcatatgaagttgcgaagagacagcaggtggaactctatgaaaccccgtccttgtaggtcaaggatggttgaataatagggaccattgcgtagggttccattctacagagtaacttcccagcaatgatcatgcagtgcctcagaaactgcttcctgccctcttggtcttgtcttgtcttttcttttttgagacggagtctcactctgccgcccaggctggagtgcagcggcacagtctcggctcactgcaagctccgtctcccgggttcaagcgattctcctatctcagcctcccaagtagctgggattacaggtgcacgccaccacatccagctaatttttgtatttttagtacagacggggttttgccatgttggccaggctagtctcaaacacctgacctcaggtgatcagcccacctcagcctcccaaagcgctgggattacaggcgtgagccaccgtgcccagcccgtcttttctatgtttttaaaccaagcattgcttgaaaataatcctttttttacttttttttttgcttattttttttctttttatcttatgtttattattattattactataatttttgagacagagtctctctccgttgctgaggctggagtacaatgctgcgatcttgcctcactgtaacctccgactccggggttcaagcaattttcttgcctcagcctcccgagtagctgggattacaggcatgtgacaccatgcctggctaatttttctatttttagcagagacagggtttcaccatgttggccaggctagtctcgagctcttgggttcaagtgatcggcccacctcgtcctcccaaagtgctggaattacaggcatgagccactgcgcctggcctttttacttcttttgtttgtttgtttatttactttaagaaatgttttcttttttatttttatcttatctttattatttcttatttacttcatttaccactcaacaaataacttctttaaaacatttttttttgaggcagggtcttgctctgtcactcaggctggagtgaaactgcagcttcaacctcccaggctcaaacaatctttccacctcagcctcctgagtagctggcagtagagacacatgccaccatgcctggctaattgttttattatttatagagacagggtcttgctatgatgcccgggctggtctcgaagtcctgggctcaagcgatcttcctgcctcaacctccccaagtgctaggattatgggcataagccacactgcccagcctaatattttttatttttgaagagacagcatctcactttgctgcccaggctgctctgaaactcctggcctcaagcaatcttcctgcctcgtcctcccaaagcgctgggattacaggcatgagccaccatgccaggttggatatgatcatattatagccagcaccctgtgtaacagcacaggcaatcacttaaaaacctaaggacactggcagaatacggtgactcacatctgtaatcccagcacttcgggaggccaaggagggcagatcactggagctcaggactttgagaccagcctaggccacatggcaaaaccccgtctctacaaaaaataaaacaaaataaaaacctaaggaaactgaccactggtttggtagacgtgggcgtggctttgagattcccccatgctgcgatgtggggggagtctgctctgtctgtcctaactctctctgatcttctgacttgggaaaaacaaactcgaagttaatcattcccagctcaaagccttgtgcaagtgctctctgccttcacgcttgcttcctttgggagagaaccttcctcttcttgatcggggattcaggaaggagcccaggagcagaggtgagtcctgtgaatgttcatttgtgctggatttgggctccgtgaccaggcatgaatagcgtggtgaacaaagagctccccgttcccttttctgtctctgaataattgcccagtttgttttgataaagcagaaacgtacccgtgacttacaggcctaggaatgcagctctttcctggagaagggggatctgttttctaatctgcaggagaggccttgggcaggccccatgctctgggtcacctcaatgtcacagtttccaaaattaaactcattcaaggctgttatcaccatctctttatttatttaacgtttttctccaagaaaaaatattcatatttttacttataaatacataacattgcgggagaaagaaaaattaggtcgggcacggtggctcacgtctgtaatcccagcactttgggaggtcgaggcgggtggattgcttgagcccaggagtttgagaccagcctgagcaaaagaggaaaccccacctctacttaaaaaaaaaaaaatcaatagccaggcatagtggcatgtgcctgtagtttcagctacttgggaggctgaggtaggaggatcgcttgagcccaagaatttgaggctgcagtgaactatggtcgcaccattgctctccagcctgggtgaaacagccagaccctatctcaaaaaaaaaaaaaaaaaaaaaaaaaggaaaagaaaagaaaaattagaaaaagagcacttttcctaaatctccacacccagagataaaccactgctgggcaggattgctgcaaaaaccatcttcccctagtttgtggtggtttggggttttctcattacatttgtacagtattttgcttttattccgttttctgaccattggcagcatgtcattgtaggtcagaaagcaatgctgagggtattaaaatgctcattttggttttctctccatgtacaattttaaatcaatctctttcccggtgaagatgctattaggttggtgaaacgtaattgcgtcttttgctattacttttagaatatgagaattgtgtgtgctctctagggtaaaacaaacgaacaaataaacaaaaaaacctcacgagcacggcgtacaccttatcccttccttctgtgttctaaacaaagcacaaatgatatctaaggtctttttctcttcgacagacagaaaattattggagatgtagcaattcagtgttagacatccatcaataatgtaagaagtgcattgattcggtctggaaaggccggaaaacttgaagcaaaggcaggaagactgtaagcagggagggggcttccaggtcacagataggtgagagaggaacagttgccttcttttgagtttctgatgagcctttccaaaggaggcaatcagatacgcatctatctcagtgagcaaaggggggactttgactagaatgggaggcagaggccctaagcagttccccgcttgacttttccctttagcttattgacttgcgggccttgagatttattttcctttcacaaagctcattgtctttctcagaagactggttttgtgcctgaatcctgctaggagcaaacacccctcccagcatccccgaaaaggcgttgaggggaaatccctcaaccaatcgcttctctcccactcacaccctggggtttcgcagccctgcggaccttgcccacccctcctctctgccctccccgctcccacaccagctgtgtctatccttggtcaggtttcacctggacagacaccacggccacttctaggctctcagtgcctgctggctccagtgtgtcctcactcactggccgctcggcccttctaaaagtggccaggtcactcccctggttactcagaggcagaaacccaacacatctgcatgctcctgtctctttatcttctatgcatgcccatgtcctgtcaacgaaaagaagcgaactctgtagaatatttgaagagatttattctgagccaaataagagtgaccatggcccatgacacagccctcaggaggacccaagaacgtgtgcccaaggtggtcagggtgcagcttgttttatacattttagggaggcatgaggtgtcaatcaaatacatttaagatacacattggtttggtccagaaaggtggaacaactcaaagtcagggggcttccagcttatacatagatttaaacatttcctggttgacaattggttgagttcatctaaagacctgggatcctaggaggctgaggcaggagaatcacttgaacccgggaggcggagcttgcagtgagccaagatcgcgccattgcactccagcctgggcaacagagcaagactccgtctcaaaaaaataaaaaagaaagattaaaaaaaaaaaaaaaaaaccctgggatccctagaaaagaaatcttcaggttaagagaaaagattgtggagaccaaggttattttgaagtcttgtagcggctgcccttagagacaatagatgacaattgtttcctattcagacttttaaaaggtgctagagtcttagtcaatcttttcaggattggaagggtccggtagaaaaagatgtgaatatctatgtgaatagagattctttacatctttacagatgcaaatttttccccacaaaggacagctttgcagggccatttcaagatatggcaaagaaacatgtttttgggtaaaatattttgattttcttattggtctcatgttatgccagagtcagattggaaagtaagtcacaatatatagttaaatgaaacccttctgatgagaatttttggtttgtagggcatgactctccagaccccttagataggaatttgggcaagataaaaagaaaaatcagagcttcgtcctcagtcccatgcacaagccacatggggtcagaccactgcagtaccctgaaggtgacctcttgctgcctgcaactctaattgttatcttccatctcattcctttcctgctctacaccctgggctctccctcacttctcggcgagactgaggggccgcccctctgtgctttgggggtcgcccgtttccctctgtggacagaacatttccaagtgtgggcaatggtcgccccctctcccggcagcacctacccctagcaatgaaggcgaatgcgtctctccttcatgcagcactcagtgcctgcagagtcctctaggcctttttccttcacactgacactcccagttctgttttcaagtctggacctcctgggctcaagcaaatcctcccacttccgcctcccaaagtgctgggattccaggcatgagccaccacgcgcagcctctcattgtatttctgatcttcataccctctactcagattcttttgtgtatcatccaagctttgatctttccccgcttcccccttccaaatcaggactctctctctgcatttctggacattaggaatcacccctgccctgggctcgggaagcagaagacaaaataatctgcttccggacactgggattctctcatcactttgtgatcactcatgggctatgaaagctgataaaggggatggagaccctatgaccactttcttcctctttctctgaagaccatctggctgtgtattgaaacacgttttacattcttaacatagtattaaacatttttgaagccttttcactcgggaagagcattcctttatagattttgatcattgttttaagatatttttgctattgatatcatgaacgggaatcaaagttcccctaattacttacttactgttttatttataatcaggtcaatttctgctgtcaatgtgattgtggacatctttatgtcttacaggaagtagagagagagacaacatgttacatctgcaccattcttggtaagatacaattatatgcactcattagtagtctcctttctttctttctttctttctcttccttccttcccttctttctcttcttttttttttttttttttttttttttgagacggagtctcactctgtcgcccaggctggagtgcagtggcgcgatctcggctcactgcaagctccgcctcccgggttcacaccattctcctgcctcagcctcccgagtagctgggactacaggcgcctgccaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggcctcttttctttctttctttctctttctttctttctttctttctttctctctctctttcttccttccttcccttctttattttttttcctttcttatatagagacagggtctcaccatgttgctcaagctggtcttaaacacctgggctcaggcaatgctcccaccttggcctcccaacgtgctcagataatgggcatgagccaccacgcctgaccgcttctggatctcttgatggtgctttctcagaatgcactgatagtgatttatcctgcatctggagaatgaagcatgagacccgtgattaatagatgtgctccaggctcccttgatttgatgttgccccaggcagcctcagaaggaattgtatttcattctctgcaaatcaggtgggcatcaaccgctaccatcggccaggtgtctggttttccagggaaaatcagggtttcccctactacaaaccttggagactcagattacatctttactgcatcccactggggattgggacactatggccctgctgtccatgtgcattcccagggtggcatcgatgaaagaggcagcaatgatagtggcaggctgtatgtcaccaacccctgcggaaatgttccctcatggtacgcaactaccagggctttctcctccaggctggaacctccttcacctccaaacccacttctcatcagataccagtgggctaaagaagtcagtcctgggtattttcatctgtgtgctacaatgaacagagggttttcatagactcagaagtagcagctcactgtgttctcaccttgccccaagcttgtgtctcttccttgctctgctgggtggtccaaaccctaaccccagcctccattccctatgttcaacacagtttgcttaaggaagaacaatgaagaagagggaatggagaaggggcaatagctgttctggggacccgatccatccaagaaaccatgactaaggcaggctttctggctgtttttgctttttcttgttgctgttgtagttttgagacagccttgctctgttgccctgcagtggtgcgatctcagctcgctgcagcctcaacctcccaggctcaagcgatcctcccacctcagccttcccaggagttgggactacaggcacgtgccaccacgcccagctaagctgtgtatttcttgtagagatgagttttcaccatgttgcgcaggctggtcttgaactcctgtggtaaagcaatccacccgctgcagcctcacaaaatactgagattacaggagagagccactgcaccccaccaaggctttctgttaatcatgagtttaatcacttaacaacagactttacagcatcaaaaaaaacccaaaaaacttcaaggccaaataaagccatcaacggtatcagttaattgtaaccagagaaaaacaatcaaatgcctaagagatgtcctcaaagctattctgaaatgtgatgataatatcaatacctcttaaaatagtgatgccaacttcccccatacacaagttctgcaaatgagatggacaggagcatgacgcagtctctgacagtttgtgtttcaggagctggctgccagcgatgctcgctgtactgctaagtttggcaccatcagcttccagcgacatttccgcctcccgaccgaacatccttcttctgatggcggacgaccttggcattggggacattggctgctatggcaacaacaccatgaggcaagggacagagaattactcacctggtgcccccaatgcagacaccagaagaaagagaagccactgaaaatgcatataacccttgatcttggcagttcacacttcaagagttctgcacttctgcgttttctaactctccctaatgttactttcttcccatgccagcactaacctcacctcaatccatcctacatatgactgctcatttcatttttatttttatttatttatttttattttttatttttctctgagacaaagtcttgctctgtggtccaggctggactgcactggtacaatcacagctcactgcagccttgacctcccaggttcaagtgatcctcctgcctcagcctcccgagtaattctgggactgcaggtgcccaccatcatgcttgggtaatttgtaagtttcttgtagaggtggggttttgccgtgttgcccagcctcgtctcgaacttctgggctcaagtgatccacacacctcagcctcccaaagtgctggtattgcagatgtaaaccaccatacctggcctcatttcttttctttttttttttttttttgagacagaatctcactgtgttgcccaggctggagtgcagtggtgcgatctcggctcactgcaacctccgcctctgcgattccagtgattctcctgccttactctccagagtagctgggattacaggcgcccgccaccatgcctggataatttttctatttttagtagagacagggttttgccatattggccaggctggtctcgaactcctggcctcaagtgattcacccgcttcagcctcccaaagtgctgggactacaggtgtgagccactgtgcctggcctcatttcattttttaaatatgatttttatccacccagtacataatggacaatgctttagaaatgctatcagccgggcatgactgtaataccagccctttgggaggctgaggcaggaggatcacttaaggccaggagttcaagaccagcctgggaaacatagtgaaatcctgtctctagaaaatataaacattaattttttttttttgagacggagtctcgctctgtcacccaggctggagtgcagtggcatgatcttggctcactgccagctccgtctcccgggtccacgccattctcctgcctcagcctcccaagtagcttggactacaggcgcccaccaccacaccccgctaattttttgtatttttaatagagacggggtttcatcatgttagccaggatggtctcaatctcctgacctcgtgatctgcctgcctcagcctcccaaagtgctgagattacaggcgtgagccaccacgcctggcacattaatttttaaattaaaaaaaaaattagccaggcatgatggcatgcacctgtaatcctagttattcaagagggtgaggtgtgggaggatcacttgagcccaggagtttaaggttgcagtgagctgtgatcagaccactgcactctgggcgacagagaccctgtttcaaaaagtaggctggccgtggtggctcacgcctgtaatcccagcactttgggaggccaaggcaggctgatcacttggaggtcaggagttcgagaccagcctggccaacatggtgaaacccccgtctctactaaaaatacaaaaattagctgggcatggtggcgggcacctgtaatcccagctacttgggaggctgaggcaggagaatcacttgaacccgggagggggaggttgtagtgagactcaaatagtgccactgcactccagcctgggtgacagagtgagactcagtctcaaaatacaaacaaataaacaaacatacaggagaaatcagtgtcgttgcctgtaagcagaagaccaatattgatctctgtctcactcccaaccctatccatctagccaagcccagcacttatgcgggatttcaatcctcccctgctgaaaagctctgcttcagacagacaagtccacaccctcctaatgccaaaatatggcgtgtccatctgtcaagagctagagctagtccgtcctcctgtccgaattccagccttccaccctcatgtagtacttacagtgtgttggcgtccatgaagtcaaaccttcccatgaacactgtgagctccagagaaggtgccctgggctctcagttctgcattccctctgaggtcggtctctcagtaccaacagtgccttgtggaaacttagtcactctatctactcattcatttatttattttagagacaggttgtctctctgtcacccaggttgaagtgcagtgttgcaatcacagctcactgcagcttcaaactcctgagctcaagcaatcctccttcctcagtctcccaagtagctggttctacagacatgcaccaccaatcctggctaatttttctatttttgtagatttttttgtagagacagggtctcgccatgttggcccggctggtcttgaactcctggccctaaacgatcctcccgctgtggctttccaaagtgctgggattacaggcatgagccaccgcgtccagccactcattcctatttaaatgagttgatgtttcctcgaaagttcagaagacattagaaatctttgacattacctttgggtcattcctgagaacatcttgaagcactcagcgatgaccagcagaccttctatgaagtagcatgtagctatgcttatgaaaagcctgtctaattttaacaagtaaagctgttaatttgtccctccataggactccgaatattgaccgccttgcagaggacggcgtgaagctgacccaacacatctctgccgcatctttgtgcaccccaagcagagccgccttcctcacgggcagataccctgtgcgatcaggtcagtctctctttacaactgcactagggtgcagcctggtgtattcgtcacagtttctagttcttacattttggtttttttattttttatttaaatagagactggggggtgttctctctatcttgcccatgctggtcttgaaatgctgggctcaaaagatccccgctccttgacctcccagagtgctgggattacaggcatgagccaccgtgcccaggcagcttttatattctgatgctttgacatcttagggctttgctgaccttggcaggactggccctcccagggctagccaattcttagagatagcaaacaagtcacctgggagtgcacctttcatgcataaaccaaacagtccagagcccacacccccaaccatcacttttatgagattttcatatatggggctactctctccttgccctaatccccccagaatcaggtaccagctttctagggacagcccctgcagatgaaagcccacggaaattgtacaacctggccagtcttaagccggcttaccctaccttgcccattactttccaaaaaagaaaaacaataaataagaaaggctttttccatgctttcccctcactccctctgcctcctgaccaaccctggagcttccccatatagtcacacagcatggctcacccctgcgtcctcttgaactgtgagtaataaactatcagaaactgtgagtaataaactatctctccaatgacagtcatctcctgatctgttggccttgccatagctgaatgataaaaccttaataataataatacataacacctacattttaaagcacttgggtagaggctgggcacggtggctcatgcctataatcccagcactttgagaggctgaggcaggcagatcacctgaggtcaggagttcaagaccagcctgaccaacatggggaaactccgtctctactgaaaatacaaaaattagctgggcgtgatgatgagtgcctgtaatcccagctacttggaaggctgaggcagtataattgcttgaacccgggaggcggagattgcagtgagccgagatggcgccactgcactccagcctgggtgacagagcaagactctgtcccaaaacaaacaaacaaacaaaaaaacccttgggtagagatttggaatgtctggagagcagaataaaattttatcagtggctaccaaccttgtcagtacgttagaatcatccagaggatattcccaccatcccaaagcccaagttccacccaagaccaatgaaaattagcacccctggggtgataaccaggcgtcagaatattttgaagctccccacacgattccaatgggcagacaactttgagaacctttagattatatcaagagtttgatgaaattataaaatcatttttagttcaggcacaatggctcatgtttctaatcccaacactttaggaggctgaggtgggaggatttacttgagtctaggagttcaagaccagcctgggcaacatagtgagaccccgtctctgccaaaaaattaaaaatattagctaggcatggtgatgagcccctatagtcccagctacttgagagactgaagtgggaggatcagttgagcccaggagttcaaggctgcagtgatctatagtcatgccactgcactcaagcctgggtgacagagtgagaccctgtctctgcaaaaaatttaaaaattagccaggtgtggtggtgcacacctgtagtcccagctactcaggtagctgaggtgggaggatcgtttgagcccaggtggttgagactgcagtggacattgattacaccactgcattccagcctggacgacagaacaagaccccatctttaaataaattaattaacaaacaaaaaaccatttaaatttttagtcctttttcactgaattatattgcttataacctgcacataacaggaaagtccatcttctcgctaaggttttcaataaattaatcatttactttgctgccaaaaatgcaatccactaggcaaagtcatataggaagtccattttcaatttaattttaagtaagagagatttttaccaagtgttctatttttgaataaataataaataacaaacaggaaaaaaaatgtggaacagtaattctttctcttaataattgctcaaagggatggtttccagcattggttaccgtgttcttcagtggaccggagcatctggaggtcttccaacaaatgagacaacttttgcaaaaatactgaaagagaaaggctatgccactggactcattggtatgtacgtttttaaaagtggtaagcacatgacttttatatggaagggacattcagctaaagagtttggaaaggaaagtgggtgaggtgctgtgggatttcccactagacagaaagctgcatgtatctaggaaccatgttcctttccaggttgttttctgcaaagtagatactcaagaaataccagctcaggcaaggtggctcatgcctataatcccagtactttgagaggccgaggcggaaggattgcttgagcccagaagtttgaaacccgcctgggcaacatagcaagaccccacgtctacaaaaaaatacataaaaataaattaaaaaataaataaaatgtgctcatgcctatggcatatgttccaagctccattgcacaacacataattgcttctttgttctgtgggatcctctcccacccttcacatggactttttgtcttagacatgaatgtcttagactgaacaccttcagctcttttctggttggtttatggatcaacttggctagtttagtgctgccatctaaatgtttgtgtccccctaaaattcctatgttgaaacccttaccccccaggtgatggtggcaggaggtgaagcctttgggaagtgatgaggtcgtgaaggtggagcctcatgtgtgggattagtgcccttacaaaagtgactctggtcaggcgcggtggctcatgcctgtaatcccagcactttgggaggccaaggtgggtggatcgcttgaggccaggactttgagaccagcctgggcagcatggcgaaaccctgtctctacgaaaaagaaaaagaaagaaagaaaaggaacatcaacttaatgaaatatttggcatctcaaacaatgttctcgtaggccatgataaaaaaaaataagaaaaaatatattcttgcatcaaaaatttctgtaatgctacctatttttccccttggtgtgtatgaaaatgtctttactagatttagtacctccctgtcagcttccataactaacatggttatttttctacaagtcaacaaacatgtcatgtattggatgaaaaataaaattaatgacaacagttccttgagaggagaccaagttgccattatcattattgtgttatagtaatgattgttatcaacagttccatttattgataacaaacaacatgactagtggatacaatgagtataaaattcaataaactatatttctaaaaattaaaaattataaaatgttctttgtttaattttttaccaaaaaaaaaaaaaaaacaaattctggggagattcagtcatcgctgtcaaacaaaggtgtattttttccaatagactttttttttttttttaaacagggtactcactctgttactcaggctagagggcaatggtgcagtcacagctcactgcagtctcgacctcccagactcaagtgatcctcccaccttagtctcccaagcagttggtactacaggcttgcaccaccatgcccggttaattttttcttttttttctttttttttttttttttttttgtagagatggggtcttcccatgctacccaggctggtctccagcaatcctgggcacaaggaatcctctcacctcggcctcccaaagtgctgggattatagttgtgaaccaccatgcctggccaactataatttttctaagacagaagagtctatccttaagggatatccattgggaaatcatgaggttttccagatggcagacagcattggggtggttgacatctctttgtcaacaccatagtagtggctacatggaagcaaagactatattcctttgactgaatttgaaaggtgtgccttgcaaaacccaccacccacttcaaccatggccactatgatagtggtttctcaaagagagaacaattccaaagtccagaagtcttttgcccatgctgctgatatcacatggtgctttccggccttcatcattgcactgcaaaacaaggtgcaatagactaaataatggtcccagagatgtcaggccctaacctctgaatctagcaaatattagcttatatgcaaaaagagtctttgtaaatgtgattaagtgaacaatcttgaggtgagaagatgatcctgaattatccagctgggcccactgtgcaaggacaaggcttcgtttaacatggaggtagaggaagattgggccacagagaggagaaagcagtgtgattaaagtgaggcgaccacaagccaagggatagctggagccaccaggagctgggagaggcaggaaggatcctcccctagagcctctggagagagtatgtgtgtgtctgtgtcctactatcctcttcttataggacacaagttctatcagattaaggcctgtattagtctgttctcacgctgctaataaagacatacccaagactgggtaatttataaagaaaagaggtttaatggacttccagtttcacatggctggggaggcctcacaatcatggtggaaggcaaaggagaagcaaaggcatgtctttcatggcggcaggcaagagggcatgtgcaggggaactcccatttataaaaccatcagatcttgtgagactcattcactaccatgagaacagtgtaggggaaaccacctccatgattcaattatctccacctggctccactcttgacacatagggattattacaattcaaggtgagatttgcatgaggacacagccaaaccatatcagtgcccaaactaatgacctcattttacattaattatcctttgaacaccctgtctccaaacacagtcacattctgaggtcctgggtgttagggcttcaactcatgaatttgaggcaggccaggatccagctcacaatagagtcattgcagatataatcaagtaaagatgaggtctctacagtgggccctactgcgatgactgctgtccttatgagacaagagattaggtcgcagacacacacagaggacaacgccatggaaacatggagatggagactggagtgatgcggccacaagcccagggaggcctggagccctcaggagctgggagaggcaggaaggatcctcccctagagcctccaatttgagtgtggcctggagacactttgatctcagactcctggtctctaggactgggagaggatagatttctgttgtattaagtgaacagttttacagtaatttgttccacctgtcacgggtaactaatattttggttaaagctgacacatggggtcctcattcccctgaaacgatgaggccagattgtggtgcaaataacagctaatgctgcccacacttctttgcaatctcctggccccccagtgtctaacagagtatcaggaatgtgacaaacagtcaatatcgacatgtccagttatgctcagatgcttgtcacatcaacatcctttttgcctctcaggaaaatggcatctgggtctcaactgtgagtcagccagtgatcattgccaccaccctctccatcatggctttgaccatttctacggaatgcctttctccttgatgggtgattgcgcccgctgggaactctcagagaagcgtgtcaacctggaacaaaaactcaacttcctcttccaagtcctggccttggttgccctcacactggtagcagggaagctcacacacctgatacccgtctcgtggatgccggtcatctggtcagccctttcggccgtcctcctcctcgcaagctcctattttgtgggtgctctgattgtccatgccgattgctttctgatgagaaaccacaccatcacggagcagcccatgtgcttccaaagaacgacaccccttattctgcaggaggttgcgtcctttctcaaaaggtcagcagaaaagggtcagcttcctccaagcactcagctttggaatgaaaacgcatcctaaatagtcttcttcagtcaggcatggtggctcattcctgtaatcccagtgcttttggaggctgaggtgggaggatcgcctgaggtcaggagttcgagaccagcctggccaacatggtgaaaccccgtctctactaaaaatacaaaaattagcccaatgtggggctttacaggtgcatgcctgtaatcccagctactcgggaggctgaggtgggagaatcccttgaacctgggaggtggaggttgcagggaggtgaggtcacatcactgcactccagcctgggtgacacagggagaacctgtctcaaaaaaaaaaagtcgttttctttaattgacgtttgaagaatgggatagccatgacctagaaggacaattttttggtaagaatggggcatagatgagggtcagtggagccctgtgacttgccttgtgtccattaaaacattgttacagctgagctgggcatagtggtacacacctgttatcccagctactcgggagactgaggcaagaggataatttgaggccaggagttagagaccagcctggacaacacagcaagaccccatttccacaaaaattttaaaaattagctggctgtggtggcatggacttgtaggcccagctacttgggaggctgaggcaggaggatcacttgagcccaggaggttgaggctatgtagtgaggctatgaagggagcctgggcgacagagcaaggccttgtctcaaaaagaaattgttacaggtcagctggaatttgctactactctggggtcagtcttattccattagcatcctcggatcaccacagacactatttaagtaacctgcatcacctgaagggctttataatcaattataaacttaaaaaaaagtctatcttcagaagtcagatgtcttttggcagaattcagcctgcggtcaattttatggcaaggaaaattcctgtgtgggaccaggagaaatgggatgaaactagttctcagtactacacagctattttcatgctccccaagggcattctagtaaagatggtaacaccatcaaaagtcaccttacctggtgacaatgaggttgtcatcatctcctacaacattcttagataatttttttctttttttttttgagacagagtctcgagctatggcccaggccggactgcagtggtgcaatcttggctcactgcgacctccgctcctgagttcaagcaattcctgtacctcagcctcccaagtagctgggattacaggcatgcaccaccatgctcagataacttttatatttttaatagagatgggttttgccatgttggccaggctggtcttgaactcctgacctcaagtgatctacccgccttggcttcccaaagtgctgggattacaggcgtgagccactgcatccagcctcttagagagttcttcatggcaatacctaatgtatgacagaaaggacattgacaattagcttgcaaattaaagcagggtaagactgttgtgttctttttgattttaaatgtgacaggatctggctatgttgcccaggctggtctcgaactcctgggctcaagtgatcctcctgcctcagcctcccaaagtgctgagattacaggcatgagacaccatgcccagcctgacgtgttctaattaaggctaacaccttcaccattgctcttaggcttcaaggatctagattagaccatgaaggccgggtgaagggagggagaagctaaaacactgctttcaaggaggacaatggaaataatatgaataacccaatatgcctcatttgtaaagtgtgttttttataactattttatgtcctaatcctcactacgtgatagcaattataaagaaaatggaatgtgtggcaccacttattctataagctaaagcttgaggttaaaaatagatattgaaataattgaacaaaataaaagtcatgtcagtaacctacagttcttttaactttgcattaagcagtagagttagaacattataatattcgggggggaaaagatgcattagatcagtgtgggtttttatttatttatttatttattttgagacaggatttcaatccggttgtccaggctgaagtgcagtggcgcaatctcagctcaccgcaacctcctcctcccagggtcaagcaatcctcccaccccaccctcctgagcagttgggagtacaggtgcatgtcaccacatcccgctaatttttgtatttttagtagagatggggtcttgctatgtttcccatgctggtcttgaactcctaggctgaagcaatgctcctgcctcagcctcccaaaatgctgggattgcaggtgtgagccaccacgcctggcccagtgtggatttttaaatagatttcagaagggaagggaaaagtcatgatgttaaagagtcttaaacaagacgtgtgttgtggtgcatgcctgtgatcccagctacttgggaggctgaggcaggagaattgcttgaacctgggaggcagaggttgcagtgagctgagatcgtgccactgcacccccgcctgggcgacagagccacaatccgtctcaaaatgaaaaacagagagaggtaacagaccagaaaggcatggtggctcacgcctgtaatcccaacactttggaaggccgagatgggcaggggcaggtcacttgagccgaggagttcaagaccagcctagtaaacatagtgagaccctgtctctacaaaaaaaaaaaaaaaaaaaaaaaaaaattagctgggcctgttagcacatgcctgtggccccagctacttgggaggctgaggtgggaggatcacttgagcctgggagattgaggctgcagtgagctgagatcatgtcactgcactccagcctgggtaacagagcaaggccctgtctttaaaatagccaaaaaaaaaaaaaaaaaaaaaaaaggaagattgttaaatataagaattaattttccgttgaagaagagttttgagtgtttctttttggtgagcagagttgagaagacatttgagtaatgatgtgacaagtgagatccgtatttagtatctacaggacttcaatctctgttttaccaaaaaagtcaccttaattgcttcgtatttatttttaggaataagcatgggcctttcctcctctttgtttcctttctacacgttcacatccctcttatcactatggagaacttcctcgggaagagtctccacgggctgtatggggacaacgtagaggagatggactggatggtaggtaagtgcacttccagggaaaatgggctgcttcccttccagcaatagaagcaggaaaggaaacaaagaatgagaaggttaaagacagaagatgcagaatagcgattgcagtgcgattggattttaagagtgcaaaatattatagcacagatcttcactgcattagcagagggtgaattccataacacatgcacgggaggcaatgcgattcggccaaagatgtccacatcttaatcccatgtggcagaaagctgtccactccctagacagaataatggctgcagagacatccacgtcctaatcttgatgtggtagacataaaaatggccccaaagatagccactttctaatccccatgtgggagacagaataatggccccaaagatgtccacatcctaatccccatgtgctagacagaataatgactccaaagatgtccacgtcttaatccccatgtgttagagagaataatgacctcagagatttccacgtctgaattcccaagtggcatacagaattttggccccaaagatgtctacgtcctattgccatgtggtagacaaacaaaagaaagagcagataaaattcctctccgctgtagagtggctagtggctccactgcactgaaaataggactaaatttcctcctatcacctacaaaagccccatgacctgctgctgcccagatcctagtctgacctctacccaacccccttgtcctccccacctgctgcattctggccacgtggacgccacacagtatctttcacatttgtcccctgtcagggcttccacacctgctgttccctcctggaatgcttcctcaggcttcactggctcctcttcagagcctgccctgacgcacccctaaagtagctcctccccaatcatcttctcccccattctcctgtggtccttttttgttttgcctttgttttcctcctcctcttcctcctttctcctcctccccctcttcttcttcttcttcttcttattcttcttcttcatattcctcctcctcctcctccttcttcttcctcttccacttcttcctcttcttcttctttcttctttctgtcttctttcttctttttttcctaacacagcatcaccattgcttctcttcgtgaccatgtgttaggtaggttgattttccatttcccccaggggaatataaactcctgtggggccggattgtcttgcctcattccctcattatatttcctgggtttagaacaggatggaaggggaatattgcttgagtgagtcagggctgggtgagcacctgtatatgggcacagcacatccctgcctcccaaaaaagaacttaggaaccgcagggtttaggtggtggtgggctgcgaatcccaggatcctcagaataattgccatcagagatttgggtgaacgacgtatttaaaaaaaaaaaattgtttcctcaacaagctaggcatggaaggagaaaaagttaattgtgtgtgtgtgtgtggcagggtctcactttttgttttgtttttttttttttgttttttttgttttttttttgagaccgagtctcactctgttgcccaggctggagtgcaatggcacggtctcagctcactgcaacctccgcctcccgggttcaagcaattctcctgcctcagcctccggagtagctgggtttacaggcacccgccaccatgcctggctaatttttgtacttttagtagagatggggtttcaccatgttggccaggctggtctcgaactgctgaccttgtgatccgcccgcctcagcctcccaaagtgctgggattacagggatgagccactgcgcctggccgacagggtctcactcttacccaggctggagtgcagtggtgcaaccgtggctcactgcaccctgccttcccaggctcaagcaatcctcccacctcagcctcccaagtacctgggaccacaggtgtgcactaccacacccggctaatttttttattatttgtagagacaagttcttgctgtgttgttcaggctggtctcaaactcataggctcaaagagcctcccacctcagcctctcaaattgctgagatttcaggcatgagccactgtgcccggccaactgtgagtgacattaatgacatgagttcccttgtgtgtggctgcaagaagctcagggtcacttttgaggactggtctgcattttcagtctatgctttcttctcaggaatattcacatgcctcacttttttttttttttttttttttttttttttgagaccgagtctcactctgtcacccaggctggagcgcagtggcgtgatctcagctcacagcaatctccacttcccgggtttaagctattctcctgcctcagcctcccaagtagctggtactacaagcatgtgccaccacgcccggctaatttttgtatttttagtagagatgtagtttcatcatgttggccaggctggtctacaactcctgaccccaaatgatcctcctgcctcggcctcctaaagtgctgggattacaagtgtgagccactgtgcccagcctgcatgctgcacttttaagtttttgatattttgtccttgtacgttgcctaaaattctgaccaaaggatggggtgcatataaagtcatacatcaatctccaacaaaggatatcaaaattatccaacagctgacttccattatgcgttaaaactaaggcttcattcttgtggctagcccccgaatgctaaagcatacacttcagagctgcatttctgatatttttccatttcgacggccccaaaaacatctgttctttgcaggacggatccttgacactttggacgtggagggtttgagcaacagcaccctcatttattttacgtcggatcacggcggttccctagagaatcaacttggaaacacccagtatggtggctggaatggaatttataaaggtaagactgagatgctcccagatcttcatcttgcaagtttatctcttccctgcaattcccagcagggcaatctattccaggagggtcaatattattgctcagggacagtgatttttcctatccagggcaaaagtggtaatttgacatactccagtttgaatttttgttcctggaccaaactgagggtcaggctgcttattctggtggttcaaaaatgagatgcagatgaactgggagaggagggagtttatttctgtaaccggttacagggaggtctggaaattgttgccagaccaactcaaaattacaaagttctccagagcttctatttctaagctgtatgtctgcgtgtaagtgtgcactcatctaaagacattagtgatgaacttcttctaatctgtaactaaggtctgagtcccggagaccctcctctggagactaagtaaattgacttaatctaaatgggtccaggtggccgggcacggtggttcatgcctgtaatcccagcactttgggaagccgaggtgcgtggatcacctgaagtcaggaatttgaggccaacctggccaacatggtgaaacctcgcctctactaaaaatacaaaaattagccgggcatggtggcacacgcctgtagtcccagctactcaggaggctgaggcagaagaatcgcttgaacctgggaggcggaggttgcagtgagctgagatcgcgccactgcactccagcctaagcaatagagagagtctccatctcaacaacaaaaataataaaataaataaataaacaaataaataaatgggtccaggtgccagggctgattacccttaccttgtctcctgctaaatcgcggaggtctggggagttgtttcagacctctaataaaacttgtttaatcctaaaagggtcctgctaagaattccttggttatcttgtcacgcttcaaggcccaggagaggcctgggcagaactcctggggggcttttgtgacatcccggcctttgtatacaggcgctggttgtttcagcttttgctatttaacttcaccactcgtcagtgctgaaacagttgttacggaggcctgtgttagtgagacgtggcctgccacgtttttgtgcacaattaaggaatttttagtagattatcagagttgtgtaaccatcatcatgtcgatgaaaagagctaaactctgtaaaacatttgaagaggtttattctgagccaaataggagtgaccatggcctgtgacacagccctcaggaggtcccgagaacgtgtgcccaagatggtcaaggcgcagcttggttttatacattttagggaggcatgagacagcaatcaaatacatttaagagacacattggtttggtccagaaaggtgggacaactcaaagccacggggcttccagcctacaggtagatttaaacatttcctggttgacaattcgttgtttctctaaagacctgggatcaacagaaaggaatgtctgggttaagataaaggattgtggaggccaggcacagtggctcacacttgtaatcccaacgctttgggaggccaaggcgggtggatcacttgaggttaggagttcgagaccagcctggccaacatggtgaaactctgtctctactaaaaatacaaaaattagctgggtgtggtggtgcgtgcctgtaatcccagctacttgggaggctgaggcaggagaatccgttgaacctgggaggcggaggttgcagtgagccaagactgtgccactgtactccagcctgggcgacaaagcgaaactccatctcaaaaaaaaaaaaaaaaaaaaaaaaagattgtggacacccaagttcttatttgcagaggaagccttcaggtactaggcttcagagacaagaggttgtaacatgcttcttatcagacctaaaggctgtgtggatgttaatgccagagaggaatcatgaggcatgttcgactcccgcttcctgtcacggcctgaaacagcctctcaggttaagtttttaaagagctctgggtgaggaggaagtccattcagatggttgggggtccttagaattttatttttgttttacaatcactattttcattcgtaaaatttattgttattatttttatttatttttattgagacagtctggctctatctcccaggctggagtacagtggtacgatcttggctcaccgcaacctttgcctcctgggctcaagtgatcctcctgtctcagcgatcataagtagctgggactacaggtgcatgcaaccactcctggctaatttttgtatttttgtagagatggggttttgccatgttgcccaggctggtctcaaactcctcacctcaagtgatcctcccacgttggcatcccaaggtgctgggatgacagcaggcatgagccaccacatgtggtccaccactgtttatttcagaacatttcatcacctcacaaaaaaatcctctactcatagcagtcactcccttttcccccgtgctaacatccatcacccaaaaacttatttttgatttgtttattatttaatttttaaaattatcttttgtaaagatagggtcttgttatgttgcccaggctggtctgaaactcctgaactcaagcagtcctcccagctgggcctcccaaagtgctgggattccaggcgtgagccaccatgcctggccacaaaattattttgtatcattgtatattttcctactctagacatttatgtaaatgaaatcatgcaatatgtggagtttttttgtttttacttagcatgatgcctctgaggttcatctgtgttgtggaaatgtttcattcctttccatggctgaatatattccattgtgtggactcaggtttgaattttaccttcagacaatgcatccaagaaggataaggccaggcgcagtggctctcacctgtaatcccagcactttgggagaccgaggcaggcagatcacttgaggtcaggagtttgagaccagcctggccaacatggtgaaacctcatctctactaaaaatacaaaaattagccaggcgtggtggtgcacgcctgtaatcccagctgaggaggctgaggcaggagaattgcttgaacctgggaggtgaaggttgcagtcagctgagattgtgccactgcactctcgcctgggtgacagagtaagactctgtctcaaaaaaaaaaaaaaaaaaaaaaaaggtagaagggtagacacctagctggccacattatattcaaacctgtattccattgtttccaaacacgccattctttcgtgtaccacaaagatgctaaaatgtgctgccccgtgtacatgacttcacactgttgtgcttacacattttgtcttctccctgcttagagagctttatttttcagtccttgaaagagcctttttaggctaatattggcaaatatacctatgatgtatatttgctttgaagtagatggatccatcagtctagtacatatgtaaaacgggatatataaatgccaactacatccactaatgccttcccacaacaacttcacattgaaggcctgactcctcagaaaccttctttatctcattgccattgacgttaatgtatcctctacccaatctggttctctgtgccatcaagaatgtcagtattataaactggcggagctttaaacaacaggaatttatcctgtcccagccctggagaccaggagtttgagatcaacgtgtctcagggaaatgttcccgccagaagctctaggggaggctcctccctgcctctgccaactcctgggggccccaggtgtccctgagcttgtggccacatcactccagtctctgcctccgtctctatgtggccttctcctctgtgtctgtgtctcctcttctgtctcttagaatgctgtcattggacttagagtccatccttctccgcgacgatcttgagatacttaattgcatctacaaggacccctttttaaaataaggtcccattcacagaatctggggatcagggtgtggatatatgtttcaggaggactaaagtgcaatccattgcaattgaatccacttctttctggatgctctaggggaggctccttcctgcctctcccagttaccgggggctccaggcatccctgggcttgtggccgcatcactccagtctctgcctctgtctccacgtgaccttcttctctgtgtccgtgtctcctcttctgtctcttagaaggacatctgtcattgcatttagggccaccctaatccaggattatctcaaggtccttaacttgattatatctgcaaaccccctatttccaaataaagtctcatttataggctctgggagatatgacatgaacatgttttggggtcactgttcaatacgttatagttgtatccactttcttcttgaggctctaggggaggatccttcctgctgctcccagcgcctgggggttccaggagtccctgggcttgtggccacatcactccagtctttgcctccgtctccacatggccttctcctctgtgtctgtgtcttctaagaacaagagtcatttgtagtgaaggacctaacttaatccaatgcacactaaccaataacaaggttaataaaaaatataaaatcaaacctctacaggggaactacatgagattgaatgttttaatgtcactaaaacagagagagagagagagagaaattgagagactcagggagagagaaacttcaaacaagtgaaacaagcagaaaagttaaatcagccaggctgagcatctatttctggtttttaaccactttcttttgtttctgttcaaacccaggtgggaagggcatgggaggatgggaaggtgggatccgcgtgcccgggatcttccgctggcccggggtgctcccggccggccgagtgattggcgagcccacgagtctgatggacgtgttccccaccgtggtccggctggcgggcggcgaggtgccccaggacaggtacagaacaacccaaagaaacaattcagctttgcacagacacagcaacacttatggcaaatgaacatgtcactttggctttgcagtaaggcgtccctgaaattgttccccgaccaaaccgagggtcgggctgcttattctcatggcccaataacgagatgcaaatgaacgaggaaagaaaggagttttatttctgtaaccagatacggggagaaggctggaaatgatcactagaccaactcaaaattacaaagttttccagagcttctataccttctaagctgtatgtccacatgtaagcgtgcatccatctaaagacataagtgattcaacttcctttcatctagaactaaggtctgagtcctgaggaccttcctctggagcctcagtaagttgacttaatctagatggttccaggtgctggggtgattacccttatcttgtctcctgctaaatcatggaggtttggggagttcttttagaccccccaataaaacttgtttgtggaggtctggggagttccttcagatccccaataaaacttgtttaatcctaaatgggtcctgttaagaatcccttcattattttatcgcgcttcaaggtccaggaaaggcctgggtagaactcttagtgggcttttgttacattccagcctttgggtgctggctctttcagcttttttttcttctttttttttttttgagactgagtctcactcagttgcccaggctggagtgcagtggtgcgatctaggctcactgcaacctccgcctcctgggttcaagcgatcctcctgcctcagcctcccgagtagctgggattacaggcacacaccagcacacctggctaatttttgtgtttttagttgagacggggtttcaccatgttggccaggctgatcccgaattcctgacctcaggtgatccacccgcctcgacctcccaaagtgctgggattacacgcacgagccactgtgcctggccaattaattactttttagccaaaggtgacgtttggtggtgactaacgtgggcagctgctgcattcttcttctaagcgtgctaatgcacacacatgccttccatccatctgcgttcacacccagactttccctccactgatacaacataaggagagtgcaccacctggggctgggactggtggatgctggagggacaaatgtccagagtccctgttccaaccctgagccatgccatgttccttcctgcagagtgattgacggccaagaccttctgcccttgctcctggggacagcccaacactcagaccacgagttcctgatgcattattgtgagaggtttctgcacgcagccaggtggcatcaacgggacagtgagtaggggagccccttcctaacacccttagggaaagagtccctctgtgcaggaaagcaccatgccctagaacaggctagggatggagctgcattccagagtccatctccatgtctccgcacttccgtttttctccacgagctttttaaatttagtttttgtcaatatgtgtccctctcattccagcgacatgccttctgagatcacctgccaatcgtcttaaaacgatggggagtcgttacctatagtttcagcaccatgtatgggctatatttcattctttcttccctgcactatatgaagtgcaacttttatcatcatcacacacacgtatgtgcatgcatacacacacgcacgcacacatgcttgcacacacatgtgttcaagacttttctagtctcttttttttcttatttttttgtaattatttttttgagactagtctttgtcgctcaggctggagtgcaactgcagtctcccgggttcaagtgattctcctgcctcagcctcctgagtagctgggattacaggtgcccaccactacacctggctaatttcttgtatttttagtagagatggggtttcaccatgttgggcaagctgttcttgaacccctggcctcaagtgatccaccctcctcggcctcccaaagtgctgggatgacaggcatgagccaccacgcctggtctccaatttttctttattaagttgaaacaaggtctcagtatgttgcccaggcaactcctgggctcaagcaatccacccatcttggcctcccaaaatgctgaaattgcaggtgtgagccaccacgcccagccttttgtagtctattttatgcatctagatgtgcttccaaatgttttaatcacctgaccttaacacgacttcatcttctttgtgaacaattacaggcgcactcctgtaatcccagctacttgtgaggctgaggcaggagaatcacttgaacccaggaggcggaggttgcaccactgcactctagcctgggcgacagagcaagactctgtctcaaataaaaaaaaaaaaaaagaaaagaaaagaaaagaaaagaaaaaactgactgagtgcaattcacaggcacttcgtgctttcacagtgttgtgcaacctccacgtctatgtagctccagaacattttcatcacgccaaaagcagacactgttcctatcagcagtcactctccatttcacaccctgcagaccctggaaaccactactctacttcctgtcattatgtgtttccctatccttgacattcaatgtgaatggaatcatgcaatgtgtgctcttttgtaacttctttctctgagcgtagtattttgaaagttcgttgatgttgcagcctgtgtcattgtgtcattccttctcatagctgcagagtatgccatgtaagatgtaccatgttttgtttatctgtccatccatcgatggacgcttgggttaggcctaccttttagccctatgaagatgccattctccagcaaggcaccctatttctctatgccaactctgtaatgattatctttccaccaggaggaacaatgtggaaagtccactttgtgacgcctgtgttccagccagagggagccggtgcctgctatggaagaaaggtctgcccgtgctttggggaaaaagtagtccaccacgatccacctttgctctttgacctctcaagagacccttctgagacccacatcctcacaccagcctcagagcccgtgttctatcaggtgatggaacgagtccagcaggcggtgtgggaacaccagcggacactcagcccagttcctctgcagctggacaggctgggcaacatctggagaccgtggctgcagccctgctgtggcccgttccccctctgctggtgccttagggaagatgacccacaataaatgtctgcagtgaaaagctggagccccgattcctaaattttgtcactcaaattgaaacaaaccagctggccatggtggttgtcatcccagcactttaggaggccaccacaggaggatcactcccgtgatcaaaaccaacctgggcaacatgatgaaactctagctctacaaaa

SEQ ID NO: 2939 - DNA, 14641 bp, human
tcttcttgatcggggattcaggaaggagcccaggagcagaggtgagtcctgtgaatgttcatttgtgctggatttgggctccgtgaccaggcatgaatagcgtggtgaacaaagagctccccgttcccttttctgtctctgaataattgcccagtttgttttgataaagcagaaacgtacccgtgacttacaggcctaggaatgcagctctttcctggagaagggggatctgttttctaatctgcaggagaggccttgggcaggccccatgctctgggtcacctcaatgtcacagtttccaaaattaaactcattcaaggctgttatcaccatctctttatttatttaacgtttttctccaagaaaaaatattcatatttttacttataaatacataacattgcgggagaaagaaaaattaggtcgggcacggtggctcacgtctgtaatcccagcactttgggaggtcgaggcgggtggattgcttgagcccaggagtttgagaccagcctgagcaaaagaggaaaccccacctctacttaaaaaaaaaaaaatcaatagccaggcatagtggcatgtgcctgtagtttcagctacttgggaggctgaggtaggaggatcgcttgagcccaagaatttgaggctgcagtgaactatggtcgcaccattgctctccagcctgggtgaaacagccagaccctatctcaaaaaaaaaaaaaaaaaaaaaaaaaggaaaagaaaagaaaaattagaaaaagagcacttttcctaaatctccacacccagagataaaccactgctgggcaggattgctgcaaaaaccatcttcccctagtttgtggtggtttggggttttctcattacatttgtacagtattttgcttttattccgttttctgaccattggcagcatgtcattgtaggtcagaaagcaatgctgagggtattaaaatgctcattttggttttctctccatgtacaattttaaatcaatctctttcccggtgaagatgctattaggttggtgaaacgtaattgcgtcttttgctattacttttagaatatgagaattgtgtgtgctctctagggtaaaacaaacgaacaaataaacaaaaaaacctcacgagcacggcgtacaccttatcccttccttctgtgttctaaacaaagcacaaatgatatctaaggtctttttctcttcgacagacagaaaattattggagatgtagcaattcagtgttagacatccatcaataatgtaagaagtgcattgattcggtctggaaaggccggaaaacttgaagcaaaggcaggaagactgtaagcagggagggggcttccaggtcacagataggtgagagaggaacagttgccttcttttgagtttctgatgagcctttccaaaggaggcaatcagatacgcatctatctcagtgagcaaaggggggactttgactagaatgggaggcagaggccctaagcagttccccgcttgacttttccctttagcttattgacttgcgggccttgagatttattttcctttcacaaagctcattgtctttctcagaagactggttttgtgcctgaatcctgctaggagcaaacacccctcccagcatccccgaaaaggcgttgaggggaaatccctcaaccaatcgcttctctcccactcacaccctggggtttcgcagccctgcggaccttgcccacccctcctctctgccctccccgctcccacaccagctgtgtctatccttggtcaggtttcacctggacagacaccacggccacttctaggctctcagtgcctgctggctccagtgtgtcctcactcactggccgctcggcccttctaaaagtggccaggtcactcccctggttactcagaggcagaaacccaacacatctgcatgctcctgtctctttatcttctatgcatgcccatgtcctgtcaacgaaaagaagcgaactctgtagaatatttgaagagatttattctgagccaaataagagtgaccatggcccatgacacagccctcaggaggacccaagaacgtgtgcccaaggtggtcagggtgcagcttgttttatacattttagggaggcatgaggtgtcaatcaaatacatttaagatacacattggtttggtccagaaaggtggaacaactcaaagtcagggggcttccagcttatacatagatttaaacatttcctggttgacaattggttgagttcatctaaagacctgggatcctaggaggctgaggcaggagaatcacttgaacccgggaggcggagcttgcagtgagccaagatcgcgccattgcactccagcctgggcaacagagcaagactccgtctcaaaaaaataaaaaagaaagattaaaaaaaaaaaaaaaaaaccctgggatccctagaaaagaaatcttcaggttaagagaaaagattgtggagaccaaggttattttgaagtcttgtagcggctgcccttagagacaatagatgacaattgtttcctattcagacttttaaaaggtgctagagtcttagtcaatcttttcaggattggaagggtccggtagaaaaagatgtgaatatctatgtgaatagagattctttacatctttacagatgcaaatttttccccacaaaggacagctttgcagggccatttcaagatatggcaaagaaacatgtttttgggtaaaatattttgattttcttattggtctcatgttatgccagagtcagattggaaagtaagtcacaatatatagttaaatgaaacccttctgatgagaatttttggtttgtagggcatgactctccagaccccttagataggaatttgggcaagataaaaagaaaaatcagagcttcgtcctcagtcccatgcacaagccacatggggtcagaccactgcagtaccctgaaggtgacctcttgctgcctgcaactctaattgttatcttccatctcattcctttcctgctctacaccctgggctctccctcacttctcggcgagactgaggggccgcccctctgtgctttgggggtcgcccgtttccctctgtggacagaacatttccaagtgtgggcaatggtcgccccctctcccggcagcacctacccctagcaatgaaggcgaatgcgtctctccttcatgcagcactcagtgcctgcagagtcctctaggcctttttccttcacactgacactcccagttctgttttcaagtctggacctcctgggctcaagcaaatcctcccacttccgcctcccaaagtgctgggattccaggcatgagccaccacgcgcagcctctcattgtatttctgatcttcataccctctactcagattcttttgtgtatcatccaagctttgatctttccccgcttcccccttccaaatcaggactctctctctgcatttctggacattaggaatcacccctgccctgggctcgggaagcagaagacaaaataatctgcttccggacactgggattctctcatcactttgtgatcactcatgggctatgaaagctgataaaggggatggagaccctatgaccactttcttcctctttctctgaagaccatctggctgtgtattgaaacacgttttacattcttaacatagtattaaacatttttgaagccttttcactcgggaagagcattcctttatagattttgatcattgttttaagatatttttgctattgatatcatgaacgggaatcaaagttcccctaattacttacttactgttttatttataatcaggtcaatttctgctgtcaatgtgattgtggacatctttatgtcttacaggaagtagagagagagacaacatgttacatctgcaccattcttggtaagatacaattatatgcactcattagtagtctcctttctttctttctttctttctcttccttccttcccttctttctcttcttttttttttttttttttttttttttgagacggagtctcactctgtcgcccaggctggagtgcagtggcgcgatctcggctcactgcaagctccgcctcccgggttcacaccattctcctgcctcagcctcccgagtagctgggactacaggcgcctgccaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggcctcttttctttctttctttctctttctttctttctttctttctttctctctctctttcttccttccttcccttctttattttttttcctttcttatatagagacagggtctcaccatgttgctcaagctggtcttaaacacctgggctcaggcaatgctcccaccttggcctcccaacgtgctcagataatgggcatgagccaccacgcctgaccgcttctggatctcttgatggtgctttctcagaatgcactgatagtgatttatcctgcatctggagaatgaagcatgagacccgtgattaatagatgtgctccaggctcccttgatttgatgttgccccaggcagcctcagaaggaattgtatttcattctctgcaaatcaggtgggcatcaaccgctaccatcggccaggtgtctggttttccagggaaaatcagggtttcccctactacaaaccttggagactcagattacatctttactgcatcccactggggattgggacactatggccctgctgtccatgtgcattcccagggtggcatcgatgaaagaggcagcaatgatagtggcaggctgtatgtcaccaacccctgcggaaatgttccctcatggtacgcaactaccagggctttctcctccaggctggaacctccttcacctccaaacccacttctcatcagataccagtgggctaaagaagtcagtcctgggtattttcatctgtgtgctacaatgaacagagggttttcatagactcagaagtagcagctcactgtgttctcaccttgccccaagcttgtgtctcttccttgctctgctgggtggtccaaaccctaaccccagcctccattccctatgttcaacacagtttgcttaaggaagaacaatgaagaagagggaatggagaaggggcaatagctgttctggggacccgatccatccaagaaaccatgactaaggcaggctttctggctgtttttgctttttcttgttgctgttgtagttttgagacagccttgctctgttgccctgcagtggtgcgatctcagctcgctgcagcctcaacctcccaggctcaagcgatcctcccacctcagccttcccaggagttgggactacaggcacgtgccaccacgcccagctaagctgtgtatttcttgtagagatgagttttcaccatgttgcgcaggctggtcttgaactcctgtggtaaagcaatccacccgctgcagcctcacaaaatactgagattacaggagagagccactgcaccccaccaaggctttctgttaatcatgagtttaatcacttaacaacagactttacagcatcaaaaaaaacccaaaaaacttcaaggccaaataaagccatcaacggtatcagttaattgtaaccagagaaaaacaatcaaatgcctaagagatgtcctcaaagctattctgaaatgtgatgataatatcaatacctcttaaaatagtgatgccaacttcccccatacacaagttctgcaaatgagatggacaggagcatgacgcagtctctgacagtttgtgtttcaggagctggctgccagcgatgctcgctgtactgctaagtttggcaccatcagcttccagcgacatttccgcctcccgaccgaacatccttcttctgatggcggacgaccttggcattggggacattggctgctatggcaacaacaccatgaggcaagggacagagaattactcacctggtgcccccaatgcagacaccagaagaaagagaagccactgaaaatgcatataacccttgatcttggcagttcacacttcaagagttctgcacttctgcgttttctaactctccctaatgttactttcttcccatgccagcactaacctcacctcaatccatcctacatatgactgctcatttcatttttatttttatttatttatttttattttttatttttctctgagacaaagtcttgctctgtggtccaggctggactgcactggtacaatcacagctcactgcagccttgacctcccaggttcaagtgatcctcctgcctcagcctcccgagtaattctgggactgcaggtgcccaccatcatgcttgggtaatttgtaagtttcttgtagaggtggggttttgccgtgttgcccagcctcgtctcgaacttctgggctcaagtgatccacacacctcagcctcccaaagtgctggtattgcagatgtaaaccaccatacctggcctcatttcttttctttttttttttttttttgagacagaatctcactgtgttgcccaggctggagtgcagtggtgcgatctcggctcactgcaacctccgcctctgcgattccagtgattctcctgccttactctccagagtagctgggattacaggcgcccgccaccatgcctggataatttttctatttttagtagagacagggttttgccatattggccaggctggtctcgaactcctggcctcaagtgattcacccgcttcagcctcccaaagtgctgggactacaggtgtgagccactgtgcctggcctcatttcattttttaaatatgatttttatccacccagtacataatggacaatgctttagaaatgctatcagccgggcatgactgtaataccagccctttgggaggctgaggcaggaggatcacttaaggccaggagttcaagaccagcctgggaaacatagtgaaatcctgtctctagaaaatataaacattaattttttttttttgagacggagtctcgctctgtcacccaggctggagtgcagtggcatgatcttggctcactgccagctccgtctcccgggtccacgccattctcctgcctcagcctcccaagtagcttggactacaggcgcccaccaccacaccccgctaattttttgtatttttaatagagacggggtttcatcatgttagccaggatggtctcaatctcctgacctcgtgatctgcctgcctcagcctcccaaagtgctgagattacaggcgtgagccaccacgcctggcacattaatttttaaattaaaaaaaaaattagccaggcatgatggcatgcacctgtaatcctagttattcaagagggtgaggtgtgggaggatcacttgagcccaggagtttaaggttgcagtgagctgtgatcagaccactgcactctgggcgacagagaccctgtttcaaaaagtaggctggccgtggtggctcacgcctgtaatcccagcactttgggaggccaaggcaggctgatcacttggaggtcaggagttcgagaccagcctggccaacatggtgaaacccccgtctctactaaaaatacaaaaattagctgggcatggtggcgggcacctgtaatcccagctacttgggaggctgaggcaggagaatcacttgaacccgggagggggaggttgtagtgagactcaaatagtgccactgcactccagcctgggtgacagagtgagactcagtctcaaaatacaaacaaataaacaaacatacaggagaaatcagtgtcgttgcctgtaagcagaagaccaatattgatctctgtctcactcccaaccctatccatctagccaagcccagcacttatgcgggatttcaatcctcccctgctgaaaagctctgcttcagacagacaagtccacaccctcctaatgccaaaatatggcgtgtccatctgtcaagagctagagctagtccgtcctcctgtccgaattccagccttccaccctcatgtagtacttacagtgtgttggcgtccatgaagtcaaaccttcccatgaacactgtgagctccagagaaggtgccctgggctctcagttctgcattccctctgaggtcggtctctcagtaccaacagtgccttgtggaaacttagtcactctatctactcattcatttatttattttagagacaggttgtctctctgtcacccaggttgaagtgcagtgttgcaatcacagctcactgcagcttcaaactcctgagctcaagcaatcctccttcctcagtctcccaagtagctggttctacagacatgcaccaccaatcctggctaatttttctatttttgtagatttttttgtagagacagggtctcgccatgttggcccggctggtcttgaactcctggccctaaacgatcctcccgctgtggctttccaaagtgctgggattacaggcatgagccaccgcgtccagccactcattcctatttaaatgagttgatgtttcctcgaaagttcagaagacattagaaatctttgacattacctttgggtcattcctgagaacatcttgaagcactcagcgatgaccagcagaccttctatgaagtagcatgtagctatgcttatgaaaagcctgtctaattttaacaagtaaagctgttaatttgtccctccataggactccgaatattgaccgccttgcagaggacggcgtgaagctgacccaacacatctctgccgcatctttgtgcaccccaagcagagccgccttcctcacgggcagataccctgtgcgatcaggtcagtctctctttacaactgcactagggtgcagcctggtgtattcgtcacagtttctagttcttacattttggtttttttattttttatttaaatagagactggggggtgttctctctatcttgcccatgctggtcttgaaatgctgggctcaaaagatccccgctccttgacctcccagagtgctgggattacaggcatgagccaccgtgcccaggcagcttttatattctgatgctttgacatcttagggctttgctgaccttggcaggactggccctcccagggctagccaattcttagagatagcaaacaagtcacctgggagtgcacctttcatgcataaaccaaacagtccagagcccacacccccaaccatcacttttatgagattttcatatatggggctactctctccttgccctaatccccccagaatcaggtaccagctttctagggacagcccctgcagatgaaagcccacggaaattgtacaacctggccagtcttaagccggcttaccctaccttgcccattactttccaaaaaagaaaaacaataaataagaaaggctttttccatgctttcccctcactccctctgcctcctgaccaaccctggagcttccccatatagtcacacagcatggctcacccctgcgtcctcttgaactgtgagtaataaactatcagaaactgtgagtaataaactatctctccaatgacagtcatctcctgatctgttggccttgccatagctgaatgataaaaccttaataataataatacataacacctacattttaaagcacttgggtagaggctgggcacggtggctcatgcctataatcccagcactttgagaggctgaggcaggcagatcacctgaggtcaggagttcaagaccagcctgaccaacatggggaaactccgtctctactgaaaatacaaaaattagctgggcgtgatgatgagtgcctgtaatcccagctacttggaaggctgaggcagtataattgcttgaacccgggaggcggagattgcagtgagccgagatggcgccactgcactccagcctgggtgacagagcaagactctgtcccaaaacaaacaaacaaacaaaaaaacccttgggtagagatttggaatgtctggagagcagaataaaattttatcagtggctaccaaccttgtcagtacgttagaatcatccagaggatattcccaccatcccaaagcccaagttccacccaagaccaatgaaaattagcacccctggggtgataaccaggcgtcagaatattttgaagctccccacacgattccaatgggcagacaactttgagaacctttagattatatcaagagtttgatgaaattataaaatcatttttagttcaggcacaatggctcatgtttctaatcccaacactttaggaggctgaggtgggaggatttacttgagtctaggagttcaagaccagcctgggcaacatagtgagaccccgtctctgccaaaaaattaaaaatattagctaggcatggtgatgagcccctatagtcccagctacttgagagactgaagtgggaggatcagttgagcccaggagttcaaggctgcagtgatctatagtcatgccactgcactcaagcctgggtgacagagtgagaccctgtctctgcaaaaaatttaaaaattagccaggtgtggtggtgcacacctgtagtcccagctactcaggtagctgaggtgggaggatcgtttgagcccaggtggttgagactgcagtggacattgattacaccactgcattccagcctggacgacagaacaagaccccatctttaaataaattaattaacaaacaaaaaaccatttaaatttttagtcctttttcactgaattatattgcttataacctgcacataacaggaaagtccatcttctcgctaaggttttcaataaattaatcatttactttgctgccaaaaatgcaatccactaggcaaagtcatataggaagtccattttcaatttaattttaagtaagagagatttttaccaagtgttctatttttgaataaataataaataacaaacaggaaaaaaaatgtggaacagtaattctttctcttaataattgctcaaagggatggtttccagcattggttaccgtgttcttcagtggaccggagcatctggaggtcttccaacaaatgagacaacttttgcaaaaatactgaaagagaaaggctatgccactggactcattggtatgtacgtttttaaaagtggtaagcacatgacttttatatggaagggacattcagctaaagagtttggaaaggaaagtgggtgaggtgctgtgggatttcccactagacagaaagctgcatgtatctaggaaccatgttcctttccaggttgttttctgcaaagtagatactcaagaaataccagctcaggcaaggtggctcatgcctataatcccagtactttgagaggccgaggcggaaggattgcttgagcccagaagtttgaaacccgcctgggcaacatagcaagaccccacgtctacaaaaaaatacataaaaataaattaaaaaataaataaaatgtgctcatgcctatggcatatgttccaagctccattgcacaacacataattgcttctttgttctgtgggatcctctcccacccttcacatggactttttgtcttagacatgaatgtcttagactgaacaccttcagctcttttctggttggtttatggatcaacttggctagtttagtgctgccatctaaatgtttgtgtccccctaaaattcctatgttgaaacccttaccccccaggtgatggtggcaggaggtgaagcctttgggaagtgatgaggtcgtgaaggtggagcctcatgtgtgggattagtgcccttacaaaagtgactctggtcaggcgcggtggctcatgcctgtaatcccagcactttgggaggccaaggtgggtggatcgcttgaggccaggactttgagaccagcctgggcagcatggcgaaaccctgtctctacgaaaaagaaaaagaaagaaagaaaaggaacatcaacttaatgaaatatttggcatctcaaacaatgttctcgtaggccatgataaaaaaaaataagaaaaaatatattcttgcatcaaaaatttctgtaatgctacctatttttccccttggtgtgtatgaaaatgtctttactagatttagtacctccctgtcagcttccataactaacatggttatttttctacaagtcaacaaacatgtcatgtattggatgaaaaataaaattaatgacaacagttccttgagaggagaccaagttgccattatcattattgtgttatagtaatgattgttatcaacagttccatttattgataacaaacaacatgactagtggatacaatgagtataaaattcaataaactatatttctaaaaattaaaaattataaaatgttctttgtttaattttttaccaaaaaaaaaaaaaaaacaaattctggggagattcagtcatcgctgtcaaacaaaggtgtattttttccaatagactttttttttttttttaaacagggtactcactctgttactcaggctagagggcaatggtgcagtcacagctcactgcagtctcgacctcccagactcaagtgatcctcccaccttagtctcccaagcagttggtactacaggcttgcaccaccatgcccggttaattttttcttttttttctttttttttttttttttttttgtagagatggggtcttcccatgctacccaggctggtctccagcaatcctgggcacaaggaatcctctcacctcggcctcccaaagtgctgggattatagttgtgaaccaccatgcctggccaactataatttttctaagacagaagagtctatccttaagggatatccattgggaaatcatgaggttttccagatggcagacagcattggggtggttgacatctctttgtcaacaccatagtagtggctacatggaagcaaagactatattcctttgactgaatttgaaaggtgtgccttgcaaaacccaccacccacttcaaccatggccactatgatagtggtttctcaaagagagaacaattccaaagtccagaagtcttttgcccatgctgctgatatcacatggtgctttccggccttcatcattgcactgcaaaacaaggtgcaatagactaaataatggtcccagagatgtcaggccctaacctctgaatctagcaaatattagcttatatgcaaaaagagtctttgtaaatgtgattaagtgaacaatcttgaggtgagaagatgatcctgaattatccagctgggcccactgtgcaaggacaaggcttcgtttaacatggaggtagaggaagattgggccacagagaggagaaagcagtgtgattaaagtgaggcgaccacaagccaagggatagctggagccaccaggagctgggagaggcaggaaggatcctcccctagagcctctggagagagtatgtgtgtgtctgtgtcctactatcctcttcttataggacacaagttctatcagattaaggcctgtattagtctgttctcacgctgctaataaagacatacccaagactgggtaatttataaagaaaagaggtttaatggacttccagtttcacatggctggggaggcctcacaatcatggtggaaggcaaaggagaagcaaaggcatgtctttcatggcggcaggcaagagggcatgtgcaggggaactcccatttataaaaccatcagatcttgtgagactcattcactaccatgagaacagtgtaggggaaaccacctccatgattcaattatctccacctggctccactcttgacacatagggattattacaattcaaggtgagatttgcatgaggacacagccaaaccatatcagtgcccaaactaatgacctcattttacattaattatcctttgaacaccctgtctccaaacacagtcacattctgaggtcctgggtgttagggcttcaactcatgaatttgaggcaggccaggatccagctcacaatagagtcattgcagatataatcaagtaaagatgaggtctctacagtgggccctactgcgatgactgctgtccttatgagacaagagattaggtcgcagacacacacagaggacaacgccatggaaacatggagatggagactggagtgatgcggccacaagcccagggaggcctggagccctcaggagctgggagaggcaggaaggatcctcccctagagcctccaatttgagtgtggcctggagacactttgatctcagactcctggtctctaggactgggagaggatagatttctgttgtattaagtgaacagttttacagtaatttgttccacctgtcacgggtaactaatattttggttaaagctgacacatggggtcctcattcccctgaaacgatgaggccagattgtggtgcaaataacagctaatgctgcccacacttctttgcaatctcctggccccccagtgtctaacagagtatcaggaatgtgacaaacagtcaatatcgacatgtccagttatgctcagatgcttgtcacatcaacatcctttttgcctctcaggaaaatggcatctgggtctcaactgtgagtcagccagtgatcattgccaccaccctctccatcatggctttgaccatttctacggaatgcctttctccttgatg

SEQ ID NO: 2940 - DNA, 29454 bp, human; identical to SEQ ID NO: 2936

SEQ ID NO: 2941 - DNA, 29473 bp, human; identical to SEQ ID NO: 2937

SEQ ID NO: 2942 - DNA, 33587 bp, human; identical to SEQ ID NO: 2938

SEQ ID NO: 2943 - DNA, 5853 bp, human
tcttcttgatcggggattcaggaaggagcccaggagcagaggtgagtcctgtgaatgttcatttgtgctggatttgggctccgtgaccaggcatgaatagcgtggtgaacaaagagctccccgttcccttttctgtctctgaataattgcccagtttgttttgataaagcagaaacgtacccgtgacttacaggcctaggaatgcagctctttcctggagaagggggatctgttttctaatctgcaggagaggccttgggcaggccccatgctctgggtcacctcaatgtcacagtttccaaaattaaactcattcaaggctgttatcaccatctctttatttatttaacgtttttctccaagaaaaaatattcatatttttacttataaatacataacattgcgggagaaagaaaaattaggtcgggcacggtggctcacgtctgtaatcccagcactttgggaggtcgaggcgggtggattgcttgagcccaggagtttgagaccagcctgagcaaaagaggaaaccccacctctacttaaaaaaaaaaaaatcaatagccaggcatagtggcatgtgcctgtagtttcagctacttgggaggctgaggtaggaggatcgcttgagcccaagaatttgaggctgcagtgaactatggtcgcaccattgctctccagcctgggtgaaacagccagaccctatctcaaaaaaaaaaaaaaaaaaaaaaaaaggaaaagaaaagaaaaattagaaaaagagcacttttcctaaatctccacacccagagataaaccactgctgggcaggattgctgcaaaaaccatcttcccctagtttgtggtggtttggggttttctcattacatttgtacagtattttgcttttattccgttttctgaccattggcagcatgtcattgtaggtcagaaagcaatgctgagggtattaaaatgctcattttggttttctctccatgtacaattttaaatcaatctctttcccggtgaagatgctattaggttggtgaaacgtaattgcgtcttttgctattacttttagaatatgagaattgtgtgtgctctctagggtaaaacaaacgaacaaataaacaaaaaaacctcacgagcacggcgtacaccttatcccttccttctgtgttctaaacaaagcacaaatgatatctaaggtctttttctcttcgacagacagaaaattattggagatgtagcaattcagtgttagacatccatcaataatgtaagaagtgcattgattcggtctggaaaggccggaaaacttgaagcaaaggcaggaagactgtaagcagggagggggcttccaggtcacagataggtgagagaggaacagttgccttcttttgagtttctgatgagcctttccaaaggaggcaatcagatacgcatctatctcagtgagcaaaggggggactttgactagaatgggaggcagaggccctaagcagttccccgcttgacttttccctttagcttattgacttgcgggccttgagatttattttcctttcacaaagctcattgtctttctcagaagactggttttgtgcctgaatcctgctaggagcaaacacccctcccagcatccccgaaaaggcgttgaggggaaatccctcaaccaatcgcttctctcccactcacaccctggggtttcgcagccctgcggaccttgcccacccctcctctctgccctccccgctcccacaccagctgtgtctatccttggtcaggtttcacctggacagacaccacggccacttctaggctctcagtgcctgctggctccagtgtgtcctcactcactggccgctcggcccttctaaaagtggccaggtcactcccctggttactcagaggcagaaacccaacacatctgcatgctcctgtctctttatcttctatgcatgcccatgtcctgtcaacgaaaagaagcgaactctgtagaatatttgaagagatttattctgagccaaataagagtgaccatggcccatgacacagccctcaggaggacccaagaacgtgtgcccaaggtggtcagggtgcagcttgttttatacattttagggaggcatgaggtgtcaatcaaatacatttaagatacacattggtttggtccagaaaggtggaacaactcaaagtcagggggcttccagcttatacatagatttaaacatttcctggttgacaattggttgagttcatctaaagacctgggatcctaggaggctgaggcaggagaatcacttgaacccgggaggcggagcttgcagtgagccaagatcgcgccattgcactccagcctgggcaacagagcaagactccgtctcaaaaaaataaaaaagaaagattaaaaaaaaaaaaaaaaaaccctgggatccctagaaaagaaatcttcaggttaagagaaaagattgtggagaccaaggttattttgaagtcttgtagcggctgcccttagagacaatagatgacaattgtttcctattcagacttttaaaaggtgctagagtcttagtcaatcttttcaggattggaagggtccggtagaaaaagatgtgaatatctatgtgaatagagattctttacatctttacagatgcaaatttttccccacaaaggacagctttgcagggccatttcaagatatggcaaagaaacatgtttttgggtaaaatattttgattttcttattggtctcatgttatgccagagtcagattggaaagtaagtcacaatatatagttaaatgaaacccttctgatgagaatttttggtttgtagggcatgactctccagaccccttagataggaatttgggcaagataaaaagaaaaatcagagcttcgtcctcagtcccatgcacaagccacatggggtcagaccactgcagtaccctgaaggtgacctcttgctgcctgcaactctaattgttatcttccatctcattcctttcctgctctacaccctgggctctccctcacttctcggcgagactgaggggccgcccctctgtgctttgggggtcgcccgtttccctctgtggacagaacatttccaagtgtgggcaatggtcgccccctctcccggcagcacctacccctagcaatgaaggcgaatgcgtctctccttcatgcagcactcagtgcctgcagagtcctctaggcctttttccttcacactgacactcccagttctgttttcaagtctggacctcctgggctcaagcaaatcctcccacttccgcctcccaaagtgctgggattccaggcatgagccaccacgcgcagcctctcattgtatttctgatcttcataccctctactcagattcttttgtgtatcatccaagctttgatctttccccgcttcccccttccaaatcaggactctctctctgcatttctggacattaggaatcacccctgccctgggctcgggaagcagaagacaaaataatctgcttccggacactgggattctctcatcactttgtgatcactcatgggctatgaaagctgataaaggggatggagaccctatgaccactttcttcctctttctctgaagaccatctggctgtgtattgaaacacgttttacattcttaacatagtattaaacatttttgaagccttttcactcgggaagagcattcctttatagattttgatcattgttttaagatatttttgctattgatatcatgaacgggaatcaaagttcccctaattacttacttactgttttatttataatcaggtcaatttctgctgtcaatgtgattgtggacatctttatgtcttacaggaagtagagagagagacaacatgttacatctgcaccattcttggtaagatacaattatatgcactcattagtagtctcctttctttctttctttctttctcttccttccttcccttctttctcttcttttttttttttttttttttttttttgagacggagtctcactctgtcgcccaggctggagtgcagtggcgcgatctcggctcactgcaagctccgcctcccgggttcacaccattctcctgcctcagcctcccgagtagctgggactacaggcgcctgccaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggcctcttttctttctttctttctctttctttctttctttctttctttctctctctctttcttccttccttcccttctttattttttttcctttcttatatagagacagggtctcaccatgttgctcaagctggtcttaaacacctgggctcaggcaatgctcccaccttggcctcccaacgtgctcagataatgggcatgagccaccacgcctgaccgcttctggatctcttgatggtgctttctcagaatgcactgatagtgatttatcctgcatctggagaatgaagcatgagacccgtgattaatagatgtgctccaggctcccttgatttgatgttgccccaggcagcctcagaaggaattgtatttcattctctgcaaatcaggtgggcatcaaccgctaccatcggccaggtgtctggttttccagggaaaatcagggtttcccctactacaaaccttggagactcagattacatctttactgcatcccactggggattgggacactatggccctgctgtccatgtgcattcccagggtggcatcgatgaaagaggcagcaatgatagtggcaggctgtatgtcaccaacccctgcggaaatgttccctcatggtacgcaactaccagggctttctcctccaggctggaacctccttcacctccaaacccacttctcatcagataccagtgggctaaagaagtcagtcctgggtattttcatctgtgtgctacaatgaacagagggttttcatagactcagaagtagcagctcactgtgttctcaccttgccccaagcttgtgtctcttccttgctctgctgggtggtccaaaccctaaccccagcctccattccctatgttcaacacagtttgcttaaggaagaacaatgaagaagagggaatggagaaggggcaatagctgttctggggacccgatccatccaagaaaccatgactaaggcaggctttctggctgtttttgctttttcttgttgctgttgtagttttgagacagccttgctctgttgccctgcagtggtgcgatctcagctcgctgcagcctcaacctcccaggctcaagcgatcctcccacctcagccttcccaggagttgggactacaggcacgtgccaccacgcccagctaagctgtgtatttcttgtagagatgagttttcaccatgttgcgcaggctggtcttgaactcctgtggtaaagcaatccacccgctgcagcctcacaaaatactgagattacaggagagagccactgcaccccaccaaggctttctgttaatcatgagtttaatcacttaacaacagactttacagcatcaaaaaaaacccaaaaaacttcaaggccaaataaagccatcaacggtatcagttaattgtaaccagagaaaaacaatcaaatgcctaagagatgtcctcaaagctattctgaaatgtgatgataatatcaatacctcttaaaatagtgatgccaacttcccccatacacaagttctgcaaatgagatggacaggagcatgacgcagtctctgacagtttgtgtttcaggagctggctgcc

SEQ ID NO: 2944 - DNA, 14641 bp, human; identical to SEQ ID NO: 2939

SEQ ID NO: 2945 - DNA, 29454 bp, human; identical to SEQ ID NO: 2936

SEQ ID NO: 2946 - DNA, 29473 bp, human; identical to SEQ ID NO: 2937

SEQ ID NO: 2947 - DNA, 33587 bp, human; identical to SEQ ID NO: 2938

SEQ ID NO: 2948 - DNA, 26958 bp, human
tgacaagaaacgccagacccaacattgtcctgctgatggcagatgaccttggagtgggggatttgtgctgctacggtaataactcagtgaggtaaagatggactctgaccccctccctgtatgtgggagtctcccttaccacagtgttcacgtctttgccgttgcagagaagggtttctggagagaagtcattgtctgatgttatcggcaggaatagcagaggtcactggggaaaattgcaaaatgtcaggagaccacttaacctcccagtttccttagattctagctgttggtggtggcgttttcattgttgggcaaaatttacatttaaaaattggccttttttgatcaggcatggcggctcaagcctataatcccagcactttggaaggccaaggtgggagcattgcttgagcccaggagtttgcgatcagcctgggcaacacagggagaccccgtctctacaaaaataataaaaaaaaaaatctactgggacatggtggcgtgtgtctgtggtctcagctactcaggaggctggggcaggaggattgcctgagcaagggagattgaggctgcagtgagctatgatcccaccactgcactccagcctgggtgacagagggagactctgtttaaaaaaaaaaaaaaaaatcaccttttaaccattttaaagtgaacaattcagtggcatttggtacattcacagtgttggacaaccgtcacccccacaaagaagacccccatttcccatcctatccccatgccctgttaaccacaaatgtaccctctgtctctatggatgtgtctcttcttagaatttcatatacaagtaatcatataaagtatttattttctcaggctgccgtgacaaaggtccacagactggttggcttagataacatcagcttattctctcacagtcctggaggctggaagttcaagatcaaagtgtgggcagggctggttcctcctgaggcctctctcctgtccttgtagatgccgtcttctccctgtgtcttcacagggtcgtccctctgtgtgggtctgtgtcctcatctcttcttcttatgaggtgtcttagtctatttcaggctgctataaaagaataccatagactgggtggcttagaaacaacagacattgattctcccacagtcctggaggctggaagtctgagatcaaggtgtctgcagggctggttcctcctgaggcctctctcctgggcttggagatgccgtcttctccctgtgtcctcacagggtcatccctctgtgtgtgtctgtgtcctcatttcctcttcttataaagaccccagtcctattggataagggtccactttaacgacctcatgctaccttaatcacctctataaagactccatcttcaaatacagtcacattctgaggtcctgggggttaggacttcagcacaggaatttgggagggacacaatttagctcataacatatggtaagtggtgtttggtgactggcttctttcacttagcgtgatgttttcaaggttcattcatattgtagcatgcgtcagcacttcattcctttccatggctgaatactttttcattatatacatacaccacattagtctacagttttaaaaatatcttccttgaattacttctaaagtctctggtacccggggctctttatttctctactctctatcgatagaccaatctggctcttgtaaaaatacatagcatcttttagtgtggatttaaataacattgtttcttcttggaatgcagatcacagtctagtcctatatcttaagcatatatttgttgattgaaaggcattggtcttcttcttcttattttctttctttctttctttctttctttctttctttctttctttctttctttctttctttctttcttccctttttcttttcctttctttcctctatctcttttttttccttttatttttaagacaggatctcattctgtcatccagactggagtgcagtggcatgatcttggctcactgcagccttgacctcccaggctcaagtgatcctccctcctcagcctcctgagtagctgggactataggcatgagcccccacacctgcctaatttttgtggtttttcttttgttttgttttttttttgttttttgtttttgtagaggtggggttttgccatattgcccaccctggtctgagctcaagtgttcagcccctcttggcctcccaaagtgctggggttacaggcgtgagccatcacactcagcctccattatcatctttctgtgggattatggaaaaaaaatgttgtacccatgggatcaagattggatatggtttagcttttaggagaacaggcacgtcttttttttaacctataagttttacaaaatttttgcaatgtattagacaaacaaaatgggaaataaattaaactccaaaatgtcacaatttggtcataaaataggtcaattttaccgtaagatatatattaatgggaggctgaagtgggaggatcatttgaagccaggagtttgagaccagcctgggcaaaatagcaagacatgtatctctgcataaaattttaaggccaggtgtggtggatcacacctgcaatcccagcagtttgggaggctggggaaagtggatcacttgaggtcaggagttcaagactagcttggccaacatggtgacacctcatctctactaaaaatataccactgggcgtggtggctcatgcctgtaatcccagctagtcaggaggctgaggcaggaggatcacttgaattgggaggcagaggttgcagtgagctgggatcgcaccactgtactccagcctgggtaatagagtgagaccacgtctcagaaaaaaaattaaattaaatacaaatttaaataaattagtagggcatggtagcgcacacctgtggacctagctacttgagaggctgaggtgggaggatcacttgagcccagggaatttaaggttgcagtgagctataactgcaccactacactccaccctgggcaacagagcaagagactgtctcttaaaaaaatatgaaacacattaaaattttacttaatctaaattacccattaattttaggtccttgataagaagaaattggctaatttttccattgaaatacatttttttctcagactcataaaactgtataccgagtgacctgtattcatttgtaatagttttgactaaagatatattttaaacttatgtttccatttgcttctaaccatcaatgcatataaggaaatagacagattaaagttttaaaaagatggattttaggtttaccagaaatagagtcaacttgacccaaaatagaatagctttgatccttgatcattgtattgagaatttttagaaactcacctgctgaattcttctttggtctgcagcacacctaatattgaccgcctggcaagtgaaggagtgaggcttacccagcatctcgcagctgcttccatgtgcaccccaagtcgggctgccttcctgaccggccggtaccccatcagatcaggtgaggcaataaaaaggcagcaacatttcagtctcaccagaatgcattctaatgattagtttttgcaaatctttataagaattctcaaaaggtcactcagagtattagggatctaaattcaaaggtggttgttatccctgggcagcttaaatatgtgtgcctctcaccaggtaccactgcacctgctcatctctgtgcatatagcgacagggtttaggcctcttgggggcaatttgccaacttatggtcaacactcccattttcaggtacttgtgctaagatttctcaagagacccctgatgtctttaagctagcagagaccatgcagtggttctgagataagtggatcaaatccacctctgtggatgagattggaaaactagacacagttgggaaaaaaggtataactgagaaaacaaaaaggaaatgaaacttttacatactcccttacttgaccccatcatttcaagatttagacttaccaagttgatataacgacaattaaatgtgttcctttgctgcttagcttaggatcaatacctacaaacatccactcaagatcaatattatgaacaacaatttttatacccagctaaaatatagtggtgcccttagacactattgaagtgttcatggttatcagactctatgtgaaatatcgtgtcatgctgttgcattttgtttaattctagtatttgcttgtcataattttagtatacctgccttcacagtttaatttttcagtgaaaaatttttctgtatgaattttcttcctcctaagtagtagattctcatccaatacattcaaggaatgaactaattaggttaatgagaattatactaaaattaagagtaaacattaaaagtttttgtcccataaatattgatttattattatctttttttgttgcctaatgaccttctttcataattcaaggttctccattttgttcaaaatagtttggtttctagataagcagtctctatataacacagtaccgtgtatgaagagggataaagatatgaatttgtatgagtttccaaaaaaaactacacttataatttcaggatttcaggattttttctttttttctttctttctttttttttttttttgagacagactcttgctctgtcatccaggctggagtgcaagggtctgatctcagctcactgcaatctctgcctccctggttcaagtgattctcctgcctcagttcctgaatagctgggattacagtcatgcaccaccacacccggctaatttttgtatttttagtagagatgggatttcaccatgttggccaggctggtcttgaattcctggcctcatgtgtgatccacctgccttggccacccaaagtgttgggattacaggagtgagccaccatgctctgcctaatttcagggaattttaagtattgattatggtgaaataaaatttatttttaaaaattaagaaaaaaattaggtgattggtggagagatttcaagtcattgccatgtgtatatttttaatcatttgacacaaacggttcagtttaattcattctacttatcaaaaatttcagcaaaacagttcaacagcaagataatggtctaatgcttcccttaataaaactgtttctctttcctatcaatgacactatctagagtctactttcttcttcttccaaggtaggatccttgaaatatacttttttcttttgagatggagtttccttcttgtcacccaggctggagtgcaatggcatgatctcagctcattgcaacctctgcctcccaggttcaagtgattctcctgcctcagcctcctgagtagctgggattacaggtgcctgccaccaagcccagctaatttttgtatttttagtagagacagggtttcaccatattagccaggccggtctcctgatctcaggtgatccaaccactttggcctcccaaaacactgggattacaggcgtaagccactgagcccggcctgaaattatcatttatttatttcttgctgatcttcacttgtggttttcttgtgaattccttttaaactataggtgtataatattgtccaccagtataaatctacataaaattatatggaggccaggcacggtggctcacatctttaatcccaacactttgggaggctgaggtgggtggatcacgtgaggtcaggagttagagaccagcccggccaacatagtgaaacctcgtctctactaaaaacacacacacaaaaaatagccaggtgtggtggcacacatctgtaattccagctagggaggcggaggcacgagaattgcttgaacctgggaggcggaggttgcagtgagccgagatgttgacactgcactccagcctgggtgacagagtgaaactccatctcaaaaaaaaaaaaaaaaaaaaaaaaaaaaatatatatatatatatatatatatatatataatatatatatgtatgtgtatatacacacacacacatatgaaaaagaaattgtcactcctacacttcttcatttcagattctcaaggatacttttaaaaatgtatttatacccagctaaaatgcagtagtgtcctcagatactattgaaacattgaaggttagcagcctctatatgaaaaactaacgaaggttatttgttgttagtctgaaattcaaatggatataactaagtgtcccgtatttattctggcaaccctaattccaagggaatgtttgcatttagcaagtgaaaaaaggagggtcaaggacgtacagccagaaagcaacagaaaacttggggaagaatggctttgaggaggtgcgggaggagaggactttaagcatgtcgggataaattcggtattagcaaagactatggtgctaacttattgacttctgtgaatttagggatggtgtctgcctacaacctgaaccgtgccttcacgtggcttggtgggtcaggtggtcttcccaccaatgaaacgacttttgccaagctgctgcagcaccgtggctaccgcacgggactcataggtatggcgccggaactctgcccgtggaaacgtgatcctgcagcctctctgtcatcgtgtctaaggtgtttccggggatgttggctttgtgcgcgccagtttgaccgacttctctttgagataagacacttggagaaggaaatgatcacacattgattgagcatgtgtagaatcgagggcatagtattggaaaaacaatgagaacagaaagcaaacaagtgtatccaaagttgccactaaaatggaatgttgtgttggagggatacgatgtttgtgacaccattattagcagaaaaaccagtaaatttgtagagaagtactgttgaaatgggaaacttacagcattaagagttgtcaaatggaggcaattgctggtcgacttagatcacttaatattctatgcccttttggcgggggtgggggtttggggcggggggacatgagcttgtgagggagcctttcaccgaaaaataagtttgtagaattccagtcctagaagatagtcctctaagaataacttgtgtgatcaaatccttttgggaaatgctactcaaaagcattgtacggtccactatttttgaggattcctaatgtgaattgtaagccacagctccgagatatccccagttaaaaaaaaggttaagaaattttctatcagtagggcatgtattcccatgcaactcccagcagcgtcctgtgagtgggaattctctagattagctttgagcagcgttcttacatcattagagcacgggattcagatctgactctgctattattcattaatgtgactcaggcttctgaataaatctagatagctgggcacagtggctcagacctgtaatcccagcactttgggaggctgaggcagaagaaggccaggagttcaagaccagcctaggccaccatagcaagaccctggatctacaaaaataaaatgttaaaattagctgggcatggtggcacgcacctatagtcccagctactcaggaggctgaggcaggagaattgcttgagccaaggagttcgaggctacagtgagctataatcatgccactgcgctccagcctgggcaacagagcaagactctgtctcttaaaaaaataatctagacaatgtgttttttattcataataaagggtctgggaagtgttgaatataataatgtgtgcggacaaatcagaacgtgacctggccccctagagtatgtgcttgataaaaggaattacttgcattatcagaatcgtttggttcttgatgaaattctttggctactttgtcatccctagcttgaggacctagaagaggtgttccatctatacataaaatctcggttacctttcagtgagatggaataagagggtcggaaggcactgctagataaaagcatgaatgtgcaaggtgcactgaaagtccttggtattgtccccaccaaacaaccaagacatcgattctgccctcctagcaagctccagatacctggaaagtttctcattgttcatgaggttgtttggtaccaagcaaaaggtttcttctgaatgaacactaggctcctctccttgtcgcaagcaaagaggctcctgctgcatggcttttgtctgaaagaggcatattgtagggagaaggctgttggtggcatgtctataccagggaggtatttggggatatcaagaaaaaaccatgatgacaacagaatgaaagttatatttgacttttccaaagggaagcccacattctagaaacagaccggcattgaatgctgccatgctgccatggtacgattttattttacttttaggcaaatggcacctgggtttgagctgcgcctctcggaatgatcactgttaccacccgctcaaccatggttttcactacttttacggggtgccttttggacttttaagcgactgccaggcatccaagacaccagaactgcaccgctggctcaggatcaaactgtggatctccacggtagcccttgccctggttccttttctgcttctcattcccaagttcgcccgctggttctcagtgccatggaaggtcatctttgtctttgctctcctcgcctttctgtttttcacttcctggtactctagttatggatttactcgacgttggaattgcatccttatgaggaaccatgaaattatccagcagccaatgaaagaggagaaagtagcttccctcatgctgaaggaggcacttgctttcattgaaaggtatttagccatttcttgcctgatttcctgcatggaaattttatttttatttcataggaggtcatcacaccttgataacatgggcctttaaaagtctcttggagagaatgtgcggcatttggctttctgttcctgtattaatttgcttagaataatggcctccagctgcatccatgttgctgcgaaagacatgatctcattctttttcatggctgtgtagtattttgtgggatataatgggagctaaacattgagcctccatggacataaacatggaaacaatagactgcaaacttctagaggagagagggagacagggagaccaggggcacatggttgcaagactacctattgggtgctctgcttaccccctgagtgcaatagacccacgtaacaaactggcacatggagaccctgtatcgaaaataaaagctgaggaaaaaaaaactttaggtgacatttgtgatagacttgagtctcctcttaggtagaattaaatagttaaatttcctgcaaattttgaatgctcaaaaggcaaaaaaacaaaaaccaaaacaaaaacaaaacataaaaacatattttgctcacctccccatttttaatgttttaattttttttttttttttttactttttgggacaggatctcactctgccacccaggctagagtgcagtggtgcaatcatggctcacagcagcctcgacttcccaagctcaagtgatcctcccacctcagcctccagagtagctgagactacaggcacctacaggatgcctggctaaattttgcattttttttttagaaatggggttttgtcatattgcccaggctggtctcaagttcctgggctcaagtgattcacccactttggcctcccaaagtactggggatacactacgcctggccacttacccctttttaaaaatgaaaactagagttgccatattttaatctatattgcttcagtgtggattgttatgtaaattgattaaacctggggggtaaaattttttttctctgtctcagacacagccggaagagctctctgtccataaactattggatagtggctctgtatttacagatacctagttttaagttttctgtgttcaacacaagctatgcaggcataactataatgagctctcatcatcccataccagctcactcctacgttacaaattattactattattatttggagacagggtctcactctgtcactcaggctggagtgcagtggtgcaatcatagttcactgaaacctcaaactcctgggcaccagtgatcctctcaccttggcctcctgagtagctgggactacaggtgcacatgaccacacccagttaattttataaaattatttttccatagagacaaggtcttgctatgttgcccaggctggtctcgaactcctgggttcaagcgatcctcctgccttgacctcccaaaatgctgggattacaggtgtgagccattgtgcccagcctgggttacaaatgaggggcacattaaagttgttggtgtggattctcattgacactgtttgtcaccttccttagtggggttggcagggagtggagaggggaggatatattgttactccaccaggctgaagggtatgcagtggaatatcattcactcatatgcccctgtgcccatcagattcattatttattccaacacaaccatgagaacagtgatcagccacccactcagctctccattcatcttacctgcccttcccgtcccaacccatttgcttgggctatctttttgggaatatattcaatctccatctccttcccttctttctatgctggttgtgaaaaatgtgtaaaggagtagctttagaatgactgcatgtgacattaaaatgcaaaacacaaggtcaggtgtggtggctcatgtctgtaatcccagcactttgggaggctgaggcaggaggattgcttcagcccaggagtttgacaccagactgggcaatatagtgagctcccatctctacaaaaaatgtacaaaattagccaggcttggtggcgtgtacctgtggtctcagctccttggaaggataaggtggaagaatcacttgagcccaggaggttgagccatgattgcaccactgcactccagcctgggcaacagagtgagactttgtctcaaaataaataaatacataaaatgcagaacacaaaaagcaagatgtaaatgaggggaatttatttctctcttggggtaggcaggctacagatacagtgaggttatcttgttctctgccatcctttgtgagcagcctcatggcccaaggtagatgccaaagctccagccatcagacttatgttccaggaaccatgaaggaggtggaagaaagaaagaagggaaaatggagagtaaggagcatcaaatccttactgtggcacatctgagtctgtccttaagatatgattcttctgaactcatacctaaaagaacactttgaaacaatagatgaggagaattcatactttttaacccattcaacaaagattaaaagatttattaagctgctactttatgtcagatgctaaactggacacaagagagtataaaatgaactgcgttaaacatttttgttgttgttgttaagacagggtctcactgcgttgcccaggctggagtgcagtggtgtgataatagctcacggcagcctccacctcccaggctcaagcgaaccccttgcctcagcctcctgagtagctgggatcacaggtgtgccattaagcacagctatatttttgtattttctgtagagacgaggtcttgccatgttgcctgggctggtctcacactcctgggctcatgcaatgctcctgcctcagcctcccaaagtgcaaagaatataggcatgagccactgtgcctggctacatgaaacattttactgggaacacaaatgttctgttatccttcattcctcctcatatcctttcaacataaatcttgtggtatttacgactcacaggagtggtattgtcatctaaagtacatagaaaacctccgccagctattatgagatcttttcatcagtgcagaatcgcatttaaatgatggaaatgacttcatatttgtgaaggtaattttggtaactttctaccccttaggtacaaaagggaaccttttctcctctttttttccttcctgcacgtacatactccactcatctccaaaaagaagtttgttgggcgcagtaaatatggcaggtatggggacaatgtagaagaaatggattggatggtgggtaagtattcagtaacagaactgtaaatatctgaagtacgggctacagaaaaacaaatctgtactaactgtctcaaattatgtccagccccttgcatagcatagatacctgaaaagtatctgtttcatcccttaattggattaaaagctggcttttaattgttcagcaataccagtgaaatatattccccaagataagtcacagtttgtaaatacaagttttcccatctttaaaataaagacagccacttttctgaaaaactcattggcaagataaagaaagctgcactgtaaagtatattgtaattcctggccgggcacgcagtggctcacacctgtaatcccagcactttgaaaggccaaggctggcagatcacttgaggtcaggagttctagaccagcctggccaacatggtgaaaccccatctctactgaaaatacaaaaattagccaggcatggttatgcgggcctgtagtcccagctgctcgggagggtgaggcaggagaatcacttggatccaggatgcagaggttgcagtcagccaagatgagaccactgcactccagcctgagtgacacagcgagattctgtttcaaaaaaaaaaaaaaaaaaaagaatattgtaatttcaattcccaattattttgatggatataaaagggaacgttattctgattagtcagttctacaggaaatacatagaaaattgggatggggatttaacacaactaaagcaacttatttcaaaggcatagtgttcactataaagaaatgctaaggataataaatgagcaggtgggaagagttactgtatgcattccagaataataaatagctgtgctagttgaattgcatttgcccacccccgcctctatgtacgtgacagagttgtccttcctctcagcgatggtgtttcattttggaatacagtacttttcttcttcttctgagtgcaaacttctgaaaacggtgctctgccgaaccattgaaacgaacaatctcccagttatcagccgcctctgttgacttatatggagtgcctttgaaagaaacagagctattttaatttaaatgcatttaaggggtgttaatcaatcacattttattataaataactttcttttctctgaaaaccaccatctaagtgagctataaaatactagttaaaattactgaagaactagtggtgtcggataggacaaagaggggaatcttgtcatgggataaatttctcttgtatatttccactatgtgtgtttacctctaattataggtaccattgtaacatttactgtctatatttaatcccaaagaggagatagaatacagagaggggccaggcgtggtggctcatgtctgtagccccagcacttttggaggttcaggcgggaggatcacttgatcccatgagtttgagaccagcctgggcaacataccaaggctccatctctacaaaaaaatacaaacattagccaggcatggtgtcacacgcacgccttgtagttccagctacctaggaggctgaggtgggtggatcacttgaacctgggaggtgggggtagcagtgagccgagattgcaccactgtactccaagaccccgtctcaaaaaaaaaaaaaaaaaaaaaaaaaaaaaaagaggccgagtgcggtggctcacgcctgtaatcccagcactttgggaggccgaggcgggcggatcacaaagtcaggagatcgagaccatcctggctaacacggtgaaaccccgtctctactaaaaatagaaaaaatgagccgggcgcggtggcgggcgcctgtagtcccagctactccggaggctgaggcaggagaatggcgtgaacctgggaggcggagcttgcagtgagccgagattgtgccactgcactccagcctgggcgacagagccagactcagtctcaaaaaaaaaaaaaaaaaaaaaaagaatacaaggaaagtcagtgctgccaggctgccagtaaggcatttaagcagaaatggggagaaaaaaggaatgtgttaaagggaaaaacttatgggcttagttaaagggaactaaccctgacatccaaacccttttgaagcttgctgaactaaagctaagctctgtatttcttaatttaatctttgctgtgggatgtgtatgtgtgtgtatatatatacacacccagctgcagttattttatttgcacggtataaattacaaatcacttttatgcataatactatagtcagatttaatatgaattaagctatatacacacacacaccatatgttatatacatatatatatacacacaccccatatggtttatatgtatacacaagttatgttttatacatatacacacatagcactgtatgttgcatatatacacatttattatatatagtttaattccttggtaacgaaatacaaacactgaaaggtgttacagttaaaaatagctataacactgtagcctttatggaattatataattgggattttttttttttctctgcttcttttgaaatcgcttactatagttgtacttagtcaaaggacagtttcccgtaaagggattttctgttaaagtctatatctgagtgtttatcactaagaaataattatgtttgttttacagtatatgtaaatacatgatgaagacgtgttacaaaagctagcaattgcattattaaatggctaatattatttgacacaggagaaatgatgagtagctatttttctgcgtaacatctcccaaatattctgagttttctccgtcatttcttataaaaattctaccaaaataaagacatattgaaagtcagacaggtatctctgtgggtattattttactatttaacaatatgagtataaaactcaaaggtttagtaacttattaactttactcaaaaataagccataacaatgctatactcatgcaaatgcaaatacaacgtgcaaaatgaacttaatgaatcttcgggaattcagtaacattttaaactttccaatgaaagaaacttgtgcctattaaaaaacacttttagtcctttttttttttttttttaagacacagggtctcactcttttgcccagtctggctggaatgcagtggtgcgatcacagctcaccacacacttgacctcctcggctcaggtgatcctcccacctcagcctcgtgagtagctgggactaaaaatgtgcaccaccatgtctggccaatttgtgtgtgtgtgtgtgtgtgtgtgtgtgtgtctctgtgtgttttgtagtggagttttgccatcttgcccaggctggtctcgaactcttgggctcaagcaaacttcccacctcggcctcccaaagtcctgggattacatgtgtgagccaccaggcccaaccttaatcacttttcattattggtttctttccaggtgtctttggtaggaggtcttataagtgacctattaccattagtatttatatattcatatgcatctgtgtgttttcactttagacactatacagacaattatttgcaaatatatttgttctggaacagaaaaagaatttgcagctactatatttgcacagtataaattacaaatcacttttatgatttttttatactatagccagatctaatgtgaattgataatttacatataattatgctgttcccagaaagcctttacaatctttcatcttacaaaccctgggctttaaaatatcttaatttctaattatagcatttctaaaaaatagtatatgtcacttctaaaacaaatcactgagtttacgtataaacagttttctgtgcagctagttaagctagttacattttcttttatctttgaatgggacaagagcatagcacagagatgatctagtgtaaactagaaatgcagtgtgacctcaggcccaggacgatgttatctgttgattagcaaatgctcaacagacatcagaaaggaaatgaatgttgtttggaattttgctagaacagctttctacttattattttaaaaaactgtcctcctgagggattgtcaacacattaaagacagtgtctgctgagtctagcgcagcattaattgtcattagatcttaaccataacccaaacagcaagaataacctgcaatttccatgtagacttcagatagcagccaggacagcaagtctctaagggaggtggtgctgtgccctggagtacggggatggctttgctcatatgttcctggaggtgtcattttgcaaactgtatttttttaaattaatgttcatcggtttatttaactgctgggccttcttggcactgtctatttgaatcgtttggggcaatgatgaccttatgtattattacacgatttgtataataaaatagattttattatatattcaataataaaataatgaacacattatacaataaaattgtataataaaccagtactttatatattgtatatgaactattctacattttaaattaatataattaatgtatctagtatatttaatataatttatataattacattaatataataaaattaattaaagtaatatgtgacacatatcattcaattatataaaataatatagtatatatttatataaagatataaatttatgataaaatttaatatattaattagacatatattataaaatttaatatgttcattatatattatacatttattacatatactcatattttatcttatagttaatatattttcctatgtcaataaacatatatttttacatattgcattgatatacaaaatactatataataaaataatagttacatgttattatataattacataacaatttttacacaatgataaactattatataatgatatgtttctagtattgtaaagtcatatggtataataatacatagtatgtattgattgtacatattacaatatattttgttctattccataattgattatattttaatatataacaattctttatgcatttttaatacatcatgttatatattaatatgtatttgtaagaaatatgtactatatatcatacaatatataataaatatataattagtaattcaaatgtataaaagtatgtattatagtaaatatagcatatattatacattattacattatatattaaatattttaactgctggatataatatatattatatacactatattacgtacagtttaaaatagtatgtattacaatattatatgattaattatacaatatcgtgtagtgcagaataacattgaaacgctatgtgtaataaatacatagtagcagatatgtaataaagcagtggtgatctgcatcaagaggtcaacgtctttgtgtctctgaccctctccaggtaaaatcctggatgccctggaccaggagcgcctggccaaccacaccttggtgtacttcacctctgacaacgggggccacctggagcccctggacggggctgttcagctgggtggctggaacgggatctacaaaggtgattgtgtgtagagaaccaacgcctgtccattttaaatcagtagtctctattggctttgtgtttgcttgaattcatttgccatgatgttcagatattttgatgtgagttagactcttattaagctagaccgaaaaaaaaaaaaagctgcaaattttggggcagtttccaagagcttcaaagtaaaatgtttgaagcaacgccaaccccaggagacagcacagcatctcaatgaccatctgtggcagatgtcccagcctccgcacgattgacatttgaggctggaggattctctggctgggggcatcctgtgccgttgtaggtgttgaacagcgtctgtgggctccacccacacatgccagtagcacccaccgcagagcagcaacaaccagaaatgtctcctgatattgcccagtgtcccctggggacaaggtcatttctaagtgagaagtgctcctttagattaatcctcacttggattctcagatgcaggtttttaattcaatcacaccaatgatgctattcattatgctttaactagtgttatgtggatcagaaaaaagagtttttcatttgactggggtgcctagctcctcatggccagcagattcttccagctcactttgatagacttcatgccgggttgttcaagaactccatggcacccactcttaggcatcaccaaaggcatgccaacagaaagaataatttaaaaaagaattctgcattcgctattttccccctacccgctaaccttccaagtaaaacaaaaaaactaaaagggtatcaaaatcgtcatcattataaaatcagaatgtttgaacttccttatatttcattaaaaagttctgtgtgtgtgtgtcttatatatgtattttcctggaggtataatcactatgtatataaattcaccgtattaattgtatgtaatataatatagaatcatatatattcatcatatgtgatatataatcctatatatagtcactatgtatatatagttactatattcattacacataacacatataatcctatatatattcgctatattcattatatataatacatgtaattttacatatttactacatataatatacataatcctgtacacattcactatgtatatatagtcattatattcattatatatacacacataattctatatatttactatatttattgtatagatcattatatataattttatatattcagtatatataatataatatataatactatatatatttactatgtctatagtcacatattaattatatatagtatatagaattctatatattcactgtatagagtatacataaccctacacatattcactatatgtactcactatattcattatatattacacataatcctatatatatattcactatattcattgtatatatataggattgtggatactggattatatattgtaaattaatagaagtgagctcctgaaagcattcacctcctctggcttgtcatgtggacttgctgtagtcataactgttaattagcaaagactaaattggtgctaaacctagtagaaaaagtgaggaacagatctgagtcaccatatatatgccatctaacgaagtgtgattattacagtcatgatgattctaacaactgtacctattatatattataataattattataattgcatgagtatgtgtgagtgtaaagcccctgtccttaaaaagcacacataaccctggaataggactggcaaaattgttgtgagcatttctcaggctttgggacaggatgcctgtttctcagggtgcttcctgtgaagcgatgaattcaatggatagagagatttagatctcctgggtaagcaatgggttttgttctagtctagttacacctcgcagctctgccccacaaagatacaggttattaaatacgatgaagaaaacatcaggatggctttatgattgtatgttaaaagcacatagatttggttcagtgagcttgtcgagtttttcttataataaagaatggtgctacttgggaggctcaggagggaggctcgcttgagcccaggagttggaagctgcagtgagctatgattgcgccactgcactccagtctgggtgacagaaggagacagtgtcttaattaaaaaaaataaaaataaaaaaagaatggtgccaagaagctgagctgcctttcaacactggttagactggttagatcagtgaatgtgtcagcagtgaattttacctcattttctgctagaggcttccggttttgtgtttctttgtaatgctgcctgtcagacaggtgcgcacgtagaagacattcaatgaaaatttcacataggaagagaccttttcctccagagaggttcctattttttcttaaagagtctagacatatggtcttgacactggcatttggcatagggccatttttctattctgtaacaaccgcctcagtctcatgattgatcttacggcaagggcttcatttttgttttgtgctcagaaacacccaaggggacttttgtctaagaagtgattctcaactctgcctctggccatttttctactcacactcctctctttcttcctctatatgggaaatcacggggtaaagttttttagcttgttcctcaaggatcattataatgtggataaaacctgtatttttcttttctttttctttttcttttttattttttggagacagagtctcaccctgtcaccgaggctggagtgcagtggcacaatctcagctcactgcaatctccacttcctcgtctctgatcccccgacttcagcctcccgagtaggtgggactacaggcatgcaccaccatggagtgcagtggcgtgatctcggctcaccacaaccttcgcctcctgggtttaagcgattctcctgcctcagcctcccacgtagcttggattacaggcgcccaccaccatgcccagctaatggttttgtatttttagcagagacggggtttcaccatgttggccaggctggtcttgaactcctgacctcaagtgatccgcccacctcggccccccaaagtgctgggattacaggcgtgagccaccgtgcccggccaatatggttgggttttaactcatctttggttgtgtcgtaatctttggttttaggtggcaaaggaatgggaggatgggaaggaggtatccgtgtgccagggatattccggtggccgtcagtcttggaggctgggagagtgatcaatgagcccaccagcttaatggacatctatccgacgctgtcttatataggcggagggatcttgtcccaggacaggtatggaaacagtgtttgctcctaacctagggtgatatatttgaacataagtggatatacttgataattctatgtgtgtgtgtatgtacatagtatattacttaattatcaatattctgcccatagggccagatgtctttctccccttggtgcgtggtggaatattttgttttcttcttagagtataccttaatatcctttgtcatattacacttatgcctgtgtgtgtttgactgttctcatggatgggatctgattctcatacatcatcacatccctcacagcttctagaccattatgcaattaagtgttaaatgattactgaataaaaacatgtatgcctagagcaggtgcggtggctcgtgcctgtaatcctagcactttgggaggtcaaggctggcggatcacttgaagtcaggagttcgagaccagcctggccaacatggtgaaacccccatctctactaaaaatacaaaaatcagtctggtgtggtggcacgtgcctgtaatcccagctacctgggaggctgaggtgggaggatcgcttgaacccaggaggtagagattgcagtgagccgagatctcgtcactgcactccagcctgggtgacagggtgatgccctgtttcaaacaaaaacaaaaacgaaaacaaaacacgtatgtgtaattgcatgtgtgctaaatgatattattctttctggtttgcactttgtctatgagcttatttttaatttaatttaaatttattttttttgagacagagtctcgtcctgtcagccaggctggaatgcagtggtgtgatctcggctcagtgcaatctctgcgtcccgggttcaagtgattcttctgcctcagcctcctgagtagctgggactacaggcgggcgccaccatgctcagctaatttttgtatttttagtagagatggggtttcagcatgttggccaggatggtctcgatctcttgacctcgtgatccacccacctcggcctcccaaagtgctgggattacaggcacgagccaccaggcctggctttgtctatgagctttaaaatgaacaaatacatcctgtgctttaacgatttaattccatgtatgtggggtgatatctattcattaaatgtgaagttttattggaatcaaaagggcgtaaatagcttaatttttccaatccacaacagtaactcatattgtcttgcaaggtatcaggataatagttctagctgttctcttcttccatgacctcagaaaatgaatgttttgtttctctttctttttgttataaaatgagggaaaaggagaaagttttaagaattccttcttccgccaggcgccgtggctcacgcctgtaatcctagcactttgggaggccgaggcaggcggatcatgaggtcaggagttcgagaccagcctggccaacatggtgaaaccccgtctgtactaaaaatacaaaaattagcagggcatggtggcgtgtgcctgtaatcccagctacttgggaagctgaggcaggagaattgcttgaacccgggaggcggaggttgcagtgagcagagatcgcaccattgcactccagcctgggtgacagagcaagactccatttcaaaaaaaaaaaaaaagaaaaaagaaattcttcctctttatctttcgcctccttctcttcctccccttccttttcctcctcctcctcctcctcctctttcttctgctataaaatgcgtgactgaaccatgcctctctcatcaccttctacacacccccttctctcccaagagtgattgacggccagaacctaatgcccctgctggaaggaagggcgtcccactccgaccacgagttcctcttccactactgtggggtctatctgcacacggtcaggtggcatcagaaggactgtaagtatgaaggctgtggacacgtggaaagacgataagggcccggttccggtctccttcgtctcctggcggaagctgcaccatgtgcagatattgcccagctatgatggttctttttcgctgagaaagccacataaacagtgcactgcagtaggattttattttattttattttattttgagatagggtctcactctgtcacccaggttggagtacagtggcgcaatctcggctcaccacaacctccacctcccaggttcaagtgagtctcctgcctcagcctcctgagtaactgggactacaggcacctaccaccatgactagttaatttttgtatttttagtagagatggggtttcaccatgttggccaggctggtctcgaactcctgacctcaggcgatctgcccacctcagcctcccaaagtgctgggattacaggcgtgagccaccgtgcctggcctgcagtaggattttagagagatgtgtttgtgagagagatttgtgcccaaagggttttattttaaatttttaaaatatttataaaatagagacaagatcttactatgtggcccaggctggtctcgaactgctgagctcaagtgatcctctctctttggcctcccacaggtgtgacccaccacagccgatccactcaaagcattttaacttagggaggtgagtgctgacacagacaaaccaatgccattgcaatattttcatgacttagatttcccgagagaaggggatatgccctaccacacaggttcacggtgggaagcaccagggcttggcttggaagcagaggcaggaaggaatgaggagcccaagcaacagcctttattattaggctttccaagggaaaggtcaggcagggcagggtgaacagcttcacactggtagtttgagtaattacagtaagtttggagcaacagagactgcccctagctgcctggtacccggtgctgggttgatttaggacagagaaaatatcagcttactgtgtgagagttagataaaggaggtggatgcttgcataggtagggtgtgttcctaagtgagttgttactatttgtattagtccattctcacgttgctaataaagacatactcaagactgggtaatttataaaggaaaaagtggtttaatggactcacagttccacatggctggggaggcctcacaatcatggtggaaggcacatcttacatggtggaaagcaagagagaatgagagccaagcgaaaagggaaatgccttataaaaccatcagatctcgtgagacttattccttaccatgggaacagtatggcagaaactgcccccatattcaattatctccacttggctctgcccttgacatatggggattattacaactcaaggtgagattagggtggggacagagccaaaccatatcgctatttttaggaatcagctagtcctgggaggagcagtctttccccaagtctatgaggcccctcaagctgtcaaaatactagcctggcacagtggctcacagttgtaatctcagcacttcaggaggccaaggtaggaggattatttgagcccaggagtttgatatcagcctgggcaacattgcaagaccctgtccctacaaagaaaaaaaaaagaattagccaggtatggtggcatacaactgtagtccagctactcaggaggctgagtgggaagtttgaggctgcagttggcaatgatcgtgccactgtactccagcctgggcaacaaagtgagacactgtctcaaaaaaaaaaaaaagtcaaaacattataggatacagaaaattaagacaacatgattaatgtgtgtgtgtaagtatgcattagcttgtgtgaatgtatacatgagagagagaacaagagagaaagagagactatgaatacccacagcttagggatgactgaagtaattattctagcaacgaggagtaaattcttcaacatgacctgccgggtggttgcttatctccaccttccttcctttctaacatcctagtgattgtttctgtcccacattcgtgctatggaagtcatgcaaacaaatataaattaacaaatagcatcgtttgccttagacctgtaaagaaaggtcttttggagtcattgcatgaaattccagaattcttacttggttggatttaactttatttgcaggaggaattttctctgatgggatcagtcacttgtggtgtgatgtatcttcattttgatgtggatagtcccacataaaacaattaaaaaaacaaaaataagtaaataaaaatctatgtttttaagattctatatgagtgcaggacatgatcaatgataaataaaacagccccgtaaacagcacaagcctcccaaatttaactatagaggattatacagtagaattttttgttattattttttctcatcataatttcagaagttgggagcatggggctgacacagtgctcagtgccacggtcatgggaccagggttctttttttctacttggccacctctgacatgctagctttcattcttgtgcatctcacctcatggttgcaaagtggctgcagttcctccaagcatcacacctgcactccatgcagtaaggagggaaaaaaccaaaggcggtaaagaatccagttagatgatttgatcctattttagtaggaaagcacagcttctctgcaagaccccaccagtagacttcggtataatcctcatttaccagaggctggggaatgcttatattttctatctaaaattgatctctgcagccaggcatggtggcacatgcctgtaaatccagctactcgggaggctgaggtgggagaatcacttgaacccaggaggcagaggttgcagtgagctgagatgttgccactgcactccagcctgggcgacagagtgagaccctgcctcaaaataaataaataagtaaataataaaaaatgaaaaataaaattgatctctgaaaatagatttggtaaccatttcatatcagaagaaagaagaaaggaagggagggagggaggaaggaaaggaaggaaggaaaggaaggaaggaaggaaggggaagggaagggaaggaagggaagtaaaggaaggaggaaaggagggagcgagggagggagagaaggaaggagggaaagaaagaaaagaagaaaacagaaatggaggaaaaaaggaaggaaagaagagagtgagaaagagggagggaggaagggaagaggagggagggagagacagaagagggagggagaaaaggataaagaatgattaactttgccaaattacttttgtcaatttcagatgtgaaagtggcatttagccttggatcatttttaattttgtttgtacctaatcagattgaggtagaattttaatttggtattcccagaattaccctattcccatctgggtcatcattattatctccaaatattctcatgacaagatttctaaaaatgtctgcaagtttgcagtgaaattgtgcattgttcttagagttgaagaaatgctactgttgctgtgtaatgctgtgcagaagagtattatcaatcactagaaaaagcttttgagaaaaacatctttaacgaaaagagtcctaaaatcaccacaaagatggtatcatacataatgcaacttgttttttaggtgcaactgtgtggaaagctcattatgtgactcctaaattctaccctgaaggaacaggtgcctgctatgggagtggaatatgttcatgttcgggggatgtaacctaccacgacccaccactcctctttgacatctcaagagacccttcagaagcccttccactgaaccctgacaatgagccattatttgactccgtgatcaaaaagatggaggcagccataagagagcatcgtaggacactaacacctgtcccacagcagttctctgtgttcaacacaatttggaaaccatggctgcagccttgctgtgggaccttccccttctgtgggtgtgacaaggaagatgacatccttcccatggctccctgagaccatgcggaccacgtgttacccaccacaaacttactgttacaatggtcataggagcagagctcacctgactgattcattccatttgggataaaaactgatggcccaacccattgttttatcctcagaaatcagttctttcaagagctcggtgaaattaaagtgggcccatataacagtgaacct

SEQ ID NO: 2949 - DNA, 25286 bp, human
ttgctgagaagcactccacaagcacacactctcgttattccactccacacaactgtgaaggaggtgagtggaaaattgttgcttttcttgtgttacagattttctttaaaaatgtgagggtgcaaagggttaatgcgtgttttatttttgaaatcacaaggttgctccaatgccatctccagctatgggggaaaggagctaccactgagcagggagtctcactctgtcacacaggctggagtgcagaggtgcaatctcggctcactgcaacctccaccttctgggttcgagcaattctcctgcctcagccccctgagtagctaggattacaggcacccgctgccacgcctggctaatgtttgtatttttagtagagatggggtttcagcatgtcagccaggctgctctcaaactcctgacctcaactgatccacccaccttggcctcccaaagtgctaggattacaggcgtgagccaccacgcccagccagcacatttccatttgaggctcatctcctcattatttggatttatgagaactcaagtcacagaggtagcattttatatgacccagaggaagggcaagcgggcccatcagcctctgcaaactagcatcggcagaccttggaaccaaggcaagggggaaaactataaatattctttaggactttgaaggaaaatgtgtgtgagaaataaaagtgaaataaagatttccctatgctccagttggtctagagcagagctatgaataatctaagaaggcaaaacagcactgcattacagcaggagagagatggtaaagttgacatatagaaggatgtatgtgtattcatatgtatgcatacgtgtgtgtgtgtgtgtgtgtgtgtgtgttggcagccgtgtaaactcattcaagtaaagtaaaaagaccagcctaattactcaattatggactgtctaactgatcctgatttcacaaagcattttctttgacaaacattaattgaaagcctgctctacaacccaccacaaatgaattttcctcaaaaagtattcttttcagtatgtcagtcttgtgttccagttactagggtacataacaaattatcccaaatttgttcgcaaatctgcaacctggacagggctcgtcagagataggttgcttcttttcctctccgtcttagctgagggaatttgaaggccaaggctggaatcctctgaagactcacatgtctagatgttgatattggctggctgttggctgagatctttgctagggctattggttgaacaacttatacatggcctctttgtgtagtgtgggctttctcacaacatggtggctgtccaacagccaatgttcagggaagaggtagaagccatttagaattttatgacctagcctagaagtcacatagcatcacatttgccacattctacttgttgggatggtcacgaagcctcactcaagtttaaggagataagaaatagacgctgccttctgatgagaaatagcaagatgctagaagagacatgtgggaccagaaagcttacagtaattcatggtctccactccggcaactcacagagtgatgatctatgatacattctattgcatcgtctaagacacaagtgcttgtgacaattgtggagccataaaaagagatgtaaccaccacccaaagttcccttagcacccacagatcatgagattaaaatagcctcatgagaaaaaaatcagttattatttctttatccactcacagcattagtacaaggcagctcattctgaaactcattagaaatcgtaacataacaacagatattattatctgagaagatatatccactatccttgaccaaaagaatttaaatggaaattttctacagcgtttctacaaaccactatttcctttctagcatgctggcttcgacagcagagcagtgattttcaatttgttatgtgctaaatattttaattacattttgaagtaagcagcattccagaaaagacaaatagtccaaaatgaggtaattaattcttgaaggtaaccatactaatatatgcatctttcatagcagaaattaattattctcaagacaactgtcttttccccttgtaaattaggacatttctcctctaattagttgaaaatgcctgtaggacattatcaccactgagctatggaatttccttcagcaggtaattccagttagaattgagaggtgtttgaaattgaaagcagagttttaggcttcagcttgtttctgctcagtggggtgcagaatcacaaatataaaaccatctacgattatgaagagccattcatcctgtatgcatgggtaagtaagtgtttagcagggtgacctggacaaggtaccagtggaaatatctctttctcatttatactgtcatcttttatcttgcaaaaacagctcatgctaagaatgcaggaatgttttccctgtgggtcaagctgcatatcatgctgagatcccaaccaagaaagaaagggcagtgtgttcactactgtaatgtgccacttagcgtgttactcagataaagttgaatctagaactatctaccagcgcttctttctgctcctcgaggaacaacagcacttctcctccttgcccccccaccccccacccagtgagagcagtagaatgaacaaggcagcttcagcccattgggaaagaataaagaaccctttgcctgtgtgttatcagcctcaatcatcgtttagcatgaactctgcagccccctgagttgttggtgaactcagaattggtcaattcaagggaaggaggaccaggccaattcactggcataaggcaacatccttgagagctggacacacacattcccagctagatccagcccaattcccaatgcataacatcatcataataataattagtgtttagtgaatttgtaattaatgaataaattgtggcaactgtccggttttttattctttaacaattgttttagaattattcactttagaattattcaccaaccaagtactaggtcattatacggtagtcaataaaggaagcatcatctctgcctcgtgggacatatatttcagtagaattatgtttattccactgaaagttatttatataaatagagatcaagtgcacaaccatttatttcaaaccaactggcagaattgtctcctcagttggttttaatgcaaacactcagagaccactggagttagtgtcagttttttaaaaaccttataaaatatctatttttaacaagatataatctcctgcaaagcaaggtgcagaaagctataatacctgcaagctgtcctcctacatcaatcttgttccaagataacagaagaagatgaagctttcagatccaagatttacccaccggggctgtaccaggttaaatgaatatagataagacataatctggaacaaacaaaaccacaagaacagtatgtactgtaggagtctgatcatgcaaggttcaaaaacagacaatgctaattcatggtgataaaaatcagaatagttaccctggttgtaggggaggatggtgactgagaaaaagcatgagagaatgttccaggacaccagcagtgtttctagttatccactgaatggtgtttacagatgtaagtatatggaaaaaaaatcatcaagctgtatagttaagatgtgtgtgctcagctgagcgtggtggctcatgcctgtaatctcggcactttgtggggctaaggcaggaggactgcttgaccccaaggagttcaagaccagcctagtcaacatggtgagacattgtctctacataaaaaaatttagctgggcgtggtggcatgcacctgtggtcccagctactcacgggggctgaggagagaggatggcttgagcccaggaggtcaagggtgcagagaatggtgattgcaccactgcactccagcctgggagacacagctttttttttagagtctctaaattttttttaattaaaaaaagatatgtgtgctttattatatgaaagttacacctcagtgggaaaaaaataaaagtgtagaatggaaaagatctttatgaactgaaatttccaggacatattgttcagtggggaaaaaaaacaaagtgcaaagtaatatctttataatatgctacccttcatgtaagaatgaaggagatataagaaaatagtcatgcatttgttcttttgtgcaaaataaacaggagagatgaatcagaagtgaatgcagctggttacttagagggggtgggtgagaatgaagaaggaatgagagaatgggagtgggggatcacagatggaggggtggagagcaggacctctctgtgtatgtgttttgtatgatgctgacttttagaactatgttatgcttcccttactcaaaaagtaataactaattaaaatcagccaggacagtggtggtggcagtagggcagagacccaaaatggaatttaaagagtaacaaatgagcccaactctattgcaaatgcataacacagacatgctaaaagaagaaaagaactgatctaaataactttgaaaaacaatattttgactacatactagaaggcttaaaagacaaaaagaaatgtgtacatatactgtgttctagttaatacatattcttttcaagtggcatgtgagttagcaatttggggactataaacatgcatacacatataagttagggctgagtgagttcataaatatgttgagggtaatgagggacagatgttttactgttgaagaattacaaatacaggggaaggctagaatgaacactgtgatgttagactggaatcagtgacagtataaactcatggtccttaatatataaacataaaggtatatacatataggtatagatggttatatgtgtatgtctgtgtattcatagatatactgggaaatagccctgttctttgagagggttaagaattgacaccacagtagcaatgagcatgccaagctcccagatcttgttttctaaatcccttctccaatacaaggaatgggggctccttggaaactgcttattcccagactgaggcaagggaaatacacaatgttccagcaatatcatatggtgcctaaaattaaggaagtatttagaaaatgatggggccatgtcaaaaggaattgacagttaaaggatctcccaatgggcaaatctggggacaactggagcaatagcagaaatagcaaaaagtactaatactaatgaattataacccatagaataaaatgattatccatgaattcattactactaaatcaaaggagaaggtataactctttcttatcatagaactcccattattcaatgtaaaagaaatgaaagaaatagaatatcaccatttgcatgtatcacagtaataactgttcttgaagaagccatcaatgactgttaacattagctggtgaaaaaaatatgataaaaaacaggacatttgtacactgtcaaagtgtctcctcacaatatttttttatttcaaaggaaaaatagtaactttacaatggagaatcctggcagacacagccttagccaactgatcaaggttaatatcgccagtaataaaacacagtgacataatcatgtgtccccctgataacatgcagaggacacaatatcaattccttggcattcttgcaaaaaaacatataacctaaatttaataatgagaaaacaccaggaaaacccaaattgaggggcattctactaaaaaatttgctagtgctctttgtaaatgtcaagaatataaagaacaaagaaaggctcaaattggaggagttagggagacaacacctaaatgcaatgtgaagtcttgcatgcactcctggaccagaaaaaggacattagtacaaaaattgaacaaaaacctgaagaaaatctgcaggctaactaatagtattatactcatgttactttcttagttttgatcattgtacaatagctacataagttactaacatttttgaaagctgggtgaagggtatatgtactatataaaggtaattactttgtactaaaatgtttggcaacatttttataagtctcaaattctttcaaactgagaagtaaaataatatatttttgctttatgcacatatttaacagtttttggagaggtaggtagtgtatctgaatggcacctctcaaagtcaaatcctgtaacttcaaggtaattgacaccatgtgacttcaaggtaattgcttacatcctctatccctgatataattctccatctgtgcagtatttatcataatcctcattttacagaagagaaaggtgaggcagtgaacacaaagtggccaccattgggtatatgatgttattattattagaataagggatcagggaatgtcataatgcaagtgaaatcatccgtttcaattattttttactaagaacttcctcaccctatgaagaatcaaaggaagaagccagggacacagtgagtgggaaagtaaaggaagaaagaagatggaaggagaagggagggaggctcgagagagggaaggaggagtgaaagaataaagactgcctccttactgtgataaatgtgatcttcagtatcatcaacattaagccttcaaacaaaaaaaataatgtaaggactacatccctttattcattcctttctataccagggttctcaaaaagtatatcttcacgctcatacaattaagaggataattgctaatgtataatttgaattcaccatgttacttaatcactgtttcctcattacatcaatcacagtaattgatcatgatgataacaaatccatttccttcaggaagcaaccccaatcttaacctcttttctaatactatttatggaatcaccctgcccaagttttgtgttttctatctgaaacctaatttagatagatagataaaatgcatagatggatgatggataaacagatatggatggatagatagatagatgaaatggatagatggatggatggatggatagatagatagagatggattaccgtcggatgtatacatgcataccatcattggaagagtcaaagaaaattcttcggtggagtgacaccccactaatacaagtacgacatgccaccaaaatcaaaactactgtactcaggaatatatctatgcattcatttgtttatctgcattatatatatatatataaattttttttcttttgagacagggtcttgctctgtcacccaggctggagtgcagtgctgatcatagctcactgaagcctggaattcctgggctcaagcaatctccctgcctcagcctcccaagtaactgggaatataggcatgcaccactgcacccagctaactttttgtagtttttgtagatatggggttttgccgtgttgcccatattggtctctaactcctggcctcaagtgatcctcgcacctcagcctcccaaagtgctgggattacacataacatatatttatttaaacactcagtatgtaccaggttctaggtgctgagttgaaagcaaggatgaaaacaaagtccctgctcccatcaagaatactttctaatggagaagacagatatataaacaatgaaatctattatggcaagtccagacaggtgacataaagaaaaacaggctgggcgcggtggttcacacctgtaatcccatcactttgggaggccgaggcgggcagatcacctgaggccaggagttcaagaccagcctgaccaacatggcaaaaccccatctctattaaaaatacaaaaagtaaccaggcatggtagcacacacttgtaatcccagctaacctgggaggcagaggttgcaggcaacagagtgagaccctgtctcaaaaaaaaaaaaaaaaaaaaaagaaagaaagaaaatgaaaaagaaagtgtgataagaggagagggatttcagagaggggccacgtgggagtgagtgaggtcaagaaaggtctcttgaaagaataaagacctgtatgattatcttggggaaaacagtgacaagtcacgaaactgcaagtgcagagacttggagactggactgactgtggcagcctgaggagcagagagaaaggcagactgcttgctcagagggagagaaggaatgggaagcacatgaaagggagacagcagccacatcatttgggatcttgcaggccatgagaccccatgtatatcaccactggacgtacacatgcacaccatcattgcaagactccaatacaattcttggctaggatgacacaggaacttgcaaaaacccatgggaaaccagcctcctgttttatctctggagtccacaggttcctaaaacccaaggcagcctggaaacaggagttacgcagagctggaaaccttggcagagagaaaagccttcagttaagcgagactctccagggcgaggcagacttttttttttcctccctgtttttgttgcttttcacatctggctttcttgtgttactttcagaccatccatctatgtttgtgtaaaagggtcagggccacatagcatggaaaaatgtagctttctctgcttatttataggcccaggccttttaaggcacagatgcccaaagatctccatccctacctggaagtggcaaaagggcaatgacagtggagccaagccagcctcccagagtgtccaaaccttatttaaagcttttttggagccaaggacatttccctgaatctgttccaaactagaatgaagatgctggtgaatgatatttttgcaaaatctgcaggctcaggaattgacagtcttgacatttacgttaaatatgaagaaccatttatgaatccttgttgcagaaggctgctgtcagcaagccaaaaatacagcataaagaataataataataaaacaaagctggcacaaaaccttgtttcctcttgaaaaggccaatttttagtttgatggcagtgactcttagaacccaaaaggaaaacaaatttctacccacacggtctgtgctgctcttctcctcatgttaattttatctcacatctcaaatacatagtcatttttttcctattgaaactgaaaggtgttcttcctattgaaactcaacggtgttcattctaaaaataagttgtctgtatttaattccataaatggtttcttcctggtgagtgctatttttcaagaatgttgcttgactgaagttataataatgaattagatacagtctcttgcaaaattcttttgagatacaaagtcttcatgacatggaaactaattgcccattagctttgttcacatacttaataaaatatttccatgaagataataatcatcaaacttctttgcttcatgctgttcgagagctagaaattccttttttgcccccagtcaagggctatgcacaacgaaaactcatcaaatgcaagagccactcaaatcagctagtatttttaaaaactagaccgcaaatacaaatccacctgatatctaactgaaaaacatgtccctaacattttctaaacacttcattaattttaggcaccatatgatattgctggaacatcttggatttcccttgcctcagtcccagaataagcagtctccaaggagccctagttccttctattagagaagggatttagaaaccaagatctgtgagcttagcatgctcattgctactgtgatgtcaattcttctttcaactgataacattcatcttcacccccacggtgggcagaacgttctaacaagtgcttctcactcctttaagtaggcaacatcctgttagattttttttttctccctatcttcttgcccaaaaaagatggagaagggggcaccaacatggtgtgccagaagcaggtggcagcttccctggaccaattagccattgattggtcagatactactctgcccacaaagccacctctcacccaatctttctttagctgctttaaaagttcttctctagatttctaaacaaagacattgttcatatcttccaagaattttatagttttagctcttacatttaggtcttagattcattttgagttaattattgtatacgatgtgaagtaggaatccaacttcactctcttgcatgttgagcatccagttgtcccagcactattcttttaaaagcctattctctacccaacttaattgtattgactctcttgtttaaaattaattgactacaaatgtgagggtttattgctacactcttaattctattcaattcatctacatatttacctttttaccactaccacattgcctttattactataataagttttgactgtaagttttatagtgggtttagaaatcaggaagtgtgactcctccattttgatcttccttttcaatattgtttcggttattctgggtttgttatattaccagatgaatgataggttctgcttgtctacttctgcaaataagccagctgggattctgatagagcttgcactgagtctatagatctatttgggaagtactgccatcttaatgttgttaagtcttccaacccatgaacatagacatgggatgcatttccatttatttaggtcttctttaatctctttcaacaatgttttatagttttcagagcatacattttgcacttcttccgtaagattcaaaaatgctacagagaggaaatcagcaaggaatcaatggccatggggtgggggagagttagtgggacagagttctgttgtgactaactcatagctttctgccttgagagaatgcaaagatggtggtgccattagctacaccaggtgttttgtgaatgaaggagggtgaagtgggtgtcagaaatactgagtttcaggaagtgcctactgtgggtggtagtgtcccctagagtggctttggtatagaatttgagtatacatgttcaaggggaagccttggatgtggctgagatcacctggaaaaatgagaaaaccacagcaggaccaacatgcacaaagagacatgagtcagtggagaggctatacaggactaaggagcaagacagcagcaaaacccagtgggtattttgtcagtgtagctaaaataagagaacatgtcaagatggggtgtcgagaggaccctcaggaaggccagcaggaatcaggctgcatatgggggcccaagtaagcaggctgctgtctggtctgcttgccagtctgtgaacaccaagaaggcaactacaagagtagcccatctttacagcaagtcttcacacagcatggagggaggggagctgaatcagtggacacattgcagggacattaagtgagtcctggcccaacaagaagcagatgtccacgtgggattaagaaaatcaagatggtttcagagagaacacctctgtaaaagaaagggcaatgcaagtctgcccccacttgaaggataaagggagggaaggttggaccgctcttgactgatacacagactaagacaggttccaggctaccccaggggagttgtcaagccaatgtcagtcatattgggtcgctggctgggattagtcagtgagaaacatggcctctgcacccctgcaccaacattgcaagggactgcagagcacagtagctggggcccttgatcagttatgcgccctgcacttggagtctgccagattccgattcaaggctaccacatacatcaatatctggtctgggttttcctatgttgctggagaactcattagtagatgagaggtccctgtgtactctggaacaattgagagaagctgagcaaagacccaagagatgacaacaaacaaaagccaagaataaagaaagaaaattatgtttgaaaaggaatggagccttcatgcatgcctttctttcctcagaatttttttttttttttttttttttgagacagagttttgctcttgttgcccagctggagtgcagtggtgcgatctcggctcactgcaacctctgcctccctggttcaagtgattctcctgcctcagcctcctgagtagctgggattacaggcgcccaccaccatgccaggctaattttttgtatttttagtagagatggggtttggccatgttggccaggctggtcttgaactcctgatgtcaggtgatccacccgcctcggcctcctaaagtagaaaattacattttataccttctagaccaaacaccatgaaactaatataattaatttttttctcctggtagacttgaacaatgaattgggctaaaattatctcgccaacaaaatgcacacaataaaatgagaagagggggaaaattgcacctgattctttctagcacatatcctatcagccgcagctaattaactaaaggcccaattacctactgcgcaaaaactgtaaaggagcagagaagcctattctatgcagaaaatcttcatcataatgaaatcattagcttcaagaggaaaaagagttgtacttcaaacttgggaagcgagaagtgtctgatggcttgtcgaattacaagtttctattctacttgtggaaaaaaatattctgttaatgtgttttatgtgtcagatgaaaattgtatcacctagcacagcctgtcttacattctggaaattaatgttttagagcagggggattttttttcaacccagaacataatgtatgctttgacaaatgagctctcacttttgtcaataatattcaaagagtaagtagcaataggacagaggcagttctatccatgagagaacagccaggcatgctttattgcagagaaagaaagggaaaacagaataatattctgtacaagaaaattaagtttcaaaagattcaaatgtaatgtgtcaagaaactcttatttgcaagtggaatttaaaaggaaaccaaacgaaatgatggatgcatgtttcagcctcataagaggacattctcttctcctctttccttataaacagtatggatctgggcccactgctacaaccatcagacttccatcacagccagcatttgtgtttgaaagttctgtttcatcttccccacaccctgaccctccaaaaagttcagtaggaaatcatcctgggatcaggagagcatcaacagtcgctgttcctggtggttccagccactccccaccccctgtgcaaacaggctccagagctttgagttcttcattccccggggccctctctctccaccaaaacctcacagctttacatcccgtcccataaggaccaaatcccagctccgatataattagctccagccacagaatagtatgccgtaagttacacaaagatcatagctgtatacaaaccacatggaaatgtcttccgtacattttaaagatcttttccacatagcacagccttcttgcagatagtataatttacttatttgttattatcacatattgtctctccctctgctagcatgcagatccatggtcctgggggagctctgtatgctttatttgatgatctacctatcccacgccttcaagcagtgcctgggaatccctggcaacaggtgctccatgaatacgtgttcgatcaacatgctgagtgtgcttaaggctttccatttttactgtacagactttttagtagttttgtttataaccaacatatatttgtgcattcatagggaattctgactgttaagattttaaaaaggaaataagagaaataaaaagcctgctaatgacagtgagataatctattatcctctatcaatatgacaataagtgacaaagtgaaaatagtcgattcagatctcaaggacagaatgtaggattcccaggtcctgtctatgttcatacagaagatgtttggggtcaagcagagcctttgctcaactccacagaggtggcttcgcctggtgtgatcctctggagaagtctccgtttcagcctctccccattctttgggtttcgagacactaaccttcttgacttaataggacgcggctcatattgggaacactgccaacatacaagtgaaatagattaaacaatagtgtgctgccctcaggcttctgaaactcagatctaatgaggacattttcgtcttcatacccttaatgacctcctgttgcccacgagagaaacaccagtttttcagggtgggaaacttgcatggctctccagaacattctccagccattcatctccatatcggggttttcaggtgacaaatccttcctacctcccttccttgggtcactattcctcatgctcttccccttcttcgtgaaaaagagtcacaaatatgtcattcagtttgtcataacccctaaggtcactctttgaccaaaagccattcactgaaaataaaaaatggcaacagctatgtaccaagcaccgggttgaaaaacaaaaacaaaacaaaaaaaactttcaccggaattatttcattgtaatcctccaaaaaattctgtccacatgattgtcagagtacatatagaaggaaacttatgctcaacatgtaataagtgtgcttcactcaaggacagatgaagatggcaaacaaacgcaggaaaagatgttcggcatctttagccgttagggaagtgcaaattaaaatcacagtgaaatgccactatcttcctattaaatgggtaaattaagaaaaaaagaaaagaacaataacaagtgctggcaaggatgtggagcaaccagacttccatatattgctggtaggaatgtaaaatagcaccgccacttcgcaaaacagttgagcagtttttttataaaggtgaacacacacttgccatatgcagcaatcacacttctagagatgcatttatacaagagaaatgagaacttatgtccacataaagactcaattgcaaatgtgtacagtgactttatttgtaatcaccaaaacctggaaacaaccctgtgcccttccactgagaaatggacaaacattcaacagtaagtacatccatacaagggaatctacccagcaattaaaaggaaaggctagcagggtacagtggctcaagtctataatcccagcactttgggaggccagggcaggaggactgcttgaggtcaggagtttgagaccagcctgggcaacatagtaagaccttgtttctacaaaaacaattaaaaattagccaggcatggtggcacatgtctgtagtctcagctactcaggaggctaaggtgggaagatcacttgagcctaggaagtcaagctgcagtgtgctatgatcgcaccactgcactccagcatggacaacagagcaagaccctgtctctttaaaaacaaaaggagagagaaaggcctactgacgtatgtgacaacatggataaacctcaaagacactgtgcctaagtgaaagaagccagacatgaaagcctcatactgtctgactggttttatatgagattttgggaaaagtaaaactacgaacagaaatcagatcagtggttgccagaggccaggatgggggcaaggacagactacaaaggaatatgagagaatttggggaggtggggggatgacggaactgttccatatcatgattgtgatggtgattgcacaattatactggcttgtcaaagctcaccaaactatacccctcaaacagatgcattttactggatataagttatgcatcaataaaacttagtgtaaaaaataatcaatcaatcaatcagaagaaatacaagcacctcatcataggctataaggcttatgaatggtcaagctggagcttactcttgcaatgtgtctatttatctatttacaaattacctccaagtgctaatatcagtaatatctcaaagcacatatatgaggctaggaaaatagctatcattaatgaacttagacataaaactgcatttcaaatagtctcttgatcattttgattttttttctggtcagcttcttgccagacctgatgaagacaatgtttggacctctcaatacagtaaggaactcacatcaggaatacaaattgaccactttcttgtggtcacttgtgcttggagtattacccttaccttcagcaggttgcacatcttcaaaagtctttttaagctatttacctatgctgtgaaggtaggttttacataaactcgatgtcatctctgggttcacatgaccatacctgggtaaggcacaatacatgccaatatgtgggatactgtggggtgccccactctgcccttggattaattcttatttcatttctgacttgggacatttggcacatggctgggtgtgagcaccagtattgctctgtatagacattaataatgccaaagataaagactgttaacatttattcttttttttttttttcttgagacagtctaactctgtcacccaggctggagtacagtgacataatcacagctcactgcagcccccacctcctgggctcaagcaatcctcccacctgagcctcccaagtagctgggactatttgggaggcacaccctaccatgcatggctaattttttatttttagagatggggtctcactatgttgcccaggctggtcttgaactcctgacctcaggcaatactcctgcctcggcctcaattctttgttttttttgttttttgtttttttttttttctgagatggagtctcgttctgttgcccaggctggaatgcaatggcgtgatctcggctcactgcaacctccacctccctgggttcaagcgaatctcctgcctcagcctcttgagtagctgggattacaggcatgtgccaccacacccagctacttttagtatttttagaagagatgaggtttcaccttgttggccaggctggtcacaaactcctgacctcaagtgatccatccgcctcggcctcccaaagtgctgggatttcagacctgaaccaacacgcctggcctcaattctttattcttaaaaatgttctaatattttcttcccacatggaacaaattgctaccaacaccgcccaaattatattcagtcactatggaggcctctactcctattggcctcctctccctgatgcagttataagacctttcacagacgtgagtcctgtggccagtcttacataccatactggatccatcagatctgacattcattggtcactacccttttcccaattatctttccatcattgaaagcaatcttttttttttccctgctattgtcattttaggacatttcttcaagaatgacatttgtagaacatttccagaacatttccttaagaataatgttcagaaaaaaaaactacagtataggtttttttgtggacttctggaagcaagtgcaaatagtaggcaaatctcttcaaggttactgatgtcctcaatcctacctttcaaggctggcagtcctgcagtttcctttcctaaaactaaatggagtgtggaggctgtccccctacctctagtttcatgtccttcattgtgtcttgctcattaaaatccagggacctgtggttcatgcatgtaatctcaaaactttgggaggccaaggaaggaggatcacttgcacccaggagtttgagaccaacatgggcaacatagggagactccttctctaaaaaaaaactaaaaacttcgctgggcatggtggcactctcccgtagtcctagctactctggaggctgaggtgagaggatcacttgagcccaggaggttgaagctgcagtgaaccgtgattgcaccactggactccaacttgggcaacagagtgagacgactttgtctggaaaaaaaaaaaaaaaaacctcagggacccacccacagtcacctcctaggtcaggcctatttgcggtttcccactgctgtgtttagaccttgacattttctgtttactttttaagatgctgggtgtatgcctaagcctacgatgataaaataggattgctcaacttagcactattgacatttgggcaaggtgattctctgtggagggatacatcctctccactacaggatgatgagcagcaccccagcctctacctaccagataccaggagcaccctctacccatttgtgacaactaaaaatgtctccagacgttgctaaatgtcccatgccataaagttacccgctttacttacaagaagcaccaagatcctaacaacttgggctgctgtaaccagagaataactaccctattgaatttgccaacaaattgcaagtaaccccttgcggacaaaaatttcttagtgtaagggaagtattcattttcctagagaagacgagaaattcttcctttctcacaagaaaaggaaaaatgacctgcaggcatgtgctctgcttctctcaagaagcgcctccgaggcggaggttgcagtgagtcgagatcgtgccactgcaccccagcctgggtgacagagtgagatcctgtctcaaaaaggaaaaaaaaaaaaaaggaaaaagaaaaagcacctcctaaagccctctgttccttcttcgccaacattcctcccagagatgagggctccttctcacttccacatgcaggggacaggtgggccacacccaaaaaatccttccatcttcaccccatctgaactgtagagataacaatgctaagtgccagccaggcacaggagctcatgtctgcaatcccagcactttggaagcctgaagtgggaggatcacttgaggccaggagttcaagaccagcctgggcaacatagaccctgtctctagaaaaataaatgaacaaataaataaaaataatatttttcaaaaaatgctagtgcctacccagggatgtaacaaggattacacgagtcattatattagagcatttgtaaaagcactattacatataaatataataggataacaccattatggccagaaactaccgggactcaatgactctatcacactctggctttgcatccaccagagtttactaagcacccgcaccatgcagacactgtgctaaaccagtgtcactgcattcaagaaggttctagtctgtgaggagacagggatgatgaaagtttagacaaggtgcagacatcggtgggaggtggtgcccaaacttttctggaagagtcggggagggcttcctgtaggaggcagtggttaaactgagacctgaatgacgagagggaattttccaggagccaaggagaatgaagagcatttcattcagaggtaaaaacaatgggtgaaagtccaagggcagaagggaacatgacattttcaggaaattaaatttccaaatcaccatcaaccaaaaatataatcaggggagttacagaaaagaaggccaaagagcaagttggggccagctgacatgcagaagaggcaagatcagccaagtccatgggaaatgctaggtcaaacctaaaggagtttaaagtgtcaaaggtggtggtgagtttccaaaaggaaagatcataagcagcagttctcagatgtcggtgatgatctcggaagtccagggttcagggttctgaaagggatctgggttgggaaacactgctgagagaatgacaagtcattaaagactgattagataaaggaatttcatcatcaggtgtgcatgtgacagatgtcactctgacctgaccagcatggagggactggacaggataggccctgaggcatggaaaacacaagataccctggcaatatcccaggaagggaaaggctaaacccaggcacggccatgggcggtgggcatggaggggctggaatgcctcagagagacactgagacggagaggaacagagacaccacatttccaccttaagcagcaggtgagatggtggaaccatccagagggagaaatcgtaggaagaaactggtttgaggaggaagacaaggatttccagttaagtgcatagagtttgaggtgcaagtgaactatcatgagtatatgggggtggaggctccagagacttggactttagatataaattaaagagtcagtgatcaagaactgggcagaaactactggcatcaagtggttctcaggatcacctggggggctgcttaaaaccccgagcttctgcttcatggggtcccaggtgatgctgatgttgctcatctgggaaccttactttgagaaccacagctctagataaaagaatcctgccctttctcctctactttggacagaaatgataggtaaggaaagcataaatgtttcatctttttctctctctggcccttgaactccagaagatgggagtacttagtttgactgcattcttattccaacttcaggagcccaaatctaccacaatttgccaaatattagaagagtatggactgtaagacacacctgtaatttgagtaatgctaagaaggaaaaacagataccaataattatgagatgtggctgattgaaagaagcattctgattttcaaaatatgaaaggctggaaaatgtgcattttagaattgaccaaaagtggtcttccctgtcctctggggccaccctggaaaagtccaagcagaagcctgtgcaccagcaggagccaggatcctggatcttcctgcttttttgcctgtggtatataccaccacatccacaggaacctgccacacacaagggctttgctccccataagatctcccagcaacagggtccttcacccaaaccttccaaaagtgcctcatcccacattcccagattctgcagaagctctcaaaactcatatgcaaacatgcaaggacatttaataacaactcctgcatttcccactttcacccatgattacaagtagtcatacccagggtgttcttgctcagagagcctactacagaaaagacccaattaagaaacaccattggccagacgcagtgctcacgcctgtaatcccagcactttgggaggccaaggcgagcagatcacttgaggccaggagttggagaccagcctggccaacatggtgaaaccccatctctactaaaaatacaaaaattagctgggtatggtggcacacgcctgtaatcccagctactcgggaggctaaggcatgagaatcgcttgagcctgggaggcagagattgcagtgagctgagatcatgcgactgcactccagcctgcatgacagagggagattctgtctcaacaaaaaaaaaaaaaagggggaaggaaggaaggaaaagaaagaaagaaagaaagaaagaaagaaagaaagaaagaaagaaagaaaagaaagaaagaaagaaggaaagaaggaaggaaagaaggaaagaaggaaagaaggaaagggaaaggaaaggaaaaagaaacaccactgccaaaaccagcaaaagattaaaggaagcaaacatcctcattctactatttcccctcttatgcaggagaaatagcctgagttgcacatattaacccatattgtcttttttttctttccaaatttttaggttcaggggtacatgtgcaggtatgttacacgggtaaattgtgtgtcacggggatttgctgtccagatgatttcatcatccaggtagtcagcatagtacccagttgatagtttttcaatcctcaccctcctcctgccctccaccctcatgtaggccctagtattcattgtccccttctttgtgcccatgtgtactcaatgtttagttcccacttataagtgagaacatgcagtatttagttttctgctccctagcctgacaccgcccaatgtccacggccaaaatacttaggcaaagcaaaaagcacaaggggcctttgcacctaaaagacagtgtcttccattccagtctgaaagaaactccctggaaaaattggagcaaaatagctctgtccttcccagggtctcagaggcctcctctctccttggagagtattctgcctgtctccctgggctccccttttcttctcagaagtacaagttgaagggaatctctcaagcttcaaggagtgtccaaagtcaagcatctctgttgttgtcaagctgcaataatcatgcttccatctccaacatacccttgtaagaagaacactttacatatgttttacaaaatgtaaaaatggctatgtggaggtctagcagatcagaaacagcagaggccaagagtctacatgtcgagatcctttctggctctaaccccaaggccacgcttcctcccagaggacccacacctatatgtagctactgctaaaatgctctcacccgggcagctcctgacagagaggcccaattcatgacatgccattatcgcagcagacgaaatttcaaccaaaacaaatctgttatgcaaacagttaccaacataacttagaagggtattctgaaatgacaggcagggaaacctgacccctacctgaatatcccaggaggacgtccagtagtagcaaatcctccaagagggtcaaaattgcctgctatttttaaaacctgaaactttaaataattccagaccccctccgccacatgttgagcaatctgccagatcagttatacacatggagttgagtccaacaatctgccaaagaagggagtctcccaaatctggccacttctcatttccatatggaaagaattaccatgactgggcagagatggagggagaggggaagaggaggcgggagaggtggcgatgattccaaggagctgatccctattataccatgacgtgtgcagcatcgaacgtcgtcactgcaatcatcatttcacatatttaaaggaagccttcaggaaaagtttgttttattcttttaaagatagttaatacattcattggagtttttgtggttgttcttagtcttgttctcattctgtacataagagtttttttttggtttttttttttgttgctgttgcgtttttcgcaaatctgagagtaattagtcctttgcattcaagctctggtatttggaaaattcagcattcttaataggttgactttgagctacctttggaaattcagctccccaacatgcaggaaaattctgacacaacatctgttttccagtaagaccctgttttgacacaatttgatactcatttgcattgccccaggtgttggaaggtcaagcaatagatccaaggtcacactgaaaatgaggctcccttttaatttcctgcattcttcctgaatggtttcaagagtaaatgggttccaggaaacctgaggagaaagaatgaaatcactgcaagactatccaagcttcccatgtttggtttggttagaagacatttttaaatagagcatcattcacacggtcttcttctgagtttagataccacttttcaggttctctctggaattccgtaaaattttgcagctcatcagaatcatcaaccactctccccttgttcggtgcaattgccaagtctatttataaaaagcacatgctatctgaacacttgctactcaaagtatggtctatgaacaagcaccatcagcacttgctgggcacttattcgaaaagcagaatcccccttccccaacccctgatgtaggatgtcataaaacactgttcccaaagtaattgggatgcactgattaagccaggggacagcatgctacaagcctgcaggccaaatctggccactgcctattcttgtaaacaaagatttgttgaaacacagttagaggcattaatttgtctatgcttacttttgctgtaatggcagaattgagacatttcaacagagaaagggtggcccacaaacataaaactatgaattatctggttcttaaccaaaaatcttcactgacactgatctaaacctttattctacagggaggaagaggaaggatgaagaaaaggaagaaggaggaagaagggaggaaggaggaagcaggaaggaggaaggaggaagaagaaggcaggaaggaggaaggaggaagaagaaggcaggaaggaggaagaaggaagcaggaagaaggaaggaggaagaaggaaaaaggaaggaggaagaaggaaaagggaggtagaaagaaagaggaaggaagaagaaacaggaaagaggaagaaggaaggaggaagaaggaaggaggaaagaggatgaagaaaaataaaagcggaaggaggaagaaggaagcaggaaggagggagaaggaaggaggaagaaggaaagatggaggaggaagaaggaagtaggaagaaggaagatggaaggaagaaaaaagaagaaggaagtaggaaggagggaggaggaagaaggaagtaaggaggaaaaaggaagaatgaaggaggaagaaggcagtagaaaggaggaaggagggagagggaagtaggaaagaaaatggaggaagaggaagtaggaagaatgcaggaggaatcagggaaaaggaagaaggaagtaggaagaagaaaaaaggaagacaggaggaagtagaaaggaggaagaagttaggaggaagaagggggaaaaaggaagaagaagacgaaggaggaggacacactttttacacaaagttctgctaatttaacccttatgtgaaacagttaaatagcaactcctagtgagacagcaggcggaaagatttgaaggaaaactgttgctgccacaagggaagtttgatggcaggacttggagtgtgtatgcatgatgtactaattgaagcattagtacagtttctttgggggggtgtcagatgagtgtagaggaaccccctactctccacctttgcctagggcaatgtctgcatcagagattggtgccaacgtaataatcagcctcacagaaagttggattcagagtctggaaagatggaagatacaatctttacagcctatggatagaccctcctttccaaacttcagcgtttggaatcttagtacaatttctataccaaaggtgcttgccaaatgaaactctggatttacaacaaattgtgttttgaaaaatactgtatttgccaggcgcgcagcggctcatgcctgtaatcccagcactttgggaagccaaggcgggtggattacgaggtcaggagttcaaaaccagcctgaccaatatggtgaaaccccttctctactaaaaatacaaaaattaccgtggtggcaggcgcctgtaatcccagctacttgggaggctgaggcaggagaatcgcttgaacccacagggcagaggtcacagtgagccaagatcgtgacactgcactccagcctgggcgacagagtgaggctccgtcagagagagagagagacagagagaaagaaatatttaaattgctccagttcaaataagccggtaataagccaaaccacctgtctcatagagagctggagagagagaagggtcagcaagggaaatgataaaataaacaaatcactgctatgaaaatttatatggctcaccccgcctctgaaatgagagttcaaaatagaaatgcttgctccttaacacgggttatcataacgagatgcatttaatacatgagtttgctgg

SEQ ID NO: 2950 - DNA, 25286 bp, human; identical to SEQ ID NO: 2949

SEQ ID NO: 2951 - DNA, 11815 bp, human
ttgaaaagattgttgacaaaaggaaaaattaaaaagggaagacagagtatttggttcagtgaaaaggctacaacagcgaggacgacacttgggaaccagagcagcacctcgtgaactgtcaggaatacatccacgacttcaacagacaccacacggaaaggcagaaagagagcacattgaccagaacaaacaggtcctctcccaacaatgctaggaaacaaatctccagatccacaaacagcagcttttctaagtcctctcctaaggcaccagtgattgggagagatcacgaatccaaaaacagccagctgtttgctgccagccagcagttcaggaagaacacagctccgtctctctgcagccagatgaaaatggacctagtgaagtcaggtatcaagatcctcatgcctaagagccccattaagcaggacgcagtgaatggctttcagagtgagagctccaaaaaactggaccccacagagcagggtcaggaggaatggtagtacccaaagtggcagcggaaaagccagacaaagctttattgggccctggtactgagcaggccaggatggggagcaagcctggatacacctgctagtgcctcaggtgcatggccccgtaagtgcagccatggccacaggcctactcgttaacaggaaagctacatctacattcatggatgcattaacagccagtgggacaaccaacatacagacatctgttacagcagtaactgtcagcaaaaggaaatttattgacaacagaagagaacagccttttaacaaacgattgcatttcagtgtgaggcaaacagaaagtgcctaaggatacagagttattgtggccgggacaaaagatggcttcacccacatcttattcactagatcaacagggaataactcagtaaatacagctgtaatgaaaaaagtctaccagctctgacaaccactgctgattacagcaagcttgtactgctcagcgcctttaacagtgtcttctgttgtggacttgactttatttattttatgcagtgtttgacagatgacagaaaaagagaaagcattaaaatgggagaacctatcagaaacgtcgtgaataatctatggccatatcactctgaaagtgacagaaaaaaagaaagtgttaaataggcagaagctaacagaaacttcgtgaataatccctggccataccacccgaaataggcacgatttcttcggatatcagaagctaagcagtatctgccctgtatagtgcatggacacaaggaactttgtgaatactattactccgttcaaaaaacctgttactgaagtaaaagaagttatctgaaacatcatgaataatctatgaccatacgaccctgaatatgatacaaaaagagaaagcattaaaatggcagaagagaagctaccagaaacgtcgtacataatctacggccatagcacagtgaacgctccaatctcatctggtcactgaagtacagagtacacgagattgcgcccagggtacggcctcttcagtacttggatgggaggaacttcgtgaaggctatcatttcactcaaactgaatattattgaagcagtcactatcccagccattcgactagaagcatccgtattgcccctttatgatatggtttaggctaatcaaaagacttggtttccaacaacctcttctacctctgagcagattccagacagctgatttaccattacgtttccgaaatcatgggacgaccagctgcaagcgagacgatgctcagtgggttgaaactgatcacacagaaggcatttggcaacggccttctctcccagctgtttgggtcctggaccttcactcaggaaattggtggctcagatcaagaagcttgtctcatgtaatcgaatagtgctggaggaatccaaagccttggtgtgctgcaacatgaagagggatctggaacaggccaacgagagaacatgtgaagtactgaagaaaatctggggttctgcccaagggttggactccatgtgaaaggacttagaaaggaagatgaatgagtttcgagtgtcaggctgcacacggaccacatcgggttccagctgagaagaacaccattgcttccatctgtccttatccattctcacagcctgaaacaagctcactggtagcttatgcttgcaagcaggactgggaacattcacgctatttattcgggagtactgactccagaaagtacagcaaccttggactgctcagcgccattggtagggtcttccgtggtgcacttggccttatttattttttacgacatttgacagaggacagagagagagcaagcattaaaacggcagaagctactggaaacgtcgtgagcaatctacagtcataccaccgtgaacgctcccaatcttgtctggtctctgaagtacagagtagatgcgattgggcccaggttggggcctgtttcattgttggatagaaggaacttcctgaatgctttgttccgcttaagctgcgtattgttgaagcactcaatggcccagccattcgactaggagcatccgtattgcctctttgtgatatggtttaggctaatgaaaagacttggtttccaacaccctcttctacctctgggcagattccagatagctgatctaccattacgtttccgaaatcatgggacgaccagctgcaagcgagacgatgctcactgggttgaaactgatcacacaggaggcatttggcaacagccttctctcccagctgtttggatcctggaccttcaatcaggaaattggtggctcagatcaagaagcttgtctcatgtaatcgaatagtgctggaggaatccaaagccttggtgtgctgcaacatgaagagggatctggaacaggccaacgagagaacatgtgaagtactgaagaaaatctggggttctgcccaagggttggactccatgtgaaaggacttagaaaggaagatgaatgagtttcgagtgtcaggctgcacactgaccacatcgggatccagctgagaagaacaccattgcttccggctgtccttcttcattctcacagcctgaaacaagctcactggtagcttatgcttgcaagcaggaccgggaacattcacgctatttattcgggagtactctggataaatcatcccattattttggaaatgtaatgctaggtcaggtatctggaatcttcctggaggtagaagagggtattggatggaaggaacttcgtgaatgcgatcattgaactccagaaagtacaccaaccttgtactgctcagggccttaggtagggtcttctgtggcgcacttgaccttatttatgttttacaacgtttgacagaggacagaaagagagcaagcattaaaagggcaaaagctaccagaaacatcgtgaacaatctacagccataccaccgtgaacgctcccaatctcgtctggcctctgaagtacagagtagaggagattgggcccaggtaggggcctgtttcatagttggatggaaggaactttgtgaatgctatcatttaacttaagctgtctattactaaacaagtcagccgcccagccattcgactaggagcatccgtattgcctctttgtgatatggtttaggctaatgaaaagacttggtttccaacaccctcttctacctctgagcagatcccacatagctgatctaccattacgtttccgaaatcatgggacgaccagctgcaagcgagacgatgctcactgggttgaaactgatcactcaggaggcagttggcaacggccttctctcccagctgtttgagtcctggaccttcacttaggaaattggtggctcagatcaagaagcttgtctcatgtaatcgaatagtgctggaggaatccaaagccttggtgtgctgcaacatgaagaggcatctggaacaggccaacgagagaacatgtgaagtactgaagaaaatctggggttgtgcccaagggttggactccatgtgaaaggacttagaaaggaagatgaatgagtttccattgtcaggctgcacactgaccacatcgggttccggctgagaagaacaccattgcttccatctgtccttatccattctcacagcctgaaacaagctcactggtagcttatgcttgccagcaggactgggaacattcacgctatttattcgggagtactgactccagaaagtacagcaaccttggactgctcagcgccattggtacggtcttccgtggtgcacttggccttatttattttttacgacatttgacagagtgcagagagagagcaagcataaaaacggcagaagctactggaaacgtcctgaacaatctacagtcataccaccgtgaacgctcccaatattgtttggtctctgaagtacagagtagatgcgattgggcccaggttggggcctgtttcattgttggatagaaggaacttcctgaatgctttgttccgcttaagctgcgtattgttgaagcactcaatggcccagccattcgaccaggagcatccgtattgcctctttgtgttatggtttaggctaatgaaaagacttggtttccaacaccctcttctacctctgggcagattccagatagctgatctaccattacgtttccgaaatcatgggacgaccagctgcaagtgagacgatgctcagtgggttgaaactgatcacacaggaggcatttggcaacggccttctctcccagctgtttggatcctggaccttcactcaggaaattggtggctcagatcaagaagcttgtctcatgtaatcgaatagtgctggaggaatccaaagccttggtgtgctgcaacatgaagagggatctggaacaggccaacgagagaacatgtgaagtactgaagaaaatctggggttctgcccgagggttggactccatgtgaaaggacttagaaaggaagatgaacgagtttcgagtgtcaggctgcacaatgaccacatggggttccggctgagaagaacaccattgcttccacctgtccttatccattctcacagcctgagacaagctcactggtagcttatgcttgcaagcaggactaggaacattcacgctatttattcgggagtactgactccagaaaatacaggaagcttggactgctcggcgccattggtagggtcttccgtggtgcacttgggttatttattttttacgacatttgacagaggacagagagagagcaagcattcaaacggcagaagctactggaaacgtcgtgaacaatctatagtcataccaccgtgaacgctcccaatcttgtctggtctctgaagtacagagtagatgcgattgggcccaggttcgggcctgtttcattgttggatagaaggaacttcctgaatgctattgttcagcttaagctgcgtattgttgaagcactcaatggcccagccattcgaataggagcatccgtattgcctctttgtgatatggtttaggctaatgaaaatacttggtttccaacaccctcttctacctctgggcagattccagatagctgatctaccattacgtttccgaaatcatgggacgaccagctgcaagtgagacgatgctcagtgggttgaaactgatcacacagggggcatttggcaacggccttctctcccagctgtttggaacctggaccttcactcaggaaattggtggctcagatcaagaagcttgtctcatgtaatcgaatattgctggaggaatccaaagccttggtgtgctgcaacatgaagagggatctggaacaggccaacgagagaacatgtgaagtactgaagaaaatctggggttctgcccgagggttggactccatgtgaaaggacttagaaaggaagatgaacgagtttcgagtgtcaggctgcacactgaccacatggggttccggctgagaagaacaccattgcttccaactgtccttatccattctcacagcctgagacaagctcactggtagcttatgcttccaagcaggactaggaacattcacgctatttattcgggagtactgactccagaaagtacaggaaggttggactactcggcgccattggtagggtcttccgtggtgcacttggccttatttattttttacgacatttgacagagggcagagagagagcaagcattaaaacggcagaagctactggaaacgtcgtgagcaatcaacagtcataccaccgtgaacgctcccaatcttgtctggtctctgaagtacagagtagatgcgattgggcccaggttcgggcctgtttcattgttggatagaaggaacttcctgaatgctttgttcagcttaagctgcgtattgttgaagcactcaatggcccagccattcgactaggagcatccgtattgcctctttgtgatatggtttaggctaatgaaaagacttggtttccaacaccctcttctacctctgagcagatcccacatagctgatctaccattacgtttccgaaatcatgggacgaccagctgcaagcgagatgatgctcagtgggttgaaactgatcacacaggaggcatttggcaacggccttctctcccagctgtttggatcctggaccttcactcaggaaattggtggctcagatcaagaagcttgtctcatgtaatcgaatagtgctggaggaatccaaagccttcgtgtgctgcaacatgaagagggatctggaacaggccaacgagagaacatgtgaagtactgaagaaaatctggggttctgcccaagggttggactccatgtgaaaggacttagaaaggaagatgaacgagtttcgagtgtcaggctgcacactgaccacatggggttccggctgagaagaacaccattgcttccacctgtccttatccattctcacagcctgagacaagctcactggtagcttatgcttccaagcaggactaggaacattcacgctatttattcgggagtactgactccagaaagtacaggaagcttggactgctcggcgccattggtagggtcttccgtggtgtacttggccttatttattttttacgacatttgacagagggcagagagagagcaagcattaaaacggcagaagctactggaaacgtcgtgagcaatctacagtcataccaccgtgaacgctcccaatcttgtctggtctctgaagtacagagtagatgcgattgggcccaggttcgggcctgtttcattgttggatagaaggaactttctgaatgctttgttccgcttaagctgtgtattgttgaagcactcaatggcccagccattcgactaggagcatccgtattgcctctttgtgatatggtttaggctaatgaaaagacttggtttccaacaccctcttctacctctgggcagattccagatagctgatctaccattacgtttccgaaatcatgggacgaccagctgcaagcgagacgatgctcagtgggttgaaactgatcacacaggaggcatttggcaacggctttctctcccagctgtttggatcctggaccttcactcaggaaattggtggctcagatcaagaagcttgtctcatgtaatcgaatagtgctggaggaatccaaagccttggtgtgctgcaacatgaagagggatctggaacaggccaacgagagaacatgtgaagtactgaagaaaatctggggttctgcccaagggttggactccatgtgaaaggatttagaaaggaagatgaacgagtttcgagtgtcaggctgcacagtgaccacatcgggttccagctgagaagaacaccattccttccgggtgtccttatccattctcacagcctgaaacaagctcactggtagcttatgcttgtaagcaggaccgggaacattcacgctatttattcgggagtactctggataaatcgttccattatttcggaaatgtaatgctaggtcaggtatctggaatcttcctggaggtagaagagcgtattggatggaaggaacttcgtgaatgcgatcattgaactccagaaagtacaccaagcttgtactgctcggggccttaggtagggtcttctgtggcgcacttgaccttatttatgttttacaacgtttgacagaggacagaaagagagcaagcattaaaagggcaaaagctaccagaaacatcgtgaacaatctacagccataccaccgtgaacgctcccaatctcgtctggcctctgaagtacagagtagaggagattgggcccaggtaggggcctgtttcatagttggatggaaggaactttgtgaatgctatcatttaacttaagctgtctattactaaaccagtcagccgcccagccattcgactaggagcatccgtattgcctctttgtgatatggtttaggctaatgaaaagacttggtttccaacaccctcttctacctctgggcagattccagatagctgatctaccattacgtttccgaaatcatgggacgaccagctgcaagtgagacgatgctcagtgggttgaaactgatcactcaggaggcatttggcaacggccttctctcccagctgtttggatcctggaccttcactcaggaaattggtggctcagatcaagaagcttgtctcatgtaatcgaatagtgctggaggaatccaaagccttggtgtgctgcaacatgaagacggatctggaacaggccaacgagagaacatgtgaagtactgaagaaaatctggggttctgcccaagggttggactccatgtgaaaggacttagaaaggaagatgaacgagtttcgagtgtcaggctgcacactgaccacatcgggttccggctgagaagaacaccattgcttccatctgtccttatccattctcacagcctgagacaagctcactggtagcttatgcttgcaagcaggactgggaacattcacgctatttattcgggagtactgactccagaaagtacagcaaccttggactgctcagcgccattggtacggtcttccgtggtgcacttggccttatttattttttacgacatttgacagaggacagagagagagcaagcattaaaacggcagaagctactggaaacgtcgtgaacaatctacagtcataccaccgtgaacgctcccaatcttgtctggtctctgaagtacagagtagatgcgattgggtccaggttcgggcctgtttcattgttggatagaaggaacttcctgaatgctattgttcagcttaagctgcgtattgttgaagcactcaatggcccagccattcgactaggagcatccgtattgcctctttgtgatatggtttaggctaatgaaaagacttggtttccaacaccctcttctacctctgggcagattccagatagctgatctaccattacgtttccgaaatcatgggacgaccagctgcaagtgagacgatgctcagtgggttgaaactgatcactcaggaggcatttggcaacggccttctctcccagctgtttggatcctggaccttcactcaggaaattggtggctcagatcaagaagcttgtctcatgtaatcgaatattgctggaggaatccaaagccttggtgtgctgcaacatgaagagggatctggaacaggccaacgagagaacatgtgaagtactgaagaaaatctggggttctgcccgagggttggactccatgtgaaaggacttagaaaggaagatgaacgagtttcgagtgtcaggctgcacactgaccacacggggttccggctgagaagaacaccattgcttccacctgtccttatccattctcacagcctgagacaagctcactggtagcttatgcttccaagcaggactaggaacattcacgctatttattcgggagtactctggataaatcgtcccattatttcggaaatgtaatgctaggtcaggtatctggaatcttcctggaggtagaagagggtattggatggaaggaacttcatgaatgcgatcattgaactccagaaagtacaccaaccttgtactgctcagggccttaggtagggtcttctgtggtgcacttgaccttatttatgttttacaacgtttgtcagaggacagaaagagaacaagcattaaaagggcaaaagctaccagaaacatcgtgaacaacctacacccataccactgtgaacgctcccaatctcgtctggcctctgatgtacagagtagaggagattgggcccaggtaggggcctgtttcatagttggatggaaggaactttgtgaatgctatcatttaacttaagctgtctattactaaagcagtcaacagcccagccgttcgactaggagcacccatattgcctctttgtgatatggttttggctaatgaaaagacttggtttccaacaccctcttctacctctgggcagattccagatagctgatctaccattacgtttccgaaatcatgggacgaccagctgcaagcgagacgatgctcagtgggttgaaactgatcacacaggaggcatttggcaacggccttctctcccagctgtttggatcctggaccttcaatcaggaaattggtggctcagatcaagaagcttgtctcatgtaatcgaatagtgctggaggaatccaaagccttggtgtgctgcaacatgaagagggatctggaacaggccaacgagagaacatgtgaagtactgaagaaaatctggggttctgcccaagggttggactccatgtgaaaggacttagaaaggaagatgaatgagtttcgagtgtcaggctgcacactgaccacatcgggttccagctgagaagaacaccattgcttccggctgtccttatccattctcacagcctgaaacaagctcactggtagcttatgcttgcaagcaggaccgagaacattcacgctatttattcgggagtactctggataaatcgtcccattatttcggaaatgtaatgctaggtcaggtatctggaatgttcctggaggtagaagagggtattggatggaaggaacttcgtgaatgcgatcattgaactccagaaagtacaacaaccttgtactgctcagggccttaggtagggtcttctgtggcgcacttgaccttatttatgttttacaacgtttgacagaggacagaaagagagcaagcattaaaagggcaaaagctaccagaaacatcgtgaacaatctacagccataccaccgtgaacgctcccaatctcgtctggcctctgaagtacagagtagaggagattgggcccaggtaggggcctgtttcatagttgaatggaaggaactttgtgaatgctatcatttaacttaagctgtctattactaaaccagtcagctgcccagccattcgactaggagcatccgtattgcctctttgtgatatggtttaggctaatgaaaagacttggtttccaacaccctcttctacctctgagcagatcccagatagctgatctaccattacgtttccgaaatcatgggacgaccagctgcaagcgagacgatgctcagtgggttgaaactgatcactcaggaggcatttggcaacggccttctctcccagctgtttgagtcctggaccttcactcaggaaattggtggctcagatcaagaagcttgtctcatgtaatcgaatagtgctgaaggaatccaaagccttggtgtgctgcaacatgaagagggatctggaacaggccaacgagagaacatgtgaagtactgcagaaaatctggggctctgctcaagggttggactccatgtgaaagtacttacacaggaagatgaatgagttt

SEQ ID NO: 2952 - DNA, 190968 bp, human
ctgcacaagcccagggagcccaggagcaacgaagggcaggctcaagggaaggccccaccatgtccttctggggggccttgaatggcaactgatacataataagacacaatctattctgctgattcacaattatggagactgtgtaagtgtgtatttttttattgatgtcctctaatgatggtgtagcaacagtcgttttgcatcattgacgttttacagcaatattttgcagggtaattttgaggtccgccgttttggtggaggaccggcctcttaaaaactcacctccggccgggcacggtggctcacgcctgtaatcccagcactttgggaggccgaggccggcggattgcctgaggtcaggagttcagaccagtctggccaatatggtgaaaccccgtctctactaaaaatacaaaaaaaattagctgggcgtggtggcatgcgcctgtaatcccagctactcgggaggctgaggcaggggaattgcttgaaccagggtggtggaggttgcaatgagccgacagcgcgccactgcactccagcttgggcgacagagcgagactcctcagaaaaacaaaaacaaaaacaaaaaaacaaaaacctcaccttaggtccccctccccctacaaccagaacaacaaatggtctagagttcgaggaagagcaagtgaggttatagtttagattgctgagtgtaccgggctcttagcacgaagctcattatatagtaaaggaaggggcaagaatatttgaaaaatattcaacgaggctgaccccagaggtgctggggagggggagtggagatctgtttaactgaattaaggctgcgagtggttgggagtagcctacgtggaggggaggaaggagcgctggggacttaggtacaccggggccaggccgtgtaagccattgcaacataaagcactttgcaagggccagagggctgatgcctggggggttggggtgggagtgatgaggcccgagtgcccaggtccccccaacctcctcagcccccacacccgagttcctggcgcctatgcctgtgtgtctgagtttgtccctaagcatttctggctcttcttgggaggtgttttgcaaaggtcgaggctccgccggaacccccactttttgagctggggtaaagactactggggtgtcttctaagacgccgattttgagggagattcaccatcgggcaggtggcagggggttctgttggggcagccgggtggcttcctttttggggtgggggagggtaacactttagcagtgatcgaggttcccctgccccctagaaactgagggggtggccgaggttcccgtcccctcgaggcagtcgtggaaaggctgggtttgggatgtgatgggggtagccctggggtcctctcagtcccacggaggccacggggaagggaccgggaccagagcaactagggagaggcccgggttcccctcacccaccctaggcgtgggggagcggggcgggcttggtagggacgctggtcccccgaccgtgggacaggggctgggttgggacgcgggtccccactaggagccgcgggggaggggcagggccggagtccctaccctcgtaggggaggggctggttcgggacgcggctcccccggggcgcaggggcggggccgggtggtacgccgggtcccctcccacggccgtgagggaggggccggcggcgggggcggacccctggcggtcctcctggctggggtccgcgcgctcgcggcagctccccgtggaggtcactgtccgtgccagtccctcccgctgtcccgccctctcccgctgccgccgccgccgccgccgcgcccgcctcagcgcccccactccgcgcttgggagcgaggagccgccagcgcccccgccccgccgccgccgcagcgccctcaggccgccattcgccaccgaaactttccagcgcccgcgctctctccgggactcggcggcggcggggcgggggcggcccgggggcggcgcgcggctgctccggggcgccgggccctcttcggccgccgcacggccgggactcggaggctgccggctggagggaggttcggagcgcggccgggcgcgcggcgccgccacaagttgcgctgctcgcgacgaggtgagtgcgcagggctcggcgggccgggcgcggggtccgcaaacttctgcggggaggcgggtcccgcgctgaccctccagggtccggccggcggctcggggcgcccgaacgctccacccgcccctggaactcctgtaggtgcaggtcgccaactgtccccgcggcgctcggactggggtgcggcgcgctcccaggagcctgaacaataccccgaggtggccgctccccgaagtgccggcgcgccttgcggggagagacggaggtcggcggggggctcctttgttttggggagggggaagtggccggtaagtttagggaagcgctcggcttttcctccggtgcccctttgtctgccgattcaggggcttgctgggcaaacctgcgccaccgcgggctccggggaccggggtggagggcggtggcgggatttccccgctgttggggagaagagccccattcatacccgggacgcgggccggccctcccggacccgggtggaagcgcagcctcgcggagtggggcaagcggcgggcgaggtggcgcgggccccgtgtctgctcagtttctgacgcgcagaaactgtcaaggaagtcgggagccccagtcctccgcccatctccccggcctgagcgcacggctgggctgggggcacccttggcccgtcgagggtctgcagagcgccgcccggggagagcgcagacctgttgctgctcctgggctctgacggggcgggtggggtgggtctcgcagatcctgggccccggccttgctatccagggggaccttccctaacgatgggaccggtgctcggagtggagtatggggagtgcgccttcgggagtcggcgctggccggatatgtgacaactgtgggtcgctggaggcccgcctgcgctgggatagggcctggacttcacgtgcgtcgcctgtgttccgtcagaccggggccggggctcgctccctgcaaggcctcgtgttcccccagccagctgcgttggacgttccacaaaggtagggactgacgtttattctcgagtcagtgatgttctggagcaaaacctaaaaagaaacaaaaacctaccctctattgtatttgcaactgtttctgctttgcattgtcatgtgtggtttgacctgccttttggatgttttcctctcctgaaacatcgcccagtccctggtttaacctggaaggcgagggggaaggaaggcaacctccctgctaaggttccaggcagtggctttggtgttggaagtggcacttgacgattttatgaaaagtttacaagtccttcctagaaaagatgtaattaggaaaaataaaatacagaagaacgttgagtatgacgcgtttattttaaagggtagtcctgtctcaaatgtgctgcacatttttgtggaaagccaccaagctgggtaactaatgcaaacaacaaaagttgttcatcactggatcaccggcccttaaggcgattccagcccttagtagaacacacacctgtagggcaaatatggagatttgtggtgtagtgctgccaccctcgctccccaactctcaggcattttgcccctttacctcagagaacttctctctgtcagtggttttaaagaggaaacagtttgcaaaaataactttattgtagacatacttagaagtgaatgtttcaatttctggagttttcccatcaattatatcagtaccactggttctgtacaacatcatcttagttagaagattttttttcaccttttaaggtgacgaacagaggcgggaaaatggtccctgcagagggaggccatctccagcaggtcccgagggtcaggaattcagattatccgatctactcctgctggataggagcacacctccgctagaacctgggtccggccccctcccagttttctgcagggcgtccagattccggtgctctgccccgcagcagtgccctgtgggcctcctggcttagctgatcagcacagcttctctgcccagcgaggcaggaccatcctcccactgctttcctgatgccttggatttgctttttttcctcccttaggaaaagcaaaaaaacctaatatgctacatccgagaagttgttaatctttcactaccacatgcattgaaaaatcagttccacccaggaagcaacactaaaggcatattgtaaacacttttttttttttagttggaaagataaacttttttcccccataactatttttagttagccggagactggactcgagtttttacctccggtcttgccccctccactcccgccctcactttctgtggggctcgaccacatggaccatgctggccagactggcaaacatgaaacccaccagaaccaaaagaaaagctggatatgggaaggggccgaagaagtccacatgtttctaaagggcaaagagcctaggctgaggagagacgtttcagatctccaggggagaaagacagccgttaaggagtccgccgggctgctgcctgcctggccagcgggagcctgacttcagatgcctgcgcctcccaagctggccccctcccacacagccatcgccatccagtatttagggagaatccaccgcatgcctgaaggttgcagaagtgaattggaaaccgttacaaatggaattggaacaaatttaaagttaagatggaagagagaatatgttgagttttcagaggaagtcgggtactgcttccttttcttgtctaggtttgttcttgtccgatgggatcagagagatttgagatggggcatgataggcggcgggttcaggagaaagggaagctttagaaatgaaggtagaaaagatgcttgcttattggaacagtattttcaacgttgagctctggaatgttgcagccaactaatggttctcatttgggacagttttgtcccccacttttgaagggagcatttgccaatgtctggagacatttcccttcctgcaactgttaaattagcaaacaggttgagccagctgggtgtggacctgcattttcctcgtggaggccctcttccaagtgtcagtaggaaaagggctcccagagtgtggtcctgctgcgggaccttggcccccacgtccaagtgagccccagaggtgccccaagccctgcctggtcatggggaatctgggctcccgctgaacttgggcgctggggacagctatgagggaaacctggtttgcagctagcttgccgtgcactgactggagctttgggcaaatcagtgaacttctctaacattaattttctcattgagagaggaggtgggtaggagtatatatatatatatgtaattatatatataggggtcgggtagagggagagagagatttcccaggctccttgtattaaaggagatagagttattatatttctcatttagtttttatttatttgtttattttgagacagtgcaattattatagctagctgcagcctcaaccttctgggcttaagcaattctcctgcctcagcctcctaagtagctgggagtaccaaatgcgcactaccatacctggcaatttttttatttttatttttagtagacacaggctctcactgtgttgcccaggctgctctcaaactcctgggctccagtgatccttcctccttgacctccccaagtgttgagattacaggtgtgagccactttactcagtcgaccgacatagaattattataatgcttggagcctaacatgccttttttgtttgtttgtttgttttttctgagacgaagtctctctcacagcccaggctggagtgcagtggtgcgatctcggctcactctgcctcccgggttcaagcgattctcctgcctcggcctcctgagtagctgggattacaggcatgctccaccacacccggctgatttttgtatttttagtagaggtggggtttcaccatgttggccaggctgggctcgaacttctgacctcaggcgaccctcccgcctcggcctcccaaagtgctgggcttatgggcatgagccatcgcgcccggctagcctaacatgcttatagtttcctgttttctgaagttgggaattgggtctggaaaggtatcaccatcagtcacgatggtgtctagtagtttgctttgtttttttccttatcttttccctcttacattttagggctgtatctatataattttattatttaaattaccatatggtaagtttgtctctttgggtgcattatgagtcttgacacatgcatagattggtgtgaccaccatcatcatcaggagagagaacaatctcctcagcccagagatgttcatggctctgtctcccacagttcctccacagtcaccccccccagccccgaatctggggcacccagccatctgctctgctctggaagtcttggggatcccatctgaatgtaacacatggtggaatgccttaggtgaatccatccgctcttccagtaccacctttgcctcctctctctgatgacacatgaacttcatgcctttgtgtgctttggccaaccgcttttcttagaacagcacattttgcactgtagatgttatcacaagcaaggaaaaaacagctttgctccttaatgtaagaaaccacagtggaaaaacatcaggtgtgttgttgaggctgctaaagctttgctcctttttaaaattttttaaaaatttttctggatacgtaggtgtatatatttatggggtgcattagatattttgatatagtcgtgcagtgtataatcacatcatggagaatgggggtatccattccctcaagcacttattctttgtgttacaaacaatccaattatactcttttagttatttgctcttttttcttttattttgagacggagtctcactatgtcgcccagggtagagtgcggtggcgcgatctccgcccgcaagttcaagcgattctcctcctcagcctccggagaagctgggactagaggcatgtgccaccacacctggctaatttttttgtatttttagtagagatgggtttcaccatgttggtcaagctggtctcaaactcctgacctcaggtgatccacctgcttagcctcccaaagtgctgggattacaggcgtaagccagcacgctcggcctatttatttcctctttgttctatgccagttagttcttgatgcctcattgtttcagatgggacattttctaatgtcgtgtttttgtttttgtttttttgagacagaatttcattggtgtttcccaggttggagtgcagtggcatgatctctcctcactgcaacctccgcttcccgggatcaagcaattctcctgcctcagcctcccgagtagctgggattacaggcatgcaccaccatgcccggctaattttgtatttttagtagagatggcatttcaccatgttggtcaggctggtctcgaactcctgacttcagatgatccactcgcctcggcctcccaaactactggaattacaggtgtgagcaaccatgcccgacctctgatgtccttttagaggatgttaccctcacctttattgcacagtcctaccaaaaggtacttcatatgtgaaatgtatcagaaggttatagtcatggctttagtttaaaaacaggatacatgttcattaaggacctttgccgttttcccaatgggttaatcacgtaaatataaaataggctaaaaatatcaagttgtttttgcctttgttgtagaaataaaaaaatgaattcctacatctgtgtttctatggagctgctaacctgtgttttactctgggccatatgtcgctttctgtgatctcatgacgtggcatgttttctaatataatccttgtcctggcattttggtgacttttgtcctgcctgaggtggtctacctggttgtgtgaagtcacagaacctgtgcatgtcctaccgtgtagagttaaagggctggatgagtggcctcaagccttttcctccctcccaggtgtgaagatttggtttggaagatggaccctgcttcaaggtctgggaggccatgtttttttcagactggttaaggatgacggttttatgttaactaaacattgggatcaagtgacagttgtttatgtccggtgcctagagtatcagttttcccatgattaaaataagcgatattttggtaaacattgataagttagttgcgcattttagttcagaaacccacagcgagtcagaaggcgctttgtgctgctgggcgcctctgagtgattccggggagtgcggcagttctccagccccaggagaccctgtgaaagaagcacaaacaatgctcacggcaaaactcacagtgtttattcttgacctgggtgtctgccttgaattcttgtcatttttcctatcgtggtggatgtagccggaatgctttaaagaaaacatgagagttttttctgcctgtttcccttgagcctggaaccgattatgaccccagatagcctgcacagggctctttcctttctggaacacctgcccaggctagaatatgggagtagggaggaggtgaggctctctcctgcccggtaaccttcccggccagctctccaagacgctgaaaccttccttcgggtctgttgaaactgcatccccagcaccatcatgtcggagcaagaagagaagggcatgtgtcccctttaggcttgactctttccaattagggacctgcctgttgttaggatttagagtccatgtgaatgtgcagtattgttcagtgctgcgagcatttttgcttgtctgaatttcctgatagaagggaatttggacaaaaagaagcttattgtacatggtgccattttattccttaaatcaataataacaaatactttatttatgtatttttagagatggggtcttgctctgttgccctgatcatagctcactgcagccttggctttctgggctcaagtgatccttctgcctcagcctcccaagtagctgggccgacaggcacaagtcagcatgtccagctttttttttttctttctttttttttttttttttaattttcaatttttttctagagattgggtcttgctgtgttgcctaggctggtcttgagcacctggactcaagcaatcttcctgcatcggcctcccaaagtgctgcgattacagttgtgagctactgttcctggccaacatatactttaatatggcaagaccatataaaataattttaagaggccaggtgtggtggctcatgccccccagcactttgggaggctgaggggggcagatcacgaggtcaggagatcgagaccattctagctaacacggtgaaaccccgtctctactaaaaatacaaaaaattagccaggcatggtggtgggcgcctatagtcccagctccttgggaggctgagacaggagaatggcgtgaaccatggaggtggagcttgcagtgagccaagattgcgccactgcactccagcctgggtgacagagcaagactccgtctcaaaaaaaaaaacaataattttaagaactggaggaaaattcagcaggactgagtcgtgatttcagtttctggtgcactgtgggtaattgggtaattgtcagcctggatgcttgtgctcctttagttgtcactgttaccttgtcatctatgtgaagatgagaaatgaagttgagtggagaactgtcgccaaagtctgccatgtaaaaatcggtagtgccaatgtgcaaaggtaattcccaggtgctataaaagtccaggtggcttcacagtttcagattgtatttcccgaaagcgtagagaattgatatccctgaataggaaattgacgtccctgccatttggttcatttggggaacagaataaacttgtgtccttgccttcagttcttttttcaacagaatcttatcaagcatttgaatcgtacacaactgtaatgccagctccatgttgataaaaactcaagaattcaaaattataaacttgaaaacagcaattgccaacttctgacagtagcaggagagtctggaggacctgttcagaggaagtcgggtactgtttccttttcttgtctaggtttgttcttgtccgatgggatcagagagattgagatggggcatgataggcggtgggttcaggagaaagggaagctttagaaatgaaggtagaaaagatgctttcttattggaacagtgttttcaacgttgagctctggaatgttgcagccaactaatggttctcatttgggacagttctgtcccccacctttgaagggggtttggtttaattcccaatttgattatgaagaaaataccagattcagcttgcattttcaagacacagtggttctatgtcaacttcagccatttccagggatctgtcttaggatacttcaaaaagcctaacctttgagatgcactcagctcataagttcgtgaaaataagaatgaataatcttccctgtccagtacatgacagaaattattgtagaccagatgagagcaaggagagatacttgttgatattacatgtcacgggatgctctgttaaattttatgggactctgagtgtaattcctttaagccagtagtctctaaatttgggggaaggacaggggacagaaatgacttgtttcagattttaattcccaaaagggtcttagtgagtttcatgccctctggcaggtgcacagcaagatttattgggatgcaggaagaaattatgaaaatgtccattaagaaaatctctaatacttgtaaaaaatatatttcttgtccatgaaatgcatgttacttgagtattttatatatttaataaattacatgagttaggagcaccttctgaaaacttttttgctgaaaaggatatatgatgaaagaaacatttatgatgtaggtccccaaaggctggaagagggggtgataccaacgtccctgcctgcaggtaggacacagttgtactcccctttcctctgacttcagctactaaggtatgtgtgcgtttgcacgcacatgtatgtgcgttaagtaactttgagatccaccagcttaaggactggacatcgttccagaggtacaggtattagtgatttgacttagggaagaaagaatatgcaataacagggaaccatgcacatactggatctattgtattttgcgtgttgtttttaaagctgaaaaaatgcgcttgtttcggaactagatgacagtacctgtttgcaggtccacaaggaaaccttggaacaatgctatgctttttaagcgttttatgactgcattgttttcataatcactgaattctgtttataaatcagctgatttcattgacggatgccctcagggctctggagaattaggcgttttgctgcagaaatggttcagaatttcaaagacatcaacgtgagattgtactggaattgagttgtgataaaagtcctagggtgctttaaatctttaaatctggttatttgtttgtttgttttttgaggcagagtctcactctgtcgcctaggctagagtgtagtggcgtgatctcagctcactgcaacctccgcctcctgggttcaagcaattctcctgcctcagcctcccgagttgctgggattacaggcgcctgccactgcacccggctaatttttgtatttttagtagagacggggttttgccatgttggccaggctggtctcgaactcctgacctcaggtgatccgcccaccttggtctcccaaagtggtgggattaccggcgtgagccactgtgacctgctgtttttgtttttgagacatatttcatctatcatggttattaagtgttttgtttttttgcatttctcattggtgttttttgtttgtttgtttgtttttttgagatggagtctggctctgtcgcccaggctggagtgctcagctcactgcaacgtctgcctcccaagtttaagcaattctcctgcctcagcatcccgagtagctgggattacaggtgcccaccaccaccacgcctggctaattgttttatttttagtagagatgtggtttcaccatgttggccaggctggtttcgaactcctgacctcaagtgatctgcctgcctcggcctcccaaagtgctggaattacaggcgtgaaccaccacgcctggcctcattaggttttttttttttttctgagttgctgctacactactggtgttacagagtgaataaacataaaaattatattcacaactcagaccacattgtgggctgtggaggtgagaaataggaatcatctctaaatttaaggtcttctggctgagctcatttgcttagaatggctgaaggtttggttttcatgagatgaaatgccaacctcaagtggttctgggtttccagaccagtttttagtttgtttaacttgagagaattgatatgtcagctttagtttttgtgtgtaatttttggtgtttgcatctgttttcttctttgtgaatattgaattcgcaacataactttgttatatgaaatgatgctcatacacttgcgcagtgcattagaaagcctgccaggagcagtacttgtagatttccgtgtaccagcaggatgcctaatgccgaccatgattaatgctcatcagaatctatgtagacctccatttgtcctttgataagctgaaatatttgtgtctactttttaaaaaacctgttgcttctctttatggtaatactcagaaggcactcactgtgaagagaggagaaacaggaagtagaattttttactatctagattgatgcacctatctcccctctccagagaccaatgcatttaggccccagtaagaaatttagttgtaatgaaccataaagcagatgcagagtatatttgggaatataccttatctgactccacagcccaacccctttaagaggaaagagatggcacaatatattttgctttaagccttagactggtcttgacttcatattggaaccactgaattgcttcagctgtgaactggaatcctctcctgtctttgttgttgagtgatgacactcttaattaatcatttgcttatttgccatccaaatcaccctatataatctttcagaagtgtatctcagagaatgaccctaagtcggctgacctctgaagcctgtaccagaattgactttatttcttaagcgcacacttcctgtgctttcaaggggcagctgtctaggtttagtttctgggagtttgaggcacagaggtatgtaggggaatgggaaggccaaatggtaaaagcccctgggacgtggaatctgtgagtacactaaccttgaaagagattatgaaaacaaactttagagcattgttgaagcaccatctacataatttatatcaatgaagacagtaacttattaggaagacaggattattaaaattaaccattttcatctttctacaaaaataaaaatcaaatcaattttagttcagataattgtatgtgaagctttataagtgaaaatttgaagttagcaaaattatataaccttagttaattatattagtgtactcaaactaaatatagaataagattagctcatggaaacattgcatttttatctcagtcagtactgctcatatccacccagtagttagtttctagttacgttttgtaattttttgaatatcctggacatggttttagaaaagttagttgaaacaagatattgtatgctttcattatttcccagttcatctttaagcataataaaaacacagagtaagttgtcctttttgaattttctttcctttctaatatgtgtctggcacaacagaggaccaagcccagggatcattaatcccatttttctgcatggcgtttgctgtgagagaagtttgggctggattcgtagtttgctatctaagagtaaatgttcaaccttctctaatttcctgttttgtttgcttttccattcagtgttctatatttggacaacaaatatatttttctgtatgggtttctggtggcccagatgttcattggagtggaaattctttctgtccacaccactgagttgggcagttactggtgtttggctttctctatctcttggagttgacttagatacattgtgtattcaggttgggcactcatcccctttgcaagctctattactttgttccatttggctttgccataaatgtttgcccttggcttgccaagacgtcagctttaagagatatgtcatttaacttagaactcttgagtctgacttaaaattaagtcagttttcttaaacattgttattgaggtataaatgacatgccacaaaagtcacctctttgaggtgtaccattcagggatttttggtaaatttactgggttgtgtagagatcaccatgatgcagttttagaacattttcaattcccaataagatcgctcctactcggttctcacccatttctgctcccacctccagccacgggccaccatgaatatccttcgtgtctctatagattccccttttgtggatattttagagttgtgcttccaagaatgagtatctctgtgcttggtcgaacttcccggatggtgagacctgatttagtgactttgccttccgccccttcatccccaggagaggaaggtggggaaaggggaaagacggcaagtatagtagtataacaggcatcgtgcctcagtttcctcatctgtaaaatcaggataaccatggactagtttcaggctctaaatgtgaaactctgtaggaagtaattagctgggaatctggcatagaggaggagctcattgtttgcgtgttaacagtgggaaatagttaaggaggtgggaaaagagctacctgtagaaaggtggcctaagtccctggagagctgagcacaggaccccagggcacacacccccttatgcttcccctgtctttcatcttgaaagcacctgcctgtgaacctcaggcttggagggaatctggatgttttcccaggatctacctctgctctatggtcctcaatccaaggtagttttgaaaccgcctttgcaaaaattatatcaatgagaaaattataacagtatgttaagctaacccatcccccatcttgcctttcccttaatattcttgggctattgggccaggtgaactttggaggacttttaggctacggtttaaatgataataggccttgtcccaaactcaaaacttgccccaaactgtaacactaatgggaggccatcaggatgggggaggagaggagcctgattgctgctaaggcaaagacatgaaccattgccagattgtcaaatacgcagattcccagttactcccgcagataacatcactgttgtagaacctaagattggccttttgagatatcttttcaggtttttaaaattttcttttctctgaactacctttggggagattctagatcttttaaaaattccttaccaactctttggagatacctcctgcgttcatggttaatccatccccttagttaaggcttattgattgcacataggaagttccctttagtaaaaggttcaaaagctagaaatgtcctggctgaaatccggtaaaaagagattttaaaatgatttttcttttgagagctctgtagttagaaatcgacttaattaaagctgatatgtgtacagatactgttttaaagcccctgttctccctctgaaagcttctgtcaatggacttctgtcttgattcttcattcctgtctttctgtgtattcttctctgttatgtagtgtttatataaaacagctctaaataattggcgtaggccaggcgcagtggctcatgcctataatcctagcactttgggaggccagggcgaggtcaggagttcgagaccagcctgaccaacatggtgaaaccccatctctactaaaaatacaaaaattagccgggtgtggtagcacacgcctgtaatcccagctactcaggaggctgaggcaagagaatcgcttgaacctgggaggcggaggttgcagtgagctgagatcacgccactgcactccagtctgggcaactgagtgagactctgtctcaaaaataaaataaaataaaattggcttaaagaaaaataagcacttaaacattgtcagaaaaatggaaactttaatggcttttacatcacatgactctgatctttcaaaaataaggacagtttaaagattatttgtaaagtaaaataaaaatgtcttcaaagttaacacactttgtctaaattaggcaggtcagatactctttgctggatgttttaaggtcataaactgcttctgtgacttttaataattgtttgacttgtctgtcttacagccattagattctaggtaaggtctggggacacatggagttagccggctcccctggctaggctgggaagaatcatgggttctgtagttttatacatggttaaaattgcttatttaccaggtttttcaccaaaaataaaagttgctgaaagttaagattgtaacacgtataattgagactactggagaaacagttttacatgcaaggcgtagaaggaaagtagaatgtgtgtgtgtgtgtgtgtgtgtgtgtttgagatggagttttgctcttgttgcccaggctggagtgcaatggcatgatctcggctcaccgcaacctccgcctcccgggttcaagcgattcttctgcttcagcctccccccggcgtagctgagattaaggacatgcgccaccacctccggctaattttgtatttttagtagagacagggtttctccatgttggtcaagctggtctcgaactcctgacctcaggtgatctacccgcctcggcctcccaaagtgctgggattataggcgtgagccactgcacctggcgggaaagtagaatgtgtcttgtgggaggctataagaaagcatgggaatatggtttttgtaaaagggaatataattttgtctggttcggaggattttaaggatcatcttaaaagagtaatgggacaaaactgaaagtttaagcaagttgaaaaaggtttgtaaagggttcatcttgtaaaggaagttctgtgggtatgagcaagttggctaagacttgaaggggattatttagtttttctgtaggttgaatattttttgtttgacttttgaatgaatgacagaaaaacgaggagagaggagcctcatactgtctttattttgtcctgtttggaaagttgagtttcccctctatcagtgagtgaagatttttgccttttaaaaattcttgagttattatggctaaataaatgacttctagtgacttgggattttattttgtaatatcaagggtctaaacatttgatatttgacaaaactttccaaagtcaaaatctaaattaagccacccccccccccgcccttattttaatctggttaaccttccagatattaaatactgtaaagtccaaaagagacatatttggcttatttgatatattaaaactataacagtaagcattgtcaggtatgcaatagtgtttggctttctttggactgtatttgtatgaatgtgttgttagtatgtgtttcagaattgtataagatttcctgtaattctgatatgttttagtatatgttatcagtaataattatgattgttaagttattgtatgccacagagatgatcagaccttaactgtggctgttctgaaacttttgtcatccacaattgttttactttggttattttcagggtggttttataatcagctataggactgtgacagttttctgataactttggagattgtgacattaaaatagacgaaaaagcttccaaggctcccattaagagctaatgtattcatggatatcgagcagaacaggagttaattacatggactgaagtaatggaagaccgaaataaactttttctggcttttcgtttgaaacattgctcattcttttgtttttcagagtccagaaaaccttttttttcttttgagctatttatagcttttaacaattggataaagtatgctcttgtgaacaaaatctgaagcacatttctctctctacctgatttctctagaatttgaaaactgtttgcaagtatacttaatttatgatgttatagttgtttgttaaatacaaatctgttttcttttgtagcaggacacaattggagacactggttattttaccaaagctttgattggaatggcatactttcagattgctttaaggaatcaaagttgacttacagagccaataaaagccccttgggtaagctggcctcataccttgtctacacagtccctggacaggttcctaagtaaagaatgtcactttctgacaggtccaggagctccaagttatcttgagcccttgaggtgaggaattcacccaattaatacaagtatttgcaggcacagataaatccgtggctgggctaaatgctttgaagtctaatgtgagatttcttagggaataaagttgcagcaaagccaattttaaaaaggagcatatatggcaaataattgttctagctgaccttatgcaaacactcgggccaggtatagtaagaataaaacttattttgcacataaattagtcctaatgtgatttgtctttagtaaaaatagggactggagagagaaattatgtttcagaaaaaaactatagaacacctgttgttagaatctagtcttgttcactatttttgaatttttattattttctgtcatttggactgaatcgtgaattctttctggactacaagtcccaaactaatgctttcaaatttttctttcatttctaacttggcctcaataaaattgctactacctctttcctgaggtcctataagctgaagcttattatgagagaaaaacatgtcagattgccaccaccttcctcgtctataactaaagatgttttgagtctaatgtctggataaattgtgcccagtgttaatctttgttttttttccgtgtctatggaaatgcctcttacagaagcttagcccatctgcagtgccacctcctgatatgggaaacagctgtttaactgatctagtcttaggacttggacactgactaaaaagatatgggacaatatatttaaattcactctttcctgtttatcccagtctctctttctaacaacatatagtctactgttgacttaagtgttgtactagaactgtgagtaagaacattaacatctttgtcatacacccgtgagtacatgcaggtagctgcacggtggtgagctcactcctattcccctgggaccaacccctgcaactatgccccctgtcagcaggaagaagccagagtgatggtcaccctttttctatctctatagccagcaccttaagaataaggtgtatgaaagccaaagggggtattgaaaccacctttgcaaaagttatatcagtgagagaatgatgacagtgaaagagatctgagctaatccaccccccatcttgcctttctcttaattattcatttcccttaattattgcatttcccttagttattccatctcccatgtggtgtggctggccttgtgtctgttaaactctttctctactaaaatgcccatggtctttatgcagccggcaggaagaacccctcaggcggttacagttttgctcccaggggacagttttggttgttataaatgaggaaggtgtgctcttggcatctagcaggtagaggccagggctggcctcctgaagtgcagaggaaggtcccctcctctttcaagagagttatccagccccaaaaggtcagcattgcagaaattaagaaaccctgacttagaagctttgcacctcgtggtagctgtaaatgaggtatttacatcctccatgaagacgtaaggaagttgaaggaataaaaatctcatggggctttgaaagcaatgcaagcatcttttagttttcatacattccatggaagtagggatttttttctaaagcaaaaagaccaacaagactttggagctcagtttagaagaaaaaagtgactttcaaaccctttagaagtattcatttacaaatgaacaatgaaatgactgtgtagatggagaaaccctgagcgccccttggctttgatctggtggtcacgttcatccgtgtctgttccctgaagaaccagtgcccacatttgcctgccttctttacctaactccccccaacaagagctgaccctcctcccatcttctcgcctggttggtctttttcctccctccccctgaagcctgcctgcctctgctttccaccctccgacaagccctgatctgtgctctgaacaaactcctatgcgggtctctttgaagtctttttgcctgcccctaagtgcatccctcccacccccacccaggtgatactgaatctatgtgaatttgtggagttctcccttccttcccctctggcagaatcaccaggattcagtctagagtacaacattatagatgttttctagcacttttcagctgtccatacgctaatatgtagtcttgggtctttatccgaatggagtcctattatatttgtttcacaccatctgctttccttatttttgtatctttactgaggtatattgaagtacagtaagctagacttgtatgaagtgtgcagttttaatctgttttttcttttttatttctttgtttgtttacatacattttttagagacaaggtctcactatgttgcccaggctggtctcaatctcctgggctcaagcaatcttcctgcctcagcctcctgagtagttgggactataggcgcatgccaccacacccggttaattttttattttttgtagagatgagggctccctatgttgcccaggctggtctcaaactcctgggctcaagtgatcctcctgccttggccttccaaagtgctaggattactacgggtgtgagccaccgtgcctggctcgttttttcatacacacacacacacacacccatatttgtgaaaccagcaccacagtcaaagaatatttccatcactctccaaagtttacttgtgcttttttgtaatgtctctccccctccctctacccctttcccaggcagccattggtgggcagtctgtgactattgcattttctagcaatttatattactgaaatcatatggtatgtactcattattttgcctggcgtctctccctcagcatcatgattttggggcttcatgttgttgcacatgtcactaactcattcctctattgctgcgtaggattccttcctgtatggatgcactatggtttgtgtatccattcaccagttgttgaatgtttgggttgtttgttttttattgtgacaattatgaataatgctgctgtaaatgtttacatggctgtacagtggttctcaaacttcatcatgcatcggaaccacctgcagagcttgttaaaacacagagcatccaggcacggtggctcatgcctggaattccagcaccttggaaggctgaggcaggaggatagcttgaaccgagaagttcgagaccagcctgggcaatgtagagagaccctggcactaaaaaaaaaaaaaaaaaaaaaaaaattagccaggtattgtgtgcacttgtagtcccagcttctcgagaggctgcagtgggacaatcacttgagtccaggagtttgaggctgcagtgagctgtgattgtgccactgcactccagcctgggtgatagagcacaagaccctgttgcataaatactccccccaaaaccccagaaaaaccaacacacagagtggcaggccccatccccagagtttgtgattcattgaattaggggctgggttaagactctgcctttctaatgggctctcagctgatgctggtgccaatggttcaaggaccacatagacttcgagggctgctgccttaaaggaagtctttgtaaattatgatagttaatcgtttgttagttgttccaggtatttctcttctagaccattccttgccatgtaatgttgcttatggtttgaagcatcaagctcgcatttttgtgtagtcgaacatgtcagtcttttctttgggcttctgggcatggcttccttccagcaaggggcagataccaagaataacttggagtaggtgaggcaggttttgatgttagcaaaactcaaaccatgacactcccccaaatgggagtctgccctcattgggcctaattgtgccctctgctgcagatgctgggatggccttctgatgggatggccgggctgtgttgtcagcacccgcccacatgagacgagtttgtagctgtgcctggtgccaagagctctgaggtgctactatgccccctggaacctttgggcaaagcatagctagtcatcaggcttgcctttcacaggcaaaccaaatccatcctttcttcatccccctgccctgccaaaatcaaccagtctcaaatcaattcacgaaagggggccaatttgcctttcgggtgtctgatctaacaagccttggagcagctaggaagctaccagaagatgtgtatgatcaatgtatttgttatttattttattttatttttttaagtttggggaaaggtaatacttttggtcaaccatctgaagggactccctcctctaggccagggcactccatagttaacctgaaaaactggttcagggcatgacaggaagggggtttgaacatgcttcattatgccctcctcccttttggaattcatgaacagccgacagcatttaacacagaccttaagtctgataagaaacagttacaatctattttctctgaagcctgctacctggaggcatcatctgcgtgataaaacctaggtctctacaaccccttatggtacctggacatttttttctattgataatagcttttttttttttattattgagacaagtgctgttgcccaggttggagtgtgatggcatgatcacagctcactgtagccttgacctcctgggctcaagcgatcctcccacctccgcctctctagcagctaggactacaggtgtgtgccaccacacctggttaatttttgtattttttgtaaagacggtgttttgccatgttgcctaggctggtctcgagctcctggactcaagcaatctgcctgccttggcctctcagagtacagcgattataagcatgagctaccaggccttgccgataataactctttcaaccagttgccaatcagaagaattttatcccagaacacacaccccccccccacgcccccgccgcctcaagtcttcccacctttctggaccaaaccaatctatatcttaaatgtattttgatatctcatgtctccctaaaatgtataaaaccaagctatgccccaaccgccttgggtacatgttctcaggatctcctgagggccatgtcacgggccatggtcactcatattcagctcagaataaatctcttcaaatgttttgcagtttgacttttttcattgacagagagcagctttaaattactgtggactctttgttgcaaaagcatcttcttgaatttgataataaagccctactcttccagtttgtccctgagtgcattctgcaggtacctccggtcaccgcttcttatctttgctgttgacctcagttcattcctttcagattcttcactcaggagaagtcgtggaacagattcctggaggattccaggctctgtaaggaggcttatctccttaggatggttaaattttggatttgcagtgacttgtaatcattggctaatatcctagtttcttcttctcttttttaatgacaactttactgagcatacacacaactcattcctctaaagtgtgtaattcaggaatttcctagtatttttacaaagttgcacaaccatcaccactgtctaatttttgaacattttcatcactcccaaaggagaccctgtacctgttaagacatcactgccccttccccttctccccagcccccctggcaaccctgaatctggtttctgcctctatggatttatctattctggacatttcatagatacagaatcatgtgatgtgtgaccttttgcgcctggattcttacttcatatttctgagtttcatccatgttgtagtatgtgttgttctagtttcttgtaaatgttctgtcaaaaccccaggtgattaaggaaggtggaacaatgttctgagataagtcagccagagacacaggctgctcctccctccaattacatttaaaatggaaaatcgttcacaaatggaacattgttcataaaattgtttatagttcagcttctattctagcatgaacggtaattttctctttcgcatttgctgtagttcctccaaatttctcccactttcctatacctaaaggtcaacgtagaaaacaattttcgtcagctagagctgggcctgcaggtctctcttgtgttgcatcttttgggtggagtcagaaggtcctttcttggtgtaagagttaggaagcttgcatttcccaaaggggttgtgtggtgttccttccagagctgaggttgtgggattccaagcagcaagacttaggctgttttctacggcgtccccaaagtcacaaccctgactgatgcaggaacagaatcataaggttgtttacttttctgaatttatcaaaccttttgtctgtgtttgaccaaaattacttttcccgggttgggttggagaatatggagggtgattttctgaaaccattcatgggacatgattttctggggcatctgtacctgcaatgaagggcttactgataagactgaaggccattgtactttactggttggtgttataattgatcatattcatttcttgtcctactgtgacaagtgactgcacatttactggcttaaacaaaaactattatcttacggttctgaaggccagaagtctgaaatgggtctcactgtgctaaaatcaaggtttagcagagccacaactttcctggaagctctaggggagaattggcttccttgccttttccagctcctggagactggccgcattcctgagcttgtggccccttcctccatctgcagaggagcagcgtagcacctctctgactgtccttccataggcatatctctctgagaccatagctgggaaaggctgtccacttttccgggctcctgtgattacattgggcccatccggaagatccagaataatccccacatctcaagagacttaatttaatcacatttgtaaagtcccttttaccatataaggaaacatattctcaggtcccagggattcaggcatgagcatctttgggggccattattctgcctactacattgtcagtcttcaaggacagacttacttcctttgtttctgtctcttaatttgctcctctgaagcctgcaagattcataggcttatgtaacgtttgtgttttgtctctcgaataattgagaaatctggtactgttgagccatttggtttgtattgctcactcactgagtcgattgattggttggttgattgagtgattaatagagacagtctcattttgttgcccaggctggtctcaaactcctggtctcaagcgatcctccctccttggcctcccaaagtgctgggattgcaggtttgagccaccatgcttgccctcagtattgattccctctgaatgagccaggatttgctttccattttggagagcccctagattgctgaacagctcagagacacacttgtgtattgaggtcctctttcctgccactcttggttttggactttatcagggactctgccagagctacttttctggacttggagtctcagagtctgtgtcagctgtgggtaaggaatgagaccaccatgaagcaagcagaggtagcgggtggggcctggcttccaggactttgcagatgctgtgtgtggatttctggggcctgaatcaagagcccctgggtttgtggcttcacagaatggtggaggaagactggtggagttaagggacagaagactcaacaataattagcttgttaatcagcattttggctcaaaaatagtttgggagtatactggtcagctttctgccatgctaatgttgcataacaaacagcccccaaattcagaggcttaaatcgtttctttcttgctcactagtcatggttagctgtgtctctcctgggcttatatgggaataggaaggcctggtcaggttctgggctaggcttagggttgaaatgatgtgtctcctcatcaggggaccctggggcatgttgtttgtgcctctcccatcaggtataggaagccaagataaatcatgcaggcacatttaaagtctctgtttgtcactacccctaacatcccattgaccaaaacaagtcccatggtgaggtccagcctccacgggttggggagggctattctagtctgaaagccctgaaaagtcacatggcaaagggagcagccatagacttccactatgggaggatggaagagttagcattgcagtgcctctgccatgtttgtgggtggaagggaaggtgatccctgtggaagagactgtggatacatccagtcataccctagaaaatcagctctataggtggatttttgaagcactgtgtgcttgttatctttttattattactttatttttgagacaggatctcactgtcacccaaactcgagtgcaatggtgagatcatggctcactggtgcttctttcttctgggctcaagtctcctcccgcctcagcctcccaagtagctgggaatacaggtgcacactcaccacattcagctactttttaaacattttttttgtagagacagagtctcatcatgttgtccagactagtcttgaactcctgggctcaagcagtcctcccacctcggcctcccaaagtgcagggattacaggtgtgagccactgcacctagccagggtgcttgttaaacctgcagcttccttgattccatcttagagccctgttctcacctgaggagaggggattgtgccccttggggaacatttgacaatgtcgggaaacacttttgcgtttcacagctgggtgggggttgctcctggcatcttgtgggcagaccccaggggttccactaagcactgtaatgtgcacaggacagcccccctcaaagaattatctggcccaacaaatgtcagttctgctgaggccaagaaaccctgcacaaacaggcaattttaggtgattttcatgcactttatagtttgagaaccatgtcttgcaagactgttccaactgggaaggggaattggtgattctttccatataagtagacacggacacatctaggaaggaaggtttgatatctcgcagatagttgtgtggagaggcgaattcaaacccaagggtcttagttagatctattacttctgtaattaaaaaatatgttctgctcatattgtattaattctttgttgtattaagtatttactcttgctgtttattagtagcttaataaatggaccgtttatttggtgtgggaagaaatctatgttttattagatttctattatgagcttattttttttctaagtggccttttgccagctgtttcttctgtcctgttattcctgctcaccagcaagattataaattcttaaaaaatttgtttttaattttttttttgagaggggatctcactctatcacccaggctggagtgcagtggctcaatcatagctcattgcagccttgaacttctgggctaaagcaatcctcctgcctcagcctcttgagtagcttgggactataggtgcatgccaccatgctctgctagtttttaaattgtttttgtagagatggggtctcactgttgttgcgcaggctggtcttgaactctagggctcaagcaatcctcctgcctaggccttccaaagtattgggattacaggtgtgtgccactgcaccaccgcatcaccgcacttggccagtatatttatatatatatatatatatatatatatatatattttttttttttttttctttgagacagagtctcactgtgtcatgcaggctggagtgtagtggcatgatctcggctcactgcagcctcgacctcccaggctcaagtgattttcccgcctcagccacccgagtagctgagactacaggtgcataccaccacacccagctagtggccagtaagttcttaatagcagtgatcacgctttatattttgtttctactctgcacagtactcagcatacgataatgatcagtcagttgctaatggtatcaattgcaatgtgagttgcgctctgtggttaaagactcatttatgaggtatccgtggaccagccttttatactttgctataaatcctgtttctaggcttttggggctgaatggttggcatattgatgctcggtttctgtgtggcaattaggagaaaaggtccttgtcactggcaagctgacagcctcctttcttctcctaccctcaagttgttttggtgattgaaatgtttcagatattaaaaaaaaatcaagaattgcttgctgataggacaacagaagtacagttcagggagttaaagcttctccattccccacctcaattgtacacagcaagcatggacagatttccttgtagaaagcatgcaagcagcatttctatggaggatgctgtgtcacctgaaatttgctatgctcagatcagccaagtattgcctctgggggctaccagcaagttatagaaataactttgttatgaaatacttctttaagggggtgttagtattgattcactgaagtggttctccttgtgtacatggagtagttgtgagacgaaggtttcttttcttcctggctccccatgtgggaaggacgcttagtggtttgtgggatgcagggagaggaacagagtccatccttcagttgctctttttactaatttattaacttgcctctcatccccttggctgttaagacactaagctggtgtgtctgacaagcagatgacctaaaaattcacgcgtagtaaaagggaagatgaaaatagaagtatatgaactaaattaggaggaggacttggcttcattaaaaaaatgagaaagccatgttgtgctttttttaactgccacttttccaagtgcaggactaacagtttcagatgtcattatgctaccagtcttggtaatttctaatcatgttttgtctaaagaatatttacattaaaatgagccagcctctttaaagtcacattttagtagtgagaaaaccaatgtccgtttttggaaagggagcccttacctcagctggtgtgagcgttttgtggaggtctgcggtgtttgtgacttgtgccagaggccttgagctagaggcaacataagaaggaatcaaacttccctttctgttcggtatgcctctgtaccaagacgttttgttgattgattcatggcacggtgatacagggtgcatggtatcagatgcagggagtggaatattgttgagattggggctagagggtgtgtgtgtgtgtgtgtgtgtgtgtgtgtgtgtgtgtgtgtgtgtgtgtgtgtgtgtgtaggggaggaaggaatggaaggatgaaaccatttgggaatgtgctggaagacatgcttttgaggacaagcaatgcgattttggcattggctgggtttctgagccagtgatgaatgtagtgcattgctatgtgactgggagtgtgatagagagatattccgctggttatttccctccacctgcttcttatcagtgccatagggcagagtctcaattccacttgccagaatgctttctaggaactctttatgctcaatggaggtgatgttttcccacttgctatgctgtgccttagggaacaggaactggtattatcacataagcaatctctaagtcccttggaagattgtctcattcatcaagagggagaggattctgattttcctgcctggctcctccaggaagtctaacttcttgcaggggacctgttctctcggcccacttgtacagcatgtataaaaggaaatgaagacttttggggatttgttgattcacttgtttggaaattggggttatgtaagcccaatttgagttccaggactcatctatgattgcctggattaaatcaaaggacacccatgtaggctggacgtgatggctcatgcctataacccaagcactttgggaagctgaggcgggcggattgcttggacccgtgagttggagaccagcctgggcaagatggtgacattccatctctactaaaaatacagaaaattagccaggcgtggtggtatgttcctggtcccagctacttgggaggctggggtgggaggatcacctgaacctgggaagtcgaggctgcagtgagctgatatcctgagatcatgccactgcacttcagcctgggcaactggagtgagatcttgtctcaaaaacaaaacaaaacaaaaaaaaccaaaaaacaacctgcgtaattgtagatttttgttgttgtttgatatactgtctcttttcctggaaagaaccctctcgtgggaacagaaatgttgaatttagtcctgatgctgtccctaaccaccccgtgacactggtcccaggaaaatataggaattgtctctctttttctgtcatctcagagcttgagacaaatgttctctgaggttgttttagcaccacactgtgattcatcttcgagactgttcacagcccttgatctgaattgatggagctgtgggggatcataccgccactgccagtgctgagagctgcatgtggtgcggtccagtggctacagcgttgtctttgggatcttcacttggcaccacagcggatttgtataattattatgttgactggaacttagagtgactcaactgccttgaacaggaaccaagaaagagaggaaccaaattccagaagagaatttgccagaacattccagcatattccatactctagggttgtcttatagggtctgagggtacttcttggttatctactcatgtgcgtctgacataattaaaggccgacttagaccctatcagagaaaatcaagttcagacacttagtctaaatggaagtaaggaaaacgattacctttatctcattatcttagttctctttggaagatatataagcttgaaccatggtgacaggtgttgcctttaaacatggtgacaggtgttttcctttaaagtccttggcaaatcaactcatagacttcttcaacttcaaaaaaaaagtttttttaaaaaatattttaaaaatatttaacttgaggatcttcattgaaaattggtcatctttcgtgaatttgcttaagtaggctttgatctctttttaaaggattccttcctgcctgatacatttggtccttttagaattcgggctagaacaattctccatgaaggtggacgtgttaaaatctatttggttcattgttaggatcactcacattacaagagaaatttcggtcttgagtttttgtttttgcttatttgctttcttggaaatgtttccacatcaggtcttagaggagttgtaaaacaggaaggaggagttgacatgctgtttcataaccaatgcttgcttctcgccttggatactaacattttttccatccatttcccacataaaacatggagacaaacaccagagctgctcctgagaggtgctgagtcataggaattgaagggggctgttgggccctcgtgtgtgggatgggctcaagagctatcagtctacagagggaaaggttcatctctgtccctcattgcctgcagtttctctttggccctggctttttccgttcacagctgccctcgacgttcattttaatcaaatttcacctgcataaaagggctatgggcagagagtcttctctgtgatggagcgcagctatcctacaagtatgtagccctgatttagtagagaagaggcaggaattgtcgagggcggaggagcaggagaaatggtgcacaagggagaggggataatgacaggtcattcagggatgtctacggaatgtgaaaatgcagcaagatgggtttcggtttctttttttttaggtccgacagagattcctgggatagctgcatcttcatgttgtacacgcatacacttgattcccattattcactggagctatgttctgtaaagtcgctgagactttatagaaagcatcaccccagggaaaatacacagtgaggcttctgcgaacctctggtcacaatgttgttgtcaagcagtcagtgcataactttgttgtatgtatttctattgtgtgtttctgttggttcctttacattgcactcacgccaacagcactgtgactcacgcctggccgaacctcatctaacgcacgtattttccccataagacgcatcccagccttgtgcttcaggacatgagacagcactgcagcatctgggggccattttaagcagcaaagtcacccagaaactacaacatttcaaaaaactggcactgtgaatagactgcgaaaaggacacttgtttacggagtgagagccttgttcaccctcagctgggaacatgtgcatttggtgacacagccacacgctgcatgtttgagaatgaccatgaaagcgctgcaggtactgattttggagctacaaataaatgttagccaataggcaaattcacagacacggaatccgtaaataacaaggcttggctgtgtgtgtatacatagtgtagtgttgatagtgtgtatacacaatacacattgatattttgggagagattttgaagaagtcaccatgaaagccagtgtgtccgtttggccctctggaaagcgtgcggtgaggaggagtcagggtacaagtgtttaaattggggacatggcctgaggagatgaaagagaggtggggactgagtagggaaagctccacaccacaatgcataactgataaggttttggccaacaagccagagaaccctagagcaaagagtgccccttgcttacagccagagggccttgctcagtgaatatagggggctaggagtggggaggcatctccaaaggagcatcgtggatttgcaactctgtctttctggaaaggatatgagagtcttgccctctcccccagggctgacacagttgtaaaccaaacttttgacttcagttgtacatatcaattattttgcacccacattagattgaaccaaatgacactggctcttttaaattaaaagtggtcaaatgctggcagcctcttagggttcaattcaatggaatcttttaaaggtgcaataatgctgtttgaaatgaggagaacgcctgtgttttgtttgctgagagaaatccactatctctcatccagaagatgattagacccataatggaagccagtcagtggcatgaggaatcatggagatgattctcacctggttgattggatcagacgttcctagcccgaatgagggtggaaagggaaccaagagatgaagtggattgttgggtttatgagaggacggtggttgtctgtctatagttaaggttgtttaaactcatgaccatgagaatgagctttttctggataactctttccttttccttctgatttttgagagtgctgaaaactcaagtcctgtatttaaaaattccatcgttgaaaacatgtttcaaggacagatgacacacttatgattatagcatctgaagtgatgggaatattaaataacctttggttggacatgtaaccatcagggctccacttggtcttaaaaccaaacacacacagttcttgtcgttaaagatatccatggcctggcacagtggctcacgcctgtaatcctaacactttggaaagccgaggcgaggggttaacttgagcccaggggtttgagaccagcctgggcaacatggtgaaaccttgtctctacaaaaaatacaaaaattagctgggtgtggtgttgtgtgcctgtagtcccagctactagggaggctgaggcaggaaaatcacctgaacccaggaggtggaggttgcagtcaggcaccatcctgcgattgcactccagcctgggagacacagccagactccatctcaaaaaaaaaaaaaaaaaaaaaaagacttacacagagaaagcctgaagcccacaagagcaattagcaaaaggaaccctgacataacaaatacggtggtgtcattagcaaccaggtagttaagctcaggggttgctatgtgtcataaacttgaaagctacattggccacgagtaacacaaatgtaggtgctaatcacagatagttggtgggcatttcaaactttctcttcatatctatggatacccaaaacagtgtgcttccatttagaaggcttccattgggaggctgagacaggaggattgcttgagtccaggagatcgagattagcgtgttcctccctccctccctccctccctccctccctccctctctctctccctccctctctccgtctcttcctccctccctctcgtttctttcttttttcttttctttctctctctctctgtctccctctctctccctctccctccctccctcccctccttcctcctcctctctttcttttgaggtggggtctcgctaagtttcccaggctggtctggaactcctgggctcaagtgatcctcctgccccagcctcccaaagtgctgggattacaagcatgcatgagccactatgccaggcctattttccctttcctgctatttcctcccagctaacgcgcttttaaaatttgatacaaattaatttttctttttttgtcttttgttcaaataatgatttgatttctgttctctgtctgggtcgcttcaataacatggatacctacacatagttttatcagtaaaggtcattgacataatcagtgtgttgtgagaacaaagataggccctcatttaagctgctccattactcattttataagtcagagaaggaaggggacagcgtcctctgttttcagatggctattgaagtgagtcagagtgacggtgagcagcatgcattgaattctagctggaaagagggtttttaggcctgcgtttgagcttgccctgaatgaataaggctggaaacctataggccctggagaacattaatgaggaatctgctttccctgacagctccttgataaacgaaatgatggatgtgcagcgtgcagccctgagcaaaggcctggcagctctgtggctgagccctagagggctgagctgggccagggctcccagtagtttgttcaggagcactgagagccacagcaggtgctgatccagctcttgccttcttcgcgagtatctgacaagtctgcagagaccgcaggagcctggctactccttgagttcactgtcttggagcaagcctgtgggggaatcacatgcccccccactctagtgcccattggggacatggaggagggagtttccctatttgcagttaggttttgcgtgctgtccgcgagcttggtttcccctttgggttgcacagtgctgagatctgagcccaaggcagttgggacattaatgatgagacagaggaggctttgctgtgttccacatctatcaggctgctttgcccagggagacgccccccttgcttggggtcttgggcttgggtaggggttctggaatgtctcccctccagcaggctctgcctccttggcttccttgattcagagagcagtgcagtggctttgttgaggagcagcccctgtggaggcgctcatgggtgacaggctgtggctgaatagtggacagccctggtcactgacattaacatggtgcaatagagccttcttatgtgttccttggttcccactgccctttcatggtcgggtgtcctgattgtctgtggctagactatgccaacgtgatcagtgtccttcccagaacccctgaaagagggtcatagattgagatgtctgtcaccacccctgtccattgcagagtcacatacatgctagagaccagctcgcccttgatgcgacctgaggacctcgcccgctagtcattacagggaggggaaagacaataaaaagatgaaagagagtgctgtccctggtaatggaagttactcatcattgtaccagtgggcagccacatagggataggtcggaagagaaaggggaaagagtgaataaaaaacgctgatgtttgtgaggccgagagaggaacagaactattactgctggtcaagggggccatccacttaaaatgttcacatcctgtttcagccacaagctggccaagatcatcacataaagggacaaacgttggccccagaaagaacgcatggtcatcttgagtcaaggctgtctcatttgatgtcagaattcttaagagctgctctggctaggtgcagtggctcatgcctgtaatcccagcactttgggaggctgaggcgggtggatcacctgaggtcaggagttcgagaccagcttggccaacatggtgaaaccctgtctctactaaaaatacaaaaattagccggacgtggtggcaggcacctataaccccagctacttgggaagctgaggcaggagactctcatttgaacctgggaggtggaggttgcagtgagctgagatcaggccattgcactccagcctgggcaacaagagcaaaatcctgtctccaaaaaaaaaaaagaactgctcttggctgggtgtggtggctcacacctgtgatcccagtgctttgggaggctgagacgggaggattgcttgagcccaggagttcgagattagcatgggcaacataacaagaccccatctctttaaaaaattagccaggcatggtggtgtatgcctgtggtcccagcaacatgggaggctgaagcaggaggatcacttgagctcaggagttggaggctgcagcgagccatgatggcaccactgcactacagcctggacagcaaaggaagaccctgtctcaaaaaaaaaaaaaaaaaaaagcaagaaaaaaaaagcatccaggtgtggtggctcacacctataattccagcactttgggaggccgaggcaggcagatcacctgaggtcaggagttcaagcccagcctggccaacatggtgaaaccccgtctctactaaaaatacaaaatattagctggatgtggtggcgggttcctgtaatcccagctactcgggaggctgaggcaggagcatcgctcaaacccaggaggtggaggttgcaatgagccgagactgcgccattgcactctagcctgagcaacaagagcaagactccgtctcaaacaaacaaaaaaaactactctccaaacagaacctgcacctacccaattgtggtgggtgcccctcctggggctcctgcagtagcggtggtgtgggaattgagaatcttgcaagtgctatgagggagctgagacactgagtgtggcagggccatgtgcccagagcatgcacaacccatcctaacgtctgccggggaaggtgggggatttctgtgcattgcttttcaaccagaaaggtaatttttgttccccaggggacactcggcaatgtctggagacagttttggttgtgacactgggttaaggagtgctactgtcatctaatggatggagagcagggatactgctgaacatcccacagtgcacagggcggcctcacaacaaccaagaccacctggcctcaaatgtcagtagggctaacatccagaagctctgcgagtctgtgggaagccctggatgccccaatcctctttcattttcttctcaccacgtaggacagtttagctggacagtacacaggactcattcaaggggtcatgagaggagacctcatagcataagggtcaagtacaaggactttgcagtcagactgacgtgggtttcagtccctacccatcctagtggtgtgaccgagagcaagttgggcatagtgacatctgtcttgattgactttggagtttgacaggcagtacatgcaaagttctctattcccatgtcactcagagtgagtgtgcaaaacatactattgttggcatccatcgtcataagagtcactgtgaacatgggtgagcttagcaccttgtggcacggggctgtggtgagggactcagacagctttatgattgagtttgggcctcagcgagatggcaaagctatgcttctcttgctccttggaccatggtgacctgtgaggacccctgggggctgccttctccactgttgcagttcagggagctaaggccaaaggctactgcagtggtggactctggggtccccctggtgacaaggaagggactttgagctttggaatgccctgggctgagtcttgccacctgcaggtttgtgaacctcatcatgccttgtttttagcacaacaaaatgggataatagtgactttattattgatatactattatgctgttttcaggtatgtgacactgctgctattttactgtttcttccagatttccgtgagggtggaagaaaatcataccatatcagatgcctcgcagagcaccaggcccaccgtgaaaggtacagcaaattttacttccctcttcttgcctcgttggaaattctttcctgtgagatttcctcccctccgccctccgcgccttctgccatagcctatagcctcctctgggagttcttggataattttgttgccttatacctttgcaatttccagtatggtagccatgcgccacatgtggctgtggagtgcttgaaatgtggccagtctagattgagatgccttgtagaagtataaaatacacactggatttcaaagacttagttcaaaaagaaagaaagcaaggtatcttattgataatgtaatacagtttacatgttgaaatgatcacttggatacgtggagtaaaatagaatgtattattaaatgtaacttcacctgttttcttttgacatttttttgtggacccagaaaattgatagacaggtggatttccttcacacttacacacttgtcttgctcaagaccagccctgcttcctcactggctgctcagtcaaatgcctcctccagtttaagctgtccatcacggggccacccattatgtgtccatctcatcttctctgctcagtgcctgtgcaggcagctggtgttcctgctcctcccgcccagctttgcttatgatgctagtcttgagtgcaggctgctgagcttctcacctttcttcccatacatgtagaacctctcctccagaaacatggggtacttaccagctggcaaggagcagagctggggttcacattcatttctgtcttgctccaaatccatgtccctaatagattactgtctccaattgctttgtggatgtaaacacatagtaagttcctagagagcagggaccatttttatttctttcatctctgctgttcaagacctttctaaagcttttttgaaagaattaagatttctagtctcttgcccttccactttctgctatgtgaagacacagtgttcctgccctctgccctctggatgctacagcaacaaggtgccatgttggaaggaagcagagaacatccctcaccaaataatcaatcctgctggtgccttaattgtgaacttctcagcctgcagaactcacgaaggtcatcaccatgtaggctgattgatcttggacttccaagcctccagaactcaaatcagtgaatttaaaaacattttatggagggcggggccaagatggccaactagaagccacggtgttgggaggctgctatcagaaaagaccataataagcgtgtgaatccttcatcagcaaccaaggtatctgggttctctcatcaaaattgactagaaggctggcgtgacccacagagagaaggaagaacagtgtggtgtggcggcccacctgagagtcacatgggaaagggaaccccctcactccagataaggcaggaggtgagtgagcacgctacccagccggggaaactgcttttccacagaactgtgaaacccacggattggaagatctcactcgtgaacccacgccaccagggcctcgtgtcccagccccagaacacacagattcttacagcctctcagctggaatccgcttaagcttaccaaactcctcggggaggggtgaccagtaccagctgcagctgcctgctgtctaagccctttgaactcctgcagggaggggcagcagccagcactggcaactgcctaacatgctaagctccctggacagggggaagggtggcacccatttctgtagctacaggctacgcttttcccctgctagagccagggaggctggacagcttggtcccaagacttgtccccacagcccaacacactggctgtggcagtctgcggctagagtgcctcttcaggcccaatcccaacccatcctttcttagttggggtgtgtgtggggcggggcgcttccctgctggatctccagtaactccagccagaggctaagggacagaatttggatctcctgggcctcagcccataggggaggggtggccgcagtctctgctgaccagcagatttagcttttcctcctggtagttccaaggaatctggacagcccagatgagtgggtttcccccaagcaaaacacaccctctccaccaagggacagagtgctccattaaacgggtcctgctccctgtgtcacccaactgggtgagacccttcaacagggcttgtcagataccctctgcaggagtgatcctactggcatcaggttggtgccccttgaggtcagaggtcccagaagaaggagtaggcacccatctttgctgctctccagcatccttaatgacatctccaggcatgggagcgaatcagatgaataaggcctgaaggtgaaccaccagcaaactgcagcagccctacagaagagggactggactactgaaagaaaaacaagcagaaagtgacaacaacagcatcaacaacaacaatcaaataaaaggtccccacaaaaatctcatccaagggtagcagcctcaaagactgaaactagacaaactcatgaagatgagaaagaatgaaaaaatgctgaaaacccaaaaggccagagtacctcttctcctccaaatgattacaacatctctccatcaagggcacagaactggacggaggatcagatggatgaattgacagaagtaggcttcagaagatgggttataaaaaactacaatgagctaaaggagcatgttctaacctaattcaaagaagctaagaaccttgataaaaggttagaggaattgctaactagaataaccagtttagagaggaacataagcaacctgatggagctgaaaaacacagcacgagaactttgtgaagcacacacaagtatcgtgaagcataaacaagtatcaacagctgaatcgaccaagtaggagaaaggatatcagagtttgaagaccaccttactgaaataagacatgcagacaagaatagagaaaaaagaatgaacaaagcctaccagaaatatgggacctcataaaaagactgaacctacgattgagtggagtaccagaaggaggtggggagaatggaaacaagctggaaaacacacttcagggtattatccaggagaacttccccagactaccaagacaggccaacctgcaaattcaggaaatactgggaacaccattaagatactctatgagacgatcaaccccaagacacataatcatcagattttccaaggtcgaaatgaaggataaaactaagggcagccagagagaaaggctaggtcacctacaaagggaagcccatcagactgacaatggacttctcagcagaaactctacaagccagaagagattgggggccaatattcaacattcttaaagaaaagaattttcaacccagaattttatatctagccaaactaagctttctataaaatcctttccagacaagcaaatgctgagggattttgttaccactaggcctgccctgcaatgtctcctgaaagaagcactaaatatggtaaggaaaaactggtactagccactgcaaaaacacatgaaaatataaagaccaatgacactacaaagaaactgcatcaactaatgtacaaaataaccaaatagcatcatgatgacaggatcaaattcacacataacaatattaaccttaaatgtaaatgggctaaatgccccaattaaaagacacagactagcaaattggataaggagtcaagactcattggtgtgctgtattcaggagacccatcttacatgcagagacacacacaggctcaaaataaagggatggaggaaaatttaccaagcaaatggaaagcaaagaaaaaaagcaggagttgcaatcctagtctctgacaaaacagactttaaaccagcaaaaataaaaacagacaaagaagggcattacataatggtaaagggaacaattcaacaagaagaactaactattctaaatgtatatatatgcacccaatacaggagcacccagattcataaaataagttcttagagacctgcaaagagacttagactcccacacaataatagggggagactttaacaccccactgtcagtattaggtcagtgagacagaaaattaacaaggatattcaggactcgaactcagatctggatcaagtggacttagtagaagtctacagaactctctaccccaaatcaacagaatatacattcttctcagtgccacatggcacttattctaaaatcaaccacacaattggaagtaaaacactcctcagcaaatggaaaagaactgaaatcatgacagacagtctctcagaccacagtgcaatcacattagaactcaggattaagaaactcattcaaaaccacataatttcgtggaaattgaacaacttgctcctggatgactcctgggtaaataatgacattaaggcagaaatctagtatttctttgaaaccaatgagaacaaagagataatgtaccagaatttctgggacacagctaaagcagtgttaatagggaaattttgcactaaatgcccacatcagaaagctaaaaagatctcaaatcagcaccctaacatcacaattaaaagagctagagaggcaagagcaaactaatccaaaagctggcggaaggtaagaaataactaatatcagagaagaatcgaaggcgatagagacgcaaaaaagccctccaaaaaatcattgaatccaggagctggttttttgaaaaaattaacaaaatagatagactgctagctagactaatagagaagaatcaaatagacaataaaaaatgataaaggggatattaccactgaccctacagaaatacaaactactatcagagaatactataaacacctctatgcaaataaattagaaaatctagaagaaatgaataaattcctgcacgcatacaccctaccaagactaaaccaggaagaagttgaatctctgaatagaccaataagctctgaaattgaggcagtaattaatagcctagcaaccaaaaaaagcccaggaccaaatggattcacagctgaattctaccagaaatacagaggagctggtaccactccttcagaaattattccaaacatttgaaaaggaaggactcctccctaactcattttatgaagccagcatcatcccaatacccaaacctggaagagacacagccaatatcatactaaatgggcaaaagctggaagcattccctttgaaaactggtacaaaacaaggatgccctctctcaccactcctattcaacatagtattggaagttctggccagggcagtcaggcaagagaaagaaagaaagggtattcaaataggaagagaggaagtcaagttgtctctgtttgcagatgatgtgattttgtatttagaaaaccctatcatctcagcccaaaaacttcttgaactgacaagcagcttcagtgaagtctcaggatacaaaatcaatgtgcaaaaatcacaagcattcctttacaccaacagtaggcaggcagagagacaaatcatgagtgaactcccatagacaattgccacaaagagaataaaatacctaggaatacaagtaacaagggatgtgaaggacctcttcaaggataactacaaatcactgctcaaggaaataagagaggacacaaacaaatggaaaaacattccatgctcatggataggaagaatcagtatcatgaaaagggccatattgcccaaagtactttatacattcaatgttgttcctgtcaaactaccattgacattcttcacagaattaggaaaacctattttaaatttcatatggaatcaaagaagatcccacgtagccaagacaatcctaagcaaaaagaacaaagctggaggcatcatgctacctgacttcaaactatactacaaggttacattaacaaaaacagcatggtatgggtaccaaaacagacatatagaccagtggaccagaacagagacctcagaaataacaccatacatctgtaaccatctgatcttcgacaaatctgccgaaaacaagcaatggggaaaggatctccttattcagtaaatggtgctgggaaaactggctagccatatgctgaaaactgaaactggaccccttccttacaccttatacaaaaattaattcaagatagattaaagacttaaatgtaaaacccaaaaccataaaaaccctagaagataacctaagcaataccattcatgacataggcatgggctaagagttcatgactaaaacaccaaaagcaattgcaacaaaagccaaaattgacaaatgggatctaattcaactaaagagcttctgctcagtaaaagaaactatgatcagagtgaacaggcaacctacagagtgggagaaaacttctgcaatctacccatctgacaaaggtctaatatccagaatttgcaaggaacttaaacatatttacaagaaaaaaacaaccccatcaaaaagtgggcaaaggatatgaacagacacttctcaaaagaagacatttacacagccaacaagcatggtaaaaagctcaacatcactgatcatcagagaaatgcaaatcaaaacctcaatgagataccatctcatgccagtcagatggcgattattgaaaggtcagaaaacaatagttgctggcaaggctgtggggaaataggaatgcttttacactgttggtgggaatgtaaattagttcaaccattgtggaagacagtatggcgattcctcaaggatctagaaccagaaataccatttgacccagtaatcccatttctggatatatacccaaagtaatgtaaatcattctgctataaagatgcatgcacgtgtatgtttcttatagcactatttacaatagcaaagacatggaaccaacccaaatggccatcagtgatagactggataaagaaaatgtggcacatatacatcatggaatactatgcagccataaaaaggaatgagatcatgtcctttgcagggacatggatgaagctggaagccatcatcctcagcaaactagcacagaaacaaaaccaaacaccgcatattctcactcataagggggagttgaacattgagaacacatagacacagagaggggaacaacacacaccagggcctgttggggagtggggatgagaggagggaactatgagggtcagtagggatggtgctactaattaggtagtagggtgctgcagcaaaccaccatgacacacatacacctgtataactaacctgcacgttctgcgcatgtatcctgttttttttgttttttttttgtttttttagaaaaagccgggtgcggtggctcacacctgtaatcccagcactttgggaggccaaggcggacggatcacaaggtcaggagatcgaaatcatcctggctaacatggtgaaacaccgtctctactaaaaaaaaatacaaaaaattagccgggcgtggtggcgggcacctgtagtcccagctactcgggaggctgaggcaggagaatggcatgaacccgggaggtggaggttgcagtgagctgaggcgacaaagcgagactctgtctcaaaaaaaaaaaaaaaaaaaagatttctagtacattgcctaaaagaacccttggatgaagtcagacacatgggtagtatgagaccccagatagcatcattttgtatgtacagaatcgcttttttttttttttttttttgagtcaggttctcactctgtcacccaggctggagtgttagttatgtggtcatggctcactggagccttgatctcgtgggctcaagtgatcctcttgcctcaacctcccaagtagctgggattacaggcacacgccaccatgcctggctaatttttgtattttttgtagagatggggttttaccatgttgcccaggctggtctcgaactcctgggctcacgcgatcagcccacctcggcctttcaaaatgctaggtttacaggtatgagccactgtgcctggtctagaattgcttttagtggatgattttttgctgtcactgttaatggcgtgcattttctgagttatcagagatggccctgcatgctgcgagtctgtgttgactgtactgttggctgtgtgtgtggagggcaggaaagtgccgtccttgctgtaacttgtgttattaatgatatggacactgtgagttgcttctagagagctacacctcacttctgtgtcagcaaatgaaggcccaggaactgacagcgttccctctagctttaattgcggtataatcaccacaccctaacattctcctgttttacctttggcaacatctagagtttggttgtcacagctgatggggtgggggtgctatggcattgggtgggtagaggccaaggatgctgctgggcatcctacactgcccaggacagccccccacaaattatccagccctaaatgtctacagtgccacaggtaagaaatcctggaccgtagggtagacagatttgactggagtggagaaattgtatcctggggtaagtgggatttggattgcagttagtgcagagcttgtgtgtgtggaacgccttggacactggactaatccaagaagttgggtggggaggaggggggctttttctttaggtcctggaaaccattaaaaacctttgaacaggtgctttagaaagacaaaactggcatctgtctgaaggatggattacaacaggcaccagcagactgtggcccacggggccgtgtccagacttggcacacaaccatgcccattcattcatgggttgtctctggctgctgtgatggttaactttatgtgtcatcttggctaggccatagtattcagatatttggtcaggtacttaggaatgttgttgtgaaggtattttttagatgaaataaacacatcagtagactttgagtaaggcagatgacttccataatgtgggtggacctcatccaatcagttgaaggccttaagaaaaagactgaggtccgccaaagaggagggaattctaccagtatcctgcctttggatttgagactgtgacatctgcgctttcctgggtctctggcctgctctggaaagtttgggcttgccggcctccacaattgtgtgaaccagttccttagaatctgtccatctgtccgtccatccatccatccatccatccacgcacgcacacataaacaaaccctattggcactgtttctctggacagccctgactaacatcactgctttcttgccacagcagccaagttgaatacgtgcttgtaagtacagggattgtgtggcccacaaagtagaaaatatttactctctggccctttacagaaaaaaggccaagcattggatttggtaagtgaagtccttccatgaaactgagaagtgctgagtcagtactcaatgggagttaaaacagagaaactgtaaaagccaagagggctcaggatggtgataatcacggtctttcattcttttctcctgtgcacatttgacccgctggcatgcaggagatttaatctctctaatccagaatgtgttttagggaatggcttgcctggcttgtgggttgaaatgttctctcctcagatgtggctcctgcaatatcagctcacctgatgacaagaagtggaagccatgtaaccacctgagacgcaagttaattagggtttatcagaaagacaacctgaacccctgtgggatgtgctgtgggtgaagaaaagataccagtattctgtgattccaaataggagattttaaaaattctacccctggaggatgggttggcatttgtcttccaaacataggttaaatacgttttatttctgtctgttttgtacacattttaatcattttccagctcacaattacagttggtacttctcaattctcagtgaattgtgtagtggaattgtttgcaacatcatactttggaaatgacgttggcaattaaagttttggtccaagtttaataatgaagactatttgaaaggccaaaaccgatggatgcttttgagatgaaatagtcatttgggaagaaaatgagggcaggttgtctacttcttaacatttatctgtttttttttcttttttgagagggtcttgctctgttgcctgggttggcgtgcggtggcgcgatctcaggtcactgcagcctcaacctctggggctcaagtgattctcccacctcagcctcccaagtagttgggattacagacacatgccaccactcccagctagttttatttttttgtagagatggggtctccctatgttgcccaggcttgtctttaactcctggtctcaagtgatcctcctgcctcagcctcccaaagtgttgggattacagacatgagccaccttggattacaggcatgagtcaccacgcctggccttaacattgatcttgatgacactgaaatcgttgatgtgtgccaagggggttcctttttctaaatggaagctcactgttttgggtatccatgaattcatcatagatatgaagagaaagtttgaaatgcccaccagctgtctgtggtagcacctacatttgtgttactcatgaccaatgcagctttcaagtttatgacacgtggcaccccctgagcttaactacctggttgctaatgtctttggacatcactgtatttgttatgtcagggttccttttgctaattgctcttgtgggctttcagactttctctatgtacgtttttttgttttttggtttttttttgggagatggagtctctgttgcccaggctggagtgcagtggcgtgatccactgcaacctccacctcccgggttcaagtgtttctcctgcctcagcatccctagtagctgggactacaggcatgcgccaccacgcctggctaattttttgtagttttggtagagatggggtttcaccacgttggccaggctggtcttgaactcctgacctcaggtgatcctcccgcctcagcctcccaaagtgctgggattacaggcatgagccaccgcacccggccagtgtaagtcttttgaaacacagacacctagtgcctttcccgtgagtctttcagggaaagattgagttccgtgtcaggttggagttgctgatcaagcgactgactatacggcttcctagccccctttatttgaaaaaccagcgtggtcttcacttttcccttgagcctacaaccacagggtgcctgttcatgtatttccaggaccttatgcggctcctttgctctgcttattccgagaaccaagccttgggactgtgcattttgaatacaaatgaaggcacccggaggaagcccccagagtctcggcacagttgaggaaacaaacaaagcatgctacacgtgcaggaagatccctctttaattcctatgatgacctctctgcttttttattttttaagttaaaaggagtcaatgctttgggttttgttagactggacaaggtagcaagtcatattaaactaacccaggttgttgcttgagttttcactgaacttagactctactgacgagtatagtcaagcagaaattcccctcacgaggtggcctgatggtgtactccagtgggggggtgcagaagatttggagggatctgcttcccgactggggcaggttaacctctttctgccttagttacctctttgcatgtcctaagagcacctgcttatcagatccttaggaggattcactgaattcgtccacttggaatccacatggaaggctgcctggcatgtaggaggtacccagtaaattttagactcctgttatttttgccagttggattcaacagatgtttgttccctggactagtgtttctcacctgggggtgatctgcacctaggggacatttgacaaagtctggagacattttgggttgtcacagcttggggagggagtgttactggcatccagtgaatagtaaccaggtgtattagttttctgtcgctgtaaaggaatacctgagactgggtaatttagaggtttatttggcacatagttctacaggctgtacaggcatggtgccggcatctgcttggtttcttgggaggcctcagagcttttgctcatagcagaaggcaaagggagagcaggtgtctcacatggcaagagagggagcaagagacagagggaaggctaggctcttttaaacaaccagctcttgcatgaactgagggaactcactcagtaccagggggagggcaccaagccatggttcctccatgaaccaaacacctcccaccaggccccacctccagcagtgaggattaccccactacatttcactgtgagatttggaaagggaagacatccaaactatgtcaccaaagatgctgctaagcatcctaccgtgcacagagcagcccccataacagggttacctggcaccagagtgtcagtagtgttgaagttaggctacactgtagttcacttgcttattgtgtgtaggaagaccggaggccagttacctggcaataacaacaacaacatcaaaaccccctcaaacccaaaacaaaaaaaccccacatgacactgtgagtgttttttttttaatttgcaggagattgagtcttaatccagttgaagacctttatttccttgctagttacagagaggtttttcctggttcgttgcctgtgtttgttgcagttagtttttattgacctttctagggttcatgtgtgtcccttgggtttgccatgttttgttctccaaagccccaggagggttccccagtaacagagactgtgttagatttttaacattttcttttactttttgttttaaatgatttcttttgattaattacacactcacactgcgttgcaaacatagtgctgtcagatcccagtactgtgtcctttaccggctttccccaaggggagtggcttctcacaggatcatagagcaggaaaacccaggaaatccacgttggtgcaacacagttacctagccttggagcccttacttggatttcaccctttttgcgtgtactcatttgtgagttgcatgttaaagatgagagtcagtaatatatttccaaatgtcaacagaacataaattgagcagaagagtttataatgagatggaggattgagcagaagagctcatagcgagccagggcgaacaacctggcgaggagctccttgactttcttggaggccgaggtgggagcgttggtgacaacccccgggaaggcagatgttatcaggagttaaaatgtgatgtgtgtaccgctcatgtgtgtatggggtgtgctccttttgtttttgatgctgaaatgagacaaatcatttcccttttaagctccaggcagactgatggaggggggaaaaataacacccaacttactgcaacctgaaatcctttgccttggatccacttcctaagttcctatagtccttattttataaactgataaaacaacttttctctctcaagtgatgatcatcttgtgttttacactaattaagcccatatacacctccctttggaattccttcttctgatctgcttggcctgtttgccagttagtcgccttactaggagaatcaaaatgtaaactcataatagacaggaacccaacatcatcagcacaggatgtggcagaatgatttttctttcccacctcttgctgagaaggcaatgagattggaaatggcaaacaccccagagttctgtaactctgagtgtggaagaggaggtggcagcccttgacctcagtagcggagccagatcatcgaacatccccgtccaggaatctggacatgcactggtcaagaattcagcacaatttcctttggtctggggattgggaagctctttttgtgagtgaggcatggagtgaaattgcagaagcctgcgtgacttgtagaaaccgaagccaggctcgtttactgccttgcacaagggagatatgataagacagaatttatttgtgagtgtcgtcgatgccaaggagcctgtccaacatttatagaggcttttgggctaaacgaaaaagggtttgatctgtctgtggagacagaaagtagatgagtggttgcctaggactggggctttaggcgggtaagaggttgtcactgctaaagggtacagggttaatggaaattcttgaaattgtgctgatggtggctgcacaactctgcaggtactaaaagttgttgagttgtactcgaaatgggtccactgtatggcatgtgttttatatctcaataaacctgtcaaaaaagggtgcaggaccactgtttttgtacatgtcctcaaaatacttcctgtaatctagtgtggtcacagctggttcatgtgcacggacatagtgtcagtgtcattgtggagatagcagtttcagattcactggttccagaaaatgtgtccctgcctgttatctccgtgttgccacaattaagaaccaagggtccataacaagcagtgaaaccatggttcatatcagaggaagtggggtggtgtcatctcttttgtatttttctcttttctctcccccactgcctttgcccacttccttctccaaaataaaacaaaagagagaaagcaagagataagtggctgagctgaatgtggtccagccctttagaagaggggagtacacatactggagggaagataagcgaaaatacagcctttctcaagggccagcacagacggagataaagagagagccacaggcacactggccaagcatcagctcctcaagcatccatctcactattcagggtggggaaatacttgatacctcaagtcctctttatcatcgcagatgaaaactgacataggtgatttcctttcggagcatttagggagaatgcaagggaaattgacaacacacttggtgcaattgggtaaccagtctttgtgttgccctccaatgactcttgcttggaaatgattggaagcccatcgttttaagtcattggaacgactgtccccttcataaagcatgatgtagcaaaatgaaaagcatacttctggttaaaagtgtttttcaaaaaaagcttaccacattgaggaggtcatttcatatttcctgatattcagcaattttgctgtgagctttgtagagttgttctggtgcttagttcaaataagaaaggaattactgaaattgcacattaagttaaaaaaaaaatcagggttttgggtcctgagacttgttacctaaacatctgtcttgctattttgttacagcacaaagtaggaattgtaaaacatcttcgttataaactgagtactatacagtctctgggagagcagaagaaacgtggtaggaaggaaccacccagggtgggtaatgacagagtagagatagtcagatagggccggagacaaggccaggaaaggcgagaggaagagcctgcaggaacgagtttcttgcacgtttgagagctggacctgccaagagggtaaggccaacatctgtgtgtgttctttgaggaaatccgagtagcctgccctgcctttgaccctctgctctttgaactgtggattccttcccatacacctgtgcattctcagtgccgtggtcagatccccaaacagacaccaaaccccgacctccgaggcccaggcaggagcataacccagccccaaggggagataaagacagaaagaatcagtattatagcagggacctttttcaggaatctgccttctgcagggcagtgccctaggtgcattcaagccagcatagcaaatccacatcactagaaagactctttccgttttataacttgggaaactaaggccaaggcagtgacaaatgccaggtccccaaactctgaactgcagatctgcaagctgaatggtggcaggtgggccagtgggattttaaagccgtgtgcttttcagggcaccctggtgcttctccaaatgccggaagggtttccttgaaaattcatagcactactcagtcaggattctgcaggacagtgccctggggagtgcatgagtggatggttctgtgggtagaagccacgagctgaagatagttttacatgtttaaagagtaaagagactgggagcggcggctcatgcctgtaatcccaacactttgggaggctgaagtgggaggattacttgagcccaaggagttcaagaccagcctaggcaacatagcaagaccttgtctctaaaaataaataaaataaaataaaagccaggcatggtggcagtgctcctgtagccccagctatgcgggaggattgtttgagcccaggagttcgaggctgcagtgagccatgttcatgccaatgcactccagcctgggcaacagagccagatcctctctcaaaaaaaaaaaaaaaaaagaaaagaaaaaaacagtaccttgttgatacatggaaatgatgtgacattcagataaagttttactggagctccgccatgcccattcatggacatattttctatggttgctttttcacaacaaggggtgttgcaaccatggcaacagacactgtctgtcttgcgaagcctaagatatttgctctctggtcctctgcagaactagcgtgtagttctgagtgcttgaaggcacgtaccatcttggtggtgtgacttggactttcacctctcctgatcccttcttcatttccaccctactctcatcttgccttgcttgcagaagcctggtattttcataattcgagagtcacttacttcatgtgaagtcttgtcccagttaaagtgccaatagtcctgggagaggtaatacattaaaccttatcagttatttatacctcaggattggaagggattgttgctggctttgtcctataacagctgcgaccagaggacagagcctaagggctgttgcatgaaatgagggaggtgtgggtcacctctgtgcagggcatgagaagagaggaggctgggtcatctgaaagatgacctttgttcatggcctttttctgtatcctcctcagtcacccagaaattgggattgttggtgacaatcttttgggaattggtgttagcttcggagagccacttagcctgaagaccctccttactccgttatcatagaaccagagtggtagccacacaggcagactgtccatgctgacgtgtaaggcagggccttacacctcctacccatgtaggaggtggtggagctgggattttacatggacagccttctgctcccctggtgcttagctacattctagtgccttctgtgcaatgccagcttaacatacatatgaagtgtgctgacccaatctcctgcctttgcgttcactattttagatggttgtgtcaccttgagcctggactagggagataacacgtgaaggagatgccgcgtggtttctgtcttgtccatggtacgtggaacacattcccctcagtaacattatggttgagacatggaatgccacaatgtacagttgccaccatatggtatacttcatatatatacacatatatatttatttagtttattttaatttttttagagacagagtcttgctctggtgcctaggctggagtacagtggtgcagtcgtagctcactgcagcctcgatctcctgggctcagtgatcctcccactgcattgtcccaaagcgcttggattataggtgtaagccactgggcccggcctacttgtatatttttcattgcaaatgtacatttcagttacgttgtgggctttaaaaagcctttctaggctagttgggaatttgaccctattttttacagcatagtttctaggagaaaaacatttctgaggaagtaacaaaagaagacttgggctgtatcccatttttaatttagagagcactgtcatttgaaaatttcttctctcaacatgttttctttttgagacatgaagtaggcaggcaggatcttttttacagtggcgctggtgtctttgggaagcggcttccttggtttgcctttgctcattttctttcttgacttctccaggcattcagctgcaggcatgtacctctgctgctgggagagtggcaaggagagggggttggaggaacggggataaaaattagctagaattcaaaaacggcagtgacagcccagatgatttttcatgctaacctactttaaaagctgccagaataattgtggagtgggaaatctctcatttctcctgtcctactctgacaagatctaaaaataactttgaggagatgggcatgtggccctttgatctccttggcctggagtatttcttggtaggagcagagcttacaagaaggtgttcttcaatgagtgttctggcagtcggagttgtgggtggggctgattactgtaatcttccttcgtcattgaacgatttcatctgcccctggtttccattacttgctgctctaaatattcctctccccgcaccttccttttatgtagccacaaactggaatatgtgcatggaaaacccaaaggaggcaaatcccacttacactgcagaactttggtgctggatttagcggctatttaccaagcacctcctcttccagaataagtagcacagatctttgaccgccccccgccccccaccgagggactgtggtctagttggaagacacaaggcagaggtgtaaaaagggaactctggagataggaattggaaatggggctgagagctgaagagatggcctggggctagagaccagggagatgggaggagggggagttccttggaagagtgtgcccctaagagatcctgaagagtgagcagagattgatgagaggcgagaggagacctagagttatcagggctgcagaggtgtccttggcacatagaggccatagtatccacgttggcttccagggtaggggcagtgcatctgcggctggctgaagatggaataaatgggatagtggctaaaaagatgggggtattgggggaacacctctccttggagtggtcctccttgcagataaggggagacgtagaacagcacttgacagggaagctggtgtgggggaaggatttttttacactaggggagacttgtggttgagttaaacaggttctagaggccaggcatggtggctcatgtctgtaatcccagcactttgggaggccaagttaggaggattgctcgagcccaggagttggagaccagcctgggtagcagcagcatagagagaccctgtttttacaaaaaatacaaaaattagctggacatagtagcatgcacctgtaatcccagctgctcgggaggctgaggtgggaggataacttgaccccaggagttggaggatgcagtgagctgcagttgtgccactgcgcaccggcctgggtgacagagggagaccttgtttctaaggggaacaaaaaaagaagttaaagagataagataaagaatggggggaggggacgtattttttgcaggagggaaattttgagggtttttagccttggaaaaggagcagaacagatgggaaggtcgtaaacgtggaacctttggaagcagaaaggaagatgatttctcttaaaaagttttgcctagagatgactaatgtgaaggtcttggtgttttaagggagcagggaaagccagaggtggtgggtccggtagatgcaggaactgacccaggctttcagattgtacactggggagcagagagtgcgtgcttgggggtggggaggctgctggccagggctgaccttcctcccatgacccctgcgtagaatcagagtagcctcatttagtgtacttgagtcaaggccttctgtttaagagcttatttgaactcattacagtcatcgcttggtatccttgggggattggttccaggacctcctgcggatacccaaatgattgcacactcaaatcctgtagtcctctcagcaaaacctgctgataggaaaagtcagccctctgtgtctatgggttttgcatccccagatactgtattttccatctgaatttggttgtgaatgcagaacctgcccataaggagggccaattgtatttattgaaaaaaatccgtgttgttcaagggtcagttatagtttgaactacaaaaagcaagcaaccaaacaaaacccccaaaaaccaaagctttaattggttaagtcagagcagactaaaaaggactacatgcccagtggaactttctgtgtagtctagtagccatatctggctatgaagcacctgaaatgtggctcatgcaacagaggaattgaattttaaattttattccttttaaatatttatttttgtctttcttcgtttcttttttttttttttttttccctgagatggggtctcgctttgtcacccaggctgaagtgcagggtcgcgatcactgctcactgcagccttgacctcttgggctcaagcgatcctcccacttcagcctcccaagtagctggggccacaggcatgagctactttgcccggctaattttttaacttttgtagagatgggggtctcgccatgttgcccaggctggtctcaaactcttggtctcaagcaatgcttccacctcggcctcccaaagtgctaggattacaggtgttgagccacaatgcccagcctaaatatgtatttcagtagctccatatggggaggtgtcttggacagagcaggttagcccgtgagactctctggtccttgagtgagagggaaggatgagggcttgcagatgatcccagtgggctggttctggaagcgaaacctgcaggccccatggcttggggaaggctgaccatagcaggtgggaggagctctctgaaggccgaggctgagcactggtggagaacagggcccgtgctcacgtatcccacaccccagaacttggtgtgctggattccagccttgtgtgtttctcattatgactatgtaaatgccaggagggttgggactgtgtgatttttcttcttgcttggatgctcgagagttcttcattaattagtgaaggaaagctggctctaaggagaagcagttgaagtggagttcattgcccccacttctctgcagcaggaatgccttgtccctcctgcctcggttgaactcactttctcaggctcccacctttgaatggaggcccttgtcaggctctccatccccagcgactctgttgacatttccccatgggaaaggaaaagaccatctgaaagtttccatctgtgtgcaaggttttctgaacatgttgacaacatgggtttaattttgtgaggtcagcaagagttcttgtggtttgggatttagtaaaaactgtaggctttgtatgggaagaaaatctctctcacctctgtcttctattcttcattctctacacagactctccacttgtctttagcactaaaaacacaaactaagcattatgttttaaaaaaaacccaaaccccaagtccagtagctgattgccctgctttagcttttctccctcgttgtcattcttcaaagaaagactccactcctttcagctgtcaccctttcaccctgatcaccgcatgcagtctggcctctgccccgcttgaaagaagcactcttcccagggcacccgggaactcggaactgtgaacccccagagtctgcccagcccctctgtccctgccttttgagcaacagcgactggtgccacaacctggggtgcccctttccctgggcagcattacccacactgggccaccgtgggccaagtcacccacactgggccaggtcacccacactggaccatatgaggccacgccactcacactgggtcatgtcacccaccccaggccacactgggccatgtcacccacacttggcagggtcctgtctttctccactctggtgtctcctttatcttgatgctcaagactctctcaaaacaccagtggttcagcacagtgtggggacagagacttcagcgaggcgcccccagccccacccttgacgggaaataagcgcaaactccttgtgcctgagactcaaagggtcgtgtgcctttattggcccccttgccttacaccagtgttcttaacctttctgtgtgtgtgcgtggctctctgtagtcatcgagtgaagccgcagaggtctcagaatcacattctaaaataaaagtagaatcataaaggaagcgattaaaagtgcaattgtcaaaatatcaaaaacatgatttgttgaatagtgcttttttcttttctttttattggtaaaatacatgtaatataaaatttagtcattttaaccttttttttttttttttttttttttttagacagagtctcactctgttgcccaggctggagtgcagtggcacgatcttcactcactgcaacctccacctcccaggttcaagcaattctcctgcctcagcctcctgagtagctgggattacaggcacacgccaccacacccagctaatttttgtatttttagtagagacagggtttcaccatgttggccaggctggtctcaaactcctgacctcaggtgatccacccaccttggcctcccgaagtgctgggattacaggcgtgagccagtgtgcccggcctattttaaccatttttaagtgtacagttcagtaacagcaagtacattcatactctgcacagccaacctccagaactccttttgtctcgtagtcctgaaactccatacataactacccactcatttccccattcccagccccagcacccacccaactttctgtttctgtgtgcttcacagctctgggacctcagatacgtggaatcctacactatgtgtctttttgtgactggcttatttcactcagcgtactgtcctccaggttcgtccacatggtagcatgtgtcagaatgtctttcctttttaaggctgagtgctgttccattgtatggataggtcactttattcctgtaactgtagatggatacctgggttgcttccaccttttgactgttgtgaataatgctgctacaaacttgcctgcacaaatatttccttaagatcctgctttcagttctttgatgtgtgctttctaaaccttttttattttttccttttgttttgagacagggtttcactctgtcccccaggctggagtgcagtggcacgatcgtgactcagtgtagccttgatctcctgggctcaagcgatcctcctgcctcagtctatcaagtagcttggactacaggcacatgccaccatgcccagctaatttttgtatttttggtggagatgaggtcttggtatgttgctcaggttggtcttgaactcctgggctccagcaatcacctgtccttggagggagttggcaatggaagtgggttggctgttggagcccattagaatattccagagggatgatggttccttggaccagggtgtggtcaaggagctggagagatgggagtcagttacagacaagacagtgggatttattgggattcttgatttctctcagtggtgagaaatttcgtctttccacacaccttccatggaaacccggaacaccatgggtcccccgtaggcagtcttaagaggatagctgtttttgttctccttccaaattcccattagacttgaggtcagagtcacactttacttgttttgaatatttaaagtagtatacctaatagctcaatagactgtatgcttttatttttattttttgagcctgccttcctaggtatttggacaaatttctccataagagaagtgaacacgtaactctaacttgtaatagcaaataccgcgggaacactgggagccacatattaagatgttattagaccttccctggagtatccaaatggtctataattgcttaataaggagaagtttttgctgagatttacatgatagagatttgctttttaaaaagaaattatccagatttgaatggaaaaattgcatagtctcctgagtgttgttttgcctttgactttgtactgtttaagaactgattatgagcaggaggaaataactcacttcagctgtaatataaatgtgcattggtatttaagcatatgtgacacataaaacaataccaacttggccagaatttaaatgtttatgtaaattacatttttggacaggcactttcctctattttgcagagaaaataattttttcccaaagagattttgtgtttaaaaaaaaaacccctaatactactattaggagtgttagatgccttcgatgtggttttctttcctctttttgcctgaaaggcttgagtgctgaagcatctagcgctattcttgtgtccgggaacgttcctgcctcatttttgtttctagtcttgtttctttctgtgtcagaaataagactaatgcgtgcagctgcacctatagttcaagatgaaggggtctgtgtgagagagagaacgtctgtgcatgtgtgtatgtgtgtgagtgtgtgtgtgagagagaggagagacgggcgggggaggggagagagagagaaaagagagagagagaaaaaaaaacacagcctctttgtaatacctggttgactcagtgaagtctggctctctgagctttactgaattcctccttacttattttggggccggaggtggagatgagttcaaaagtagataaaatttgcctgttacctaaatgagcagaatagattgcgcataatcttttctagatgaagcctgtgtttttggcattctgctctcaagtcctctgagctgatctgagagtgaactggagtgttaagttgagagagatgttgatgactctggtgtggtcttttcctttcggagaagtggaggtgaaacgacttgcccggggtccctgggaagcagagcttgtgccaagatgtaatttttcggttctaagccctgtggtttttcttctgcagcaaggtgggtaccctttttctgtaagggaccagagagtatggattttaggattttggggccagtcttggcaactattcacctctgcaactcagccacattgtgagaaggcagccctgcacattgcataaacaaacaaatgtggctgtattccaataaaactccatttatggccactgacttttgaatttcatagaatattctgtaagcatgtgtcagcagcttcccctgtgcaggtccatgctcagaggtagtcgcgttggggaaagttgctttctgccctcctggagttgatagacttgtggggaggcagatactggaaagcagccacagacacaccaaaggggggagtcagtcccctgtcatgggaattgtgatggggagcgccctcccctgtgcatttagaaaggccccgccacacggaaccactgggaagctgaggcttggagattgcgtgggatttgagatgagccaggcgtgggcagggagatcgcacaggggaaaggaggatcgccgtggatcacacaggacaaaggaggtcctgacctgtccacccccaaagccctttgcttccctagcccacgttggtgtagggtgggccgagagggggcgcagtgtgaggagtgactgtagctgcagctcagcagcgtctcaggagaagccagctgtctctactcaccacgggagtttatttccagtgtgggagagggactcttgagagagaaggacaagatgcccgtttgccctacagattcctttgaggaaaattcctataggggtctcgtctctgttgtatttattgtagtacgacctttttttaagtgattcaccataatctctctaggccgtatttaggcactgaccctaaatgtgcgttaaaaaaaaaggtttgggatattttggtttatttatttgtgtgtatgtatatagttgttaaattggtgtccttggggtgggggttgatcggtggaaccttatcttctctgctttcttgctccaccccatattttggtttgtttttgttagaggtcggcaaaccttttgttgtcaatggccagataataaatattttgtggtttttaaaccctgtagtctctgggtgttatatggcaaaagcagccattgacaacatgtgagtgactgagtgtgtttatttatgggcactgaggtgctgggatcccatattcacactgttccgccaccatcaccgccattcataactcccaaactttttctttttcttggtggaggagtggagcagggtcttgctctgttgctcaggctggagtgcatcacggctccctacagccttaacgatcctcccatgtcagcctcccgagtagctgggaccacaggtgcgcatcaccacgccaggctgattttttaacttttctgtagagacgtggtctccttaggttgcccaggctggcatcaaactcctggcctcaagcattccacccactcctgcctcccaaagtgttgggattacaggtgggagccaccgtgcccagcctcagaaatttttcattatcccaacccgaaacctggtccccatgaaacagtaactccccattctcccttcccccgcagcccctggcacccaccgttctattttctgtgtctgtggatttgactagtctgaggtgcctcatgtcagtggagtcatgctctgtttgtccttttgtgtctggcttttttcacttagcataatgtccttgaggttctcccatgttgtagcctgtgtcaggacatttgcagctcagttcatttccgaggaattgtcctatatgcagggggtcttaggaacacaggtaacttcacttcccatttgaagagcgaggagttctcccgaggccctgaacaggaatagagactgtgaggcattggcgtttggaaggaagtgtctctgaaatagaaacgactgtcagatgaagagggacagttcagtatggtacccgggcctgcctttccagacgtccccagcctctttgcctagttcccactctgggcccctgggcaggtgacccgcagctgcacatgggtttcctgggaagccacagtgctgaggatcttgggagagaggctcaggatcagagtctggggagtgcaggagcttgcggggggagggggtggggtcagtgggggcggggggtgctgctttggggattgggaggagtggactggggcggggtcacagagtctttagctgaacccatgggtgctctgggtctcggcttgtcctgactcaagtcaaggggcccaggcctttgtaaaggtccacattgcccattcactggggcctggctttgggtgagggtggcagctggagatggggggaagccctgaacgggaatcttggccacacactgctatatccgcgacaccaaattctatcccacctgttgttggctgttctggaaaccagcactgaaaaatacggagtggaaaagttttctgattttttttttcctgctttgtttgggttttttggaaaacaatttcaaaattagcatatggcttgttaaaattaaatcacaaaggaagtgcctatggtaacgttttgatcaggctctaggtctgtgtgaaccacggcccatatttgaaaatccagctttattgggacatagccatgcccattgctttctgtgtcctctgtggctgctttagtgtgccaccagggcagacttgggtgggttgcagcagagatggcatggccctcaaggtccaagatgtttactctcttgccggtcctctgttatctctggtctttgtggttgccacagttttcttggatccaggagttaaaggcagtcctgagggatgatggcctcatctccgcagttgcctggaatgctgaatttcagacgtgctaaaggaggggttgcagacattgtgtggaatgcattcagaccccagatgtgggtgcaggaaggcaggcatggcacagccaggtagagactggtttccaggcccaagcagccttcagcagctgtgcgccttgtttctgatgttgtttgggagtaagaataatgtagacatggggggtcatgaggctcagggtaaaaacttcaaggaaacctccatggcatggttgggcgcagtgactcatgcctgtaaccccagcactgtggaatgccaaggtggaaggatcgcttgaggccaagagttggagaccagcctgggcaacataaggagaccctgtctctaccaaaaaaaaaaaaaaaaaatgaccaggtatggtggcgcacacctgtggtcccagctactcaggaggctgaggcgggagcctgggaggttgaggctgcagtgagctgtgattgcaccatggcactccagcctggaccacagagcaagaccctgtctcaaagaaagaaagagagagatagaaagagagaaagaaacctccatggcagatgcatggaggaatgggttaatatctagaaatacgctgagtggtggagtaaagaaaacccacaatagaatacctgatgaatgtggggaaagcacttctgagctcctctagttttagaagacctaaaaagacgatttaaaaaaacaaacaggagagccctgttattgttgatgtcttccaaaacgaacgtgcatttataagccaggtggcattttaatgtcacgagggggtccattctcccatctgtctcctttgcttttgttagagtcagtagcttctaggtctgcttgacattggagaggatactgaatgcagaaaattttgtttaattataatgatttgattttttccttctgtattcaagtttgcctgcttctaatgaattggcagaaatgaagagcttgctcagattttgccaggaccatttaaaagcaattaaaatcaatttagttattaaatttgaaattattgtctggctaaatgatagtttaaaattcaatttatactggcacttactttttaatgaacagaccacatcacacatttttatgttctcaaattatctgtggctttaaagctgtaaaaaaaggtgctcttttaaaaaagccctgcatgtttcctttttcctctctacttccgctaaaatatttacatgtttcttttaaaataaggtgagaaaatccccttgacttctcaattttaagaaactatacttatcttttcatcacaaatgttcatttatctgtgttgaagtcaacccaagaaatcttaaaatataacggaaagaaaatgtttctggattttttcccgagaatacatatacttttaaatggcacgttttacccattgactttaattcctccctccctccattacatttttagatgtgttcaatgaaacgtagtcctccccctttaaaaaaatggaccgagcatcacgtgtgaggctgcaaagaggctccctgccaaagcatcttatctgccgctggtaaagccccgcccctccgtcagcagctaacccttgagcgggatgtgtgcttgtgccgggtgcattgcattaagagaatgcaactgaatagagaaggatcaggaccttttgtgcagaggtggggagtgttaaaaagggggaggcctgggtgggagggtggagttagtgggagatgggtatgcttagtgcttaaattccctgcattccctaacacgaatttaagaaactcacacagtaaatgagtcagggagagggagagacagggagagagggaggggagagggagagttcctttcattcatgacaggatgaactttgcatgcttcagaacaatttacatttttccttatttctaggtacttttttgaactaagaacctggagggtgtgtgtgtgtgtgtgtgtgtgtgtgtgtgtgtgtgtgtgtgtgtgttggtgtgtgttggtggtggggtttttttgccttatatttcataaatatttcttggttgattaaatgtcaataatcgctcatttctggtttgtaaagctgttacctgatccttgaataccacgaatattttgtacattctaaataattgagagaaaataacaacgacaacaaaaagacacaaataaaaagcatctccgcttatttaagaagagtagatctgtgcggggcgctgtggctcatgtctgtaataccagcactttgggaggccgaggcgggaggatcccttgagtccaggagttcgagaccagcctgggcaacataatgagaggctcttttttttttctttttgagacacggtctcattctgtcgcccagactggagtacagtggcactatctcagctcaccgcaacctccacctcctgggttcaagtgattctcctgcctcagtccccctagtagctgggattatgggcgcgcaccactaccacccggctaatttttgtatttttagtagaggtggggtttcgccatgttggccaggctggtctcgaattcctgaccttaaatgatccacaccctccttggcctcccaaagtgctgggattacaggtgtgagccaccacactggggcgcaagagcacgtcttttaaaatcagtgctgtctgtggggtgggaggggaggagaagtagatctggccatgctgaaaggttcgtgcagtggcctcctgagctgcgcacatgcttctggagctttgggtggacatttagtctgcatgtggatctctgtccaagcctgcactgggagcccctgccccaggaagcgaaggctgcatttcttttatgtcaattaacagatttctgccccaccctggacatctgagcgttaactgatttgtaagggaggggtgagggagggtaaaattacaattctatatcttaacattgggggtgaagcatttttaccctagaggaattctatccaaacacattaaacactcttaataagggacaaagggttgggacgtagcggttagggggcaagcccatgagcctcactccttgtgctctctctccaggaattggagagggaatccttttgcttagcattcccacgcctcccacgggcctggcactgggcccgcgggcttgccttagtctcctgggctgccctaacgcagcaccacgtgccgggcggctgtaacagcagcccgtaattctcccacagtcctggaggttctaagtcccagatcgaggggtcagcagggttggttcctccctaggcctctctcctgggcttgtagatactgtcttctccctgggtcctaacaaggtcatccctctgtgtgtgtctgtgtcccctcatctctagtcctgttggattagggcccgtcctaatgacctcattttaccttagttacctcttgaatggccctaactccaaatgaacagtcacattctgaggtcctggggcttaaggcttcagcatatgagttgggagtagggatgtaatatgcctaatgtccagaacaggaaaatccatagaggcagaaagtgggttcctgcttgccagggctggggacgggcagtgtggggtgactgctagccagcacagggtttcttctggaagtgatgaaagtgttctggaattagacagcggttgcaaaattctgaatgtattaaaaaccactgaattgtacattttgaaagagtgaatttcatggtatgtgaattatatctcagtaaagttgttataaacaaaaactgtgagggtaagaggtaaaaggaagggagttgaaagcagcatcaggtgtgaacagcccataattcagcccatagacgagcgcgaactcctagcacagctgtctgttgaagatgtgcgtgaatgcttgctttccgcacccttcggcctgcttttctctactctccaatttcatcatacattctcttccttcctccccctccccactttttcaaaacgtttcttctagtccttacttgtggctacacaaaattccataaacataatgctgcagttcaaagaagtgttctgatggtagggagataacttaggaaaatattttacctttggggaagttttggtttccttctgagtgaaaaccctccatgaaagagaaacttaaatgcagttttcaaatgctcctgagacattcccagccttttctttgtggagaagtgaaggcaggacaatttccaaggcaaagagggacctatcgcagacagcagaccccaagtaaagaaaggcacagtgatggtgggtattcgtgcagtgttttgaaaatgtggaggtcagggatgctagcttaccaggccagcatgatcaagttacgagaaatggagaccaggacactacctctgctgggtgtgctgctccgggctccttcgaaaggggaagcagctggtggacttccttgggctgtggttaaatggggctcccataggtgccatgaaggctctgcagagccagggatgcttgcaccctggagagaccttgctccaggagctcaggagctggtaggggtggtgacagtgaagcaccggcttgccgtgcccagtgcttgggcagtgctgagctccgagggaggaacccagaaccatgcgggagcaagggagggaggcaggcgaggagaagggttgcccaggagcctgcaggtcgggtcggtgttgtatcaaattgtcttttcctgctttgctgtctgatcccactaaagactagccagagagatgtggaggtgaaaaatggtggacagccatttttctccctttcactgtgtctacaatgtctgtttcatatcaacagcaacatctgtgcaggcatcctaatgagtataaataatgtcttcagaaaactgggtttgtgaggctcctgtcatctgaatttctttcatcatttaagtgatgattttttactcattgacatacagttgttatttagtggccacgtattattcgtatagggttctttatgtgctttctgtgtacatttgttttcgtgctcatcgtatttcagtgtggcttatatataataagatgcacctgttcttagctattgtggacttttttttaaaaaaaggtttatagagatatgattcacataccaaacacccatttaagtgcctaattcaacagttcttaataccctaatttaaaaaaaaaatacagtgttgagtattttccttttctcgtttttcactaaagtagactcaggattggggttatctgtcagtcccttggtttgattcttggctgccagtgtttactggggacggatgttggtacctcccttaataggatattgttacagcattttacaaattctggttaaaaaaagtcccacatgagatctcccctcttcccccctctctgagtgtaggcattgtcagctgcagttgtccagcatctccaggactcttttcatttgcgggatggaaacaatgtaccctctgaacaactcctccctgtttctcctccctccagctcctggcaaccactattccactccctgcttctttgaatttcacaacttgaggtagcttgtgtaagtggaattattttaaaagctggttcatgttaaagtgcttagaacagagcttggtgagcatccggtcaacagtaagtacttttattattctttttatattactctttttttttaaagaggccagacacatgggcttctgtcttttcacagcttgggatctgtgcagacccaggcttccagaagccatcccacttgaattcttactcccttttcccctaaaaagaagctctgaaatcctaattgtcaagaaggctttgcctgctgtgcatgcctgagtaatgttatttttgtcattatttgagagacagagaggaagcttccagtcccctgtaaggaaacgaaatcatcgtgcacagatgtggttctgtttatagagggaaggaaatggaggtgaagagtgtgtgtggcttgcagccaggcttgcgagtgtgcagaggaataaacttttttgcctccagagttttaactggaaatgtgtctgaattctacctcctgggcacactggcctgaggtctcccctgcatacctgatcgtgaaagtcttcgggtgtgtttgtaaacacgcagcccccctgatgtgagagtcagcacaaacttctaaagatgcgatgatgaattctatcagagaagtctttctggttttgtgaaaataaccttgcactctttaattatatccaaatgatcaaatctggctctgatgtcttgtcaaaattaatgttaaaggacagtgccctttatattttacttgtctgggtataaacatcctagtctttaaagttgagtctgtaggactacctctctacttgattactctgaaaagagtgtatagagtgagtttttaaaatggaattagtgtgcatacgaggaacagagtgacatttaacaaatccttcaatagatagtgctggtatgaggattggtgaaactagaggtagggaatgagcatttttggttctgtatcatattcccaagacattttcaaatgattcaccctttgccatcagaatggtttgaaatcgatcagcctgaatccactaatgtgggctgcggcacatgaattttaacactagaagcacacggttgtgctgtgtttcaaatgaactctggccatttgaagtgagcaggcataggcagtcttctgtcctgtgataacctcagtacatatcctttctgttttttaaagtaccttacaagctgctgcattacagtcgttattattgggccattacaaaaagctgtccaattttaagtgtcttggataattcttgtttgccccagcatcagaattgagcatttttttttttttttagatggagtcttgctctgtcaccaggctggaatgcagtggcgtgatctcggctcactgcaacctccacctcccgggttcaagcgattcttctgcgtcagcctccggagtagctgggactacaggcatgcaccacgatgcccagctaatttttgtattttttagtagagatgaggtttcaccatgtgggccagcatggtctcgatctcttgaccttgtgatctgcctgccttggcctccgaaagtgctgggattacaggagtgagccattgtgcctggccaaaattgagcacttttatcatgtagtattcatgtcttactggcaatgccctgtaaagttaaataagttacatttgtcttgcacaggtaataattatgaggtaatttccacagaatccaagggcctcattgactttgctataaaatcaaaacagtgaattctgataagactagacgcatgttactcttaaattgggctgtctcctggccactgttgtgcctttaacctcagcagaaggggagctgggctgcagagtgaaattacccggaggtcaaatattgctaatttgacttttatcatagagacattttctcctctcgcaccaaggcagtggctttaatccctctttcagtggtgagacaggtgcaaagcgtttacaaaaggctttctcttgttttgaatgcgccaagaaagatttccaggccgttaagttaccaatccttctttttaagtcttgaagcaattactgtaaggtcaatccactaatttcctttcagagttaccaaagacctctcatgtaatcatttggtacttgttgccatgtagccagtatcactgagtgcttttactgtgagcaaagcacaatgcatcgggcagggagggatccaaagggatcttggtttttacctttgagccatctgtggtcttgagtgatctacgtgcattagcaattaaaaggtcctgatattcttgtttgggcatattgaaaaatgtgctcttacagataggtttcctctctctactgccccccgccccccaattttttttattgtggtaaaatacataaaacagaatttaccatcataaccatttctaagtacactgttcaacagcattaaatattcattacattgtgcaatcctcaccacgatccatctgcagaactttttcatcataccaaacagaaaactgccccattaaacacaaactccctattcttccctccccacagccccagcaaccaacgttctactttctctctctatgattttgacactctagggaccttttatatgtgggatcatatggtatttgtccttttgcgtctggcttagcacaagtttcatccatgtcatagcatgcgtcagaatttccttcctttttaaggctgtataatattccagtgtatggatggactacactctgtttatccactcatctgtcagaggacacatgggtggctttcaccttttggctgttgtggataatgctgctatgagcattggcatatgtttacttctcattgatttaagtttacatagtcatgtgtggctagtggctgctgtattagacaggacaaccctaggcctgatagccctgaggacctagtttgggtgggaagacaggggtgacctgcagcgagttgtcggctgggggccttggtgagagccagatctgggttgtgaggccactcgaggcagggggaatggtgtggcgggaagtgaggcccaaaatgagaatttcagagttgaaagctttggaagtaacatgatgctctatgactgtgaccagactcaactgcaccaatgtgcatctgagatcaggtcattggcgttgaaatcgtgaaatgctcactgcttgggacgtttgcactgtgcttgatgtctggaggttccgttaatgttaaaatagcaattatgggactggagattaggtttaatgtctgggttttttccactgtcttcaaaagcccgggtcttagtagtaaccatgctgctccccattttagtaatttcagcctggtttatgttgctcaatagcagaaaagcggttcagatttcctttggatatcatggaccatatgtttgcccaggtatcctttcttattgggaactatcaaatagttaacacagatttctccaagggcaccgactgggaaattagtttaccaaagataaatttggtaaaaggaaagtttttatgtgcgctatccttaaactaagacacatctgtcgaaatattaggacgtgcccagtctcccatcctctgctgaaactttagactgtacgtccttcagatatcttctctttggtgctttgtttgggaacagattagcctcatacttcctcgcttgtaaaactgctatcccatctcttgctcaatgcttttcttgtaccgaagggtgagggggaggttccagctctgttttctgtatcagtttcctgggtgatgtttgtttgagggtgccttgtgtccagagccccagaaggtgtttccgttctctgatgagcctgaagtctgcatgcttcgcctttggtagggaaaggcagctggggaaaggttgcatggcccagtgccagggtgccagagtgcgtgtgcacctgctggggagaagcccgctggggcccctcctctcagcacaagatgaggcctcagggcagtgcagcagatggagggcttagctgtccttgccagcaaaagctgctgggaacgtggcactcagataacaggacggttgagaagcggtgagttagggttactctgatggggagatactgagaggaggggatgacaatcttgatttctgttccctttgtgaatcttttggtggccaaaatgaggaaaaggatacattgtgtttgaggacaacaaggaacatctaggcacattgcatacttgattaaatgcacaaagagcttcttgtgacctttatcacaagagtgtggttctatgaaggtcgtaggtacaatagaaattgtgttggtctgagagttactcagattagggtgcattgtgtcaccaccattttgcatagctgtggcaccttgtcaagttaaccttttcctgcttgcttttcctaatcagaagaatgaagttgaccgtatgtactctataaggtggttgtgtgaggtcaatgagattacataggcaaaatcttggtgcaggggcacttggtaaaggttagtttctgttataaatttggggtattctgtgatgattcctactcccctcttctcctcatggctaagttctacttattctttgacgtggctccgatatcactttcctcaggaagcccggtttcccacccagatggctttgggctactcatcagtgttctgtaaaatgctgagaatattgtttatagcacttctgggttgttttgtgatagtcttttgagatatctgtctcctcaccaaactgttctttgtgtcatgggcaggcccacgtcatcctcgtctttgtagtcctgcacctggcacagagcctggcacatagctcagtcaaacaggtgaagactgggttattacatcttcccactccacccccttcattatcaagtcgtggtcagggcatgccccaccaaatgcaaaccctactaggcagtacagctgagacttggaactagactaacccagtgactcagaaatgtgccacaggacttatttggctctagatggggtcttaaaagacattcatagttgcaggcagaacagaatatccagaacaggtgcagaataacctgtgtgtacacagtaggtggtagttataatgcaggaagaatttggcacaagaagtgttacagtttaaaatgaagtcatgggccctatccacactggggacagagataatagtaactaatcatcatcactgtcatcactagcccattgtcagaggtagcactgaacacttatgcgttagccaggatttgggttctagagggtttagtgtactagttgggttaccaagacaaagatgcaggcatggggtgcaagttaacaaaggttatacactaggtggcaactgactcacaggagcctggttattgcagcggttgtggccagagccatacaagtgttctgatgcccctcaactgtgttgaaatttgtttgaggccaaccaagtcagctggcgagggggaaggcaagccagagagaaattgtgaaccagaaaggccccacctctggcagtggctcttccattggagatgaagtcttcttgccctgtttttctctttaaaaaagtgagccatttcacaagggaagttaaattaaaaactgtgcttgttagcgcggagctgggacaaccgagggaagtgatgccaaaggcaattgttggtctttccttcaaatatgtgctgacttaggaagagcaaaatgttttatattaacaattaacaaaagactaagtctttcatcacaaacaagtctaaattcagtggttaggtcagtattatattttcctatagttttaaataagatgcttatgtattcactagtgctttggatgttctttggaaaaatctccaatttagtgacaagccccaggaaatattactcttagttggtccagcatcctatattgtttgtgaaatccctcttttattgtcttttaaaggttgtaaaatgctttttctgtcaataatcagagaaggatgccgcattcatattaccccagtttccaactcaacctctcctttccaattgaaaacaaaagtcagaattcactttttgttgtggggcattaagtagtaagcaaagagatttcactcgccagggaaaagaaggagcctgcaaatcagacaatatcaaaacataaccaaaccatataaaaacacaaaaatgttgcttggcagaatttaactataattaattgtactaatttaatattgtagacacaaatgatcataaagccatatggtacaatccttttgttcatgaatttcttattcatcaaatgttaggtacgtgatgtgggaaagccagtatgttgggcttcgtgctaccagggctagagttgaccagttcagctttgtttctccagtgaccaaaaaaaaaaaaaggtatctgccttgcacatgaaaacactggatggttagattggatttagccaacaacaaactgcaaaaatcggttctggctaactgaagctcacagggtttattagagttgttggagcccatgggaactgatggagggcaaggaggcttgtcgtgcaggagcagcaggaaccaaggaagctttgcagagatgagaaacaaaaaacagggaacacagcaacatttgctgtgtcaggaacgactgccactggtggcctggacaccatcacagccgcagaagatacttaagacacatttctgttctagtgttggtagttcaagattcaaagtatgtgtgaaagtgagtgtgtgtgcataggcagagtagctaattggttgagttggggtccatgtgcccacctccaggttggaccaggggacaagccatgcagcgttttggtcacccctcacttggcagtattcccaccaggaatgaccctcgctaggatttgaggggcctggagtcactacttactaattttcttaaagttgacaacgatcacaaacttcatggtctgggaaaatgtgaattaattgcctgatccaccttcatatcttttttcttttcttttttctttttttttttttttaacaaaaatctgtatattcatagattgtctcttcctctgctagtggttttgcagtagcattttcaggtgaggaaacaacaacagagtttagggtccagctctgtcattgccattgttgtagcgatttacaagttgttactgctagtatgaacttttgcctagttaaattttggaaacttgcctgtaattgcatttgatggatgataaaaattgataaatgacttgataagtgataaaaattctacggaagaattttccatggactggcttctggctttgatcctttccaactgtgcttctcctaccctcaggccgcccctatcatgctgtgcttgtctggccccactcaccctgtcctgacactggatgatttatttccaaatgaattgctcctggaagccattccaacaccattacaaccggcggcaacacagctgtcttggatactcctggaccatatagatagatgtaaccacagcattccggtagctcccacttccccagcattttcttttagaatgggggcatcagagttgaaggaggtaactgtgggtagtgtgtcttgtctttggaaattttcatcatgacctgagcttgtgaacactctgccttggccccgcctcgcactttggaagagactggagcaggagcgggcagcgttgccttcgcagcatggtaacttctctcagcgctgtttgtaaagcagaatgggagaggaaactccccagagggaaactgggaccctgttaggtagggctagcaagaggtggttaaaacgtaagcatccgctgcaccagactgtattctccacgactgtatattttttgttgttcataagagccccgaattgcaatgagtacgattttccctggacgctgcagtgtatggagaagctgtcacttgtcacatgacagctcagtcattcgatccctgggtgctgcagagagggaagaattggcctcgcagtggggagtgagtgccagcccgtggcctgtcccctgccacgtgtcaccatactgaacgtttgtgtgtgctctgtgtgttttcaaaacaccttcatgtcacctgccccggactcctccctgtgagcaaggcagggtgggcgttaccatccctctggaccaacaaggacagaacagcttgagacgcacagggtggcttccccatggctgcggaggcatagaaagtgagggcacgggacgtgaatccgtgtgctgggattctggccgcctgtgcctgccgatcaccctcagtgcctccctggatttgattttgtggctcttctgggtgtgcgtgtgagtgtgttgtgggtaagtctgttgtctaggggaaggaacgggaaatcatccggccaggaatctctgtggggtggtcggcttgagttggccatatccaagctctgcgtgtgtctcacttttcagagtagcaggaaggccgggtgactttgaaatcagatgggtattttcctgattcgaagagacttggcttcttcccccgcccctccttctccctcctcccccctcctccctcttgctggctcacaaactcaatggggcatcccagcccacccatgggaggccaggagaaagaggaggcagagctgtcagagtgtggcccttcgtcttgggggtgtgcaagtgaccgctcctgccccttgatggctctcctgtttcgggtataagggatgttgtccaaaccatgtgtgggactctctgttgacagttgtttttaaattgcctgtttaattgagcttctctaaagtcttctttgtgccaagtatcgggacaggtgatagaaatagaaaattcgacacaaatcgaaaattccagtatcaaaaatgacagcgatgtacccttgccccttaacgcagccaagaaacaggggtgaagggctactctccacatatggagcaggccaccacccttgagtgacagtagccgaacacagaacattctctgcagatgtcactgaggcttaaactcattatgttttaaagggataatctgctattcttaagaaaacaaaaaacaatcacaaatctccctgccctccccacccctgcccccacttagatcctggtagggtctggcagggggagttttgcaaggagttggggcaaattactccagcagatacttccaccccgtatcccaagaaatgtgtgtaaatgctgttatgaattaatttaaaggtattccaaactcctactaattattatgtgtttgctcaagtcaagatcaggagaagtacaggcattgctatcccatggggcctgtgaaactctggtgaggtgtcctagtggaagagcttggggccccatggtgtctggaaagcgggctccactggagattctggctgttttcagcttgatgcacacggggtcccctggagaatgccaggcctgcctgagtgtgcagaggtgagggatcctcacactgcccagcatgtacgtggctgggagactccagagagacatgcaaaagtgctgttaactagacggcgtggtacaaatgcaaagtgagtgggtttttttttttccttaaacgacagtgaacattcatttcaatatttattttgcttattttaatattttactcaatgtttatttatttttatgtttttgagacagagtttcactcttgttgcccaggctgaagtgcaatggtgcgatctctgctcactgcaacctacgcctcccgagttcaagcgattctcctgcctctgcctcccgagtagctgggattataggcatgcaccaccacgcccagctaatttttttgtaattttttgtacagacagggtttctccgtgttggtcaggctggtcttgaacccttgacctcaggtgatccacctgccttgacctcccaaagtgctggaattacaggcgtgagccactgcacccagcctcaatatttatttcaatacagaaacggacttaattgggtattttgttgaaggcaaatagtagcaaagtgggactggtgtgaggcagtggaataacttagtgaaatccaaggtttatgtagttattttccccccacttttttttttttttttttttttttgaaatggagtctcactctcttgcccaggctgcaatgcagtggcatgagatcagctcactgcaacctctgcctcctgggttcaagcaattctcctgcctcagcctcctgagtagctgggattacaggtacccgccaccacgcccagctaatttttgtatttttagtagagatggggtttcgccatgctggccaggctggtccccccatttttatggtttgaaaattttcaaaccctggctgggtgtggtggctcatgcctataatcccagcactttgcggggctgaggcagaaggatcatttgaagccaggagttcgagaccagtctggacaaatagcaaaatcccatctctgcaaaaaataaaaaaatgaaaaattagccaggtgtggtggtgcacatctgtagtcctactgcttgagaggctgaggtgggaggattgcttgagcccaggagttcaaggcttgtgagccttgattgcgccactgcactccatcctgggtgacaaagcaaaactccatctcaagaaaaaaaaaaaaattcaaaccctcagaaaagcttaaagaatagattcatggatcgttaaacatttttaccaaatgtatgttttctctcattactctaaggttgctccctttcccccctcactctcctcttctccttcccttcactccatggatgtgtaggacattctcctacaaaaccatagtacttacattcttgaggttgtcacacctcataattaaacatatgatggttttattaagtatgctgtcacatgtaaatttctccagttgtttgatccaagttgtactcatggatagtgtattgtattttacgtctctttagtcttctgtattgtagaggagtcccccaaccttcttctatgacataggagtttggggatttgtctgtttcccgatgtgattagagtgatgttgaacagttttggcaggaacgctgcacagctgatgattatatttcccattgcatcccctcaggaactcagaatctccttctccatccttggtgaaggtgtattcaccagatggctccctgttgaagctcccttctctctgttaccaatgagtaatctgtgctatgatacagtgagatggtgtgattattctgttcctcacagtggttttcctttggtggttttagcatccactgattaccataaattaattagtccagctttggcaaactatggcttgccgtggtgactcacgcctgtaataccaacactttgggaggccgaggcgggcggatcacaaggtcaggagatcgagacccatcctggctaacacagtgaaaccccatttctactaaaagtacaaaaaattagctgggcgtggtggcgggcgcctgtagtcccagctactggggaggctaaggcaggacagtagcctgaacccgggaggcggagcttgcagggagtcgagattgcaccactgcactccagcctgggtgacagagcaagactccgtctcagaaaaaacaaacaaacaaaaaaacccccaaaaaactccaccaagtctgtttacttatgtgttgtctgttaacagttgcttttgcactacaacagcagaattgagttgggacagagaccagatagccaaaaatattttctatttagctgaatcttgatctagtacatttttggtcaaaaaatgatgcatttctaattcttctattcatttttcatttagtagttggcattcttaaagaagagctttctgttttgacctttaaaaatcactatggattcatttattcttaatttttttttttttttttttttttttttttttttgagacggagtctcgctctgtcgcccaggctggagtgcagtggcgcgatctcggctcactgcaagctccgcctcctgggttcacaccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgggccaccgcgcccggccttattcttaatttttaaaagtgtgttatacgttgttgtcattacattattcttttagatacacaatgttgccctaaatttgcccagtgggaacccctccaggctgggcactgtgttcttctgtcacgcccccttcaggatggggcctgggttcttttgttatgctcctctaaggccctttaatctatgtcgtttcatttttttgttgttgtttttattttgagacagggtctcactctatcacctaggctggagtgcaatggcgcgatctcgactcactgcaacctccacctcctgggttcaagccattctcctgcctcagcctcccaagtagctgggactacagatgtgtgctaccacgcccagctaatttttgtatttttggtagagacagggtttcaccatgttggccaggctggtctcaaactcttgacctcaagttctccacccgccttggcctcccaaagtgctgggattactagcatgaaccactgcgcctagcctcgtatctgtgtcctttctttctgggaccggaagaggtttcaggttcccagtggaaattccctgcccctcaccttgaatcagcctttggccaaagagccttggagaatgatatttaatatttaaaaaccaggaactgagaactgagtgtgctcattgctatggggatatcattgctcctgggctccttgggtgcagagacccagggaaatagatgtttctgtgtatgctttcacactgtccctccctctcaagcccaactccacaggatgcttcctcaccttcctcttgccatctagtatcacgcttctgtagtgagaatctgctgcctacagcaacaacatattgacacatccattctcttctataggacacaaaaaaaggtttcagaaatttttacgttggtgctgccaccaccaccgctaccaaagcaatgaaataaagttcaagattccttgagattctcttgtcgttaggatgtatctcactgtgggtgtacagacaatatacaaaagttacttaatttttctccgatgtttatagtaccaatttgataatgtaagttaaattattcatctttattgaattttaagatatgcatattttatcctctttgagttaagtatttttcaaatatagaaaacgtttacgtggtccaaagtcaaaactctgttaataggtttgctcagagttctcagctcccatccttatcccaccaccccatttttactcacctcttcagttcattgccattactttttgccttatcttttttgtgtgtttctttttgcatctacttagtgcttttaagccccccatttaaaggcctaatgctaagtcttacatgtaaaccagcaaaaatgtcacctttttaagtagacttttgtgaccaaaaccttattatcaaagcgtgaaagttgagaccgtctagggagttttcatcatggtggttagacagtgtgtggaattgaaatgtacagcgtttgtacatgcaggtccgttattgagagaactgatccaaaaccgtgacgactgccaataaaatgtactttaccaaatatctgctcaaaatgcccatgtctccttaatgtcaatacccaacacatgggtacatccagttttagtctcaaatgttttaagatttattaagcttggtttgcaggagtttagtgttcttggaattagaaggatttctctagtgatgtggtgagaagagataaacctgggaccttttgtgttttcttgatacgcacatttatgttgtgtgcaacacaggaattgtcaggaacctgcaatgcaatctttcttgatttataatcttgcaaaatgtggaataaaaagtaaagtgcaaagtttaagtggtaagtgttacaattcatgtgaacaatatgatgctttttctcatgcttacttgaagacagcagctggcccttgagttcagtctcagtgcaaacagcctccaaagaaagtgcattgcactaaggaagcccttttcatctcacaaagggcaaagtctggattgcccccctttctctgttgtctttgcctgttgctccctggaccccagccagtctccccaggcctggagctgggtcagctaggtctgtggccaggaggtgggggtccacgtccactgtgctcctcagcggcaggttctgcaaactgcagcccgtggggcagactccacctccagcctgagtgaggccatccagctaagaatggctttgacatttttaaatggccagggtgaaaaaactaaaagaggattttgtcatgacacatgaaaatgatataaaatgaaagtgtcaactgtcatacattttgatttttgtcagtttcagagaaatttattttctctttttattaaatgtcactacataatatacttgattttgcctttctgctcactgaagctaaaatatttactctctggccctttccggaaagagtccgccgaccccctctctgtggaatgagagcttccaaaaagatgcagaagaccgtgcatcccaagcggttgtaaaagccacttactttcgtaggtttaatgactcaaaagaaagggcgcttgttccctcccttccttcctgggcaggcccctttttggaatggagtttcgttatacagaaagttgttctcgctgtacagaattctgcgatgccttcacttgatggctgtttcttcggggataggagggctgggggtcaggatctgatctcacacgaatggttcagagtctggacttagtagctcagagcagttcactgatttgggatctctggaagaaaagggtactgagtcactggcaccttctgctcagctcctgacagcagtgtaaaggatgctttcgtgacacccagccttcagcccaggaggatggtggcagatcagacagctctggaaatgcagggcacaatgcgcagagggttgcaccacaacagcagtcactcggtgcccgcctggagcactgctctcatttccagagtccctgtatttctgatcttggctgctttaaaaaggaggtgtgggcctgggatcccagaagtattcctctgtgattctgtaccacagctttaccttaattgggggtgtagggggtggggagaaagaggaagacagatgaaagcagggaaatccttcttggagtcatagttaaaaggataaaataagagctttagtgtagcctccgtttccagcaatccattttattctttgtccacaaactgaatgaaaataagcagtcattcaaaaatgatatttacgtaacctacaaaaatctcaatcaaccaaggaaaaggtggaatggggcttaatacaatacagggctgtctccggagttccctcccttgatttcaggcttttggtgtaaagctcccgaaagaaagcaactttgatttttattagactcttcaaaatcatctcggtagaatattgaccttttttgtgtgtggaaaaatgacttctacgaattctcttgtaggagtgtacattttggtcattttttggaatgtaggaaaaaaaatgtggggtaccctttattgcattttcaagaccttccaaagaagataattctgattgtaactcattataatctgggaaagtagattgttctggtttcaaggactgcgtgtgctttaaataatcacaggctgctctcagacttgggaacttttggtagaatacagcagtgattctcaaccagggcagttgtgttccttgggggacatttggcagcgtctggagacatttttggttgtcacgttttggggaaatgggtggtgctcctggcatctaatgggtagaggcccaggatgctgccaaacatcctacagtgtgcaggacagcccccccccaaccaagaatgatttagccccagatgttcatagcgccagaggtggaggaactgcctcgggggatgtgtaggagctttactttatgggttttttaatggaaaatatatgtatagacacgtacatatatatacgtgtacatacacatgtagatgactctgctcagcgcacccatgaagtatgcagtgcacctgtcccctgggatctggttatacgatgggtgtccagcctgtgcccaggggatcagtttcctttgtgctgctgcagtaccttgtcagcatggagagggggaggtcagttatgaggaggcccttttggggtagagtggaggaatggtgccgcctggtcaaggcctcgcatggggtagtgttctttgtacagttctaggtgaggcggcgaacacgttctcatgcattcttcatggtggtggtgatgctgatgttaagaccaacgggcctctgttgttctgctcaaggttccaagtagagtaggttttctattttcaaaatgtagttcacggtgtcccaatttttagtgcagcgtatttcaacaaaatgtccttttacacatataaatggcttatgttgcaaggtccccctcagcttcctggtgtggaatcagtgatggataaaggcagagaggctctcaggctgacatatactccctatgaagaggggggaagaactgtgttggcccatgggtgtttggggaaacacttgtattccaaggtatttgtggagaagatatgggatgtttttccatgttgggcttcggatatgaagtttaaggaaggagaatggagtcctggtgcacacctctcataagcacacgcacgctggccactctgctggctccagagtcatccagagcatcgagcatagtttctcccccggagaccctccaatctgatcagatagggaggctgtgagtctggtgacccccactgcagggggcagagctagtgcaggtggtgctgagctgactgggagaagaagggcctgcaggaccggctgcaaagcccttaggggagggaggaagtgaggaatttggtttcctaaacgggtggtccaagagaggccgggttcatcgctgtgcagtgaggtggcactggaaggagggagtcctcagatgggccaccctttggggctataagtctcgtggtttgtttctcttggcttcaagataacatatctagtttgggtgttttgggatgatgaggttggggtgtttgggaattgaggtggccgcgtaggcattgaggaagatactggtgttttgtgcggtcaaagggcaatggtgtggaactcagatcccagctctgaccctgtgtggtcttgggggatcatccaccatcagtctatttctctgtgacttggggataacagtacatgtgagcgtgaaataagagtataaattgcatcaatgtctgtgtgtcaaggttgcctgaggaggagttggctgggcttgcactgacgcttgattctttgtatcactccgacttaaaccacgacacttccaaggcagagtctaaagcctgtcctctcacaatcttctacaggtgagtaggaggccatagaccttgtgagtacagagtcctaaaagaaggcagaaatgtgtgaatctgccaaaagtaaagaaagggtgttactactggtcaaagtcgttgcaagaatgctggcttttacaactcctgtttctgctgctatcacctgctgcctgtgtcttgtttcctgggctccagatcattttcacatttctcaaaatggtccttggtagctgtggtagatggaataatggccctcaaggtgtatctccatcctaatcctggaacctgtgaataggtcattctacatagcaaagtggactttgtggacgtggtttaaggatctcaaggcctggtgccaggggctcatgcctgtaatcccagcacttgaggaggctgaggtggaagggttatttgagcccaggagttcaaggccagcctgggcaacagagagagaccctgtctctagaaaaaaactaaaaattagctgggcatggtggcacgtgcctgtagtcccagctactcaggatgctgaggtgggaggattactgaagtccaggaggtttaggctgtagtgagccatgttggcgccactgcactccagcctgggcaacagagcaagacactgtcccagaaaaaaaaacaaaaacaaaaggatatcgagatgaggttggggaggttgtctgggtgggcccagagcaatcacagaggtgcttctgagtggaatagggaagctgggggaacagaatcccagaggagataggaggatgggcgcagaggccccagtgatgtgggcccatgagccaagggatgctggcggcctctagaagctggacaaggcaaggaatcgaattctcccctgaagcctttaaaaaaggacacagccctgtgacccattttagacattgcacatcgagaacctaagagagtgtgtctgtgttgcttatggtagccgagctggagattctttgtgacagcagcaacaggaaacgcagacagtgggtgagcaccagatggtagagtcaagtttaatatgctggagcaaggagggtcagctaatcactggcaaaagatcagggcctgggacttttgctaactgtttctatggattcctccttcctcttgcaatgagaagcgacagcctcgtggtgaaatttgttagctgtttattattttcattgatctgattctactagtgtgatttatgctaagcataaatgaccaaagttgactgtggttttttgaagaacattggaaaataaacgtacaaaattatgtttttataataatggttcagtccaaaataaaggaatatattcatagaaattagctaaaattatagagggtaagttacatacatcttcttcttaaagatgctggtaccaacactggaagaagctgtacaagtgggcaggttgttttttgtttttgagactaggtgtcactgtcacctcaacctccccaagctcaggcgatcctcccacctcagcctcctgagtagccgtgactacaggtgtgcacctccacatctggctaatttttgtattttttgtagagatggactttcaccatgttgtccagactggtcttaaattcctgggttcaagtgatccagatgccttggcctcccaaagtgctgggattaggggcatgagctacggtgcccagtctcaatttttaaaaatatattttaccatcactttccaagctttttgtcctatgtgacaacagaaaattgaatttcttaatccacttacattgaatttaaaatccacttaggaaagtgagcttcaggtattagaattattaactccgaataagcagatactctagcatattttatcttccagattgtgttgtgattgtaacaagacacattttatgcattttagttttcatcacaaactggctgaaaatcatgttatgtacaaatatgacttgattcaatacaatttattgtttgggtataatttgaattagaaagccatttgtataccttttgctcacttacattatgctattatgcttttgacatcagaggaaatacacttacttaaaatcctcgcagatcccagagcaaatgaagagtttttgttcttttaaaaattggaagtagtctagttttctggttgtacagtaacaatgtgatatatattgtctttatcatatatacacacatacataaatcatctttccttcaaagatctcagatcacttttttaaaaaacagctttactgagatataatttacataccataaaattcccctattgtaaatgtacaggttcagtgaattttagtaaatttacagagttgtacagacatcgagacagcacaattttagaacattgtcatcactccaggaagcgtccctgtaaccattagcagtcacgtcctccccagcccctggcggccactgatctattttatgtctctggatttgcatattctggacattagatataaatccaatcatataacctgtggtcttttatgtctggcctcgttcatttagttttcaaggttcatccatgtcatagcatggattgatccttcactttttattttattttgtgttttttagaaacagggtcttgctctgttgcccgggctggaatgtagtggtaggatcatagctcggtgcagcctcaaacgtctgggctcaatcagtcctcccacctcagcctcccaaatagctgggactacaggcagacaacaccacgcctggctaatttgtttttagttttgtagagagagtgtcttgttatgttgcctaggctggtcttttgaattcctgggctcaagcgatcctcctgtttcagcctcccaaagccttgggattacaagtttaaaccaccacacctggcctgttttttattgttagataatattccattgttataaatatcccacatttttagattgattcatcagtttatggacatttggttgctcccatgttttttgctgttataaataaagctgctgtgagccctcgtgtacaggtgtttacatgcacatatgcttttattcctctggggtagatttctaggagtggagttgctgagtcatatggcaatgctatgtttaactttttgaggaactgccaagctgctttctatagtggctgcagcatttcacattcccacccaaatgtatgagggttccagtttctctatatcctcgccaacacttgttattctctctcagagaactttctgaatctctcttataatgcctagggggttccttgttgaagatgaaattagggactaccatgaactgctttaggaaacctgggagaaaggagtcaggcccctttttcatatctatgcagtgtaaccggcctctcagaaagattggttggagtggatgggagaataaagaaatgaatgggttgggtgcagtagcttacacttggaatcccagcactttgggaggctgaggtgggaggatcacttgatcccaggagtttgagatcagcctgggcaacatggcaaaacctcatctccacaaaaaaatacaaaaattagctgggcatggtggcacacacctgtggtcccagctacttgggaggctgaggtgggaggattatttgagcccaggagttagaggctgcagtgagctatgattgtgccactgtattccagcctaggtgccagtgagactgtgtctaaacaaaaaaaaaacaaaacaaaacaaaaaaaacagtacaaagtgttcagtgccgtcagatgttctgaatatagtatgatgagaatgcagtggtgggggagaaggtggattagtttctgtggctgctgtaacaaactaccacaaacctagatgcttaaaactacacacatttactatcttaacagttctgggctgggtatggtagctcatgcctgtcatctgaacactttgggaggctgaggtgcaagaattgcttcagctcaggagttcgagaccagcctgggcaacatggcaagaccctgtctctctctaaaaaaaaaaaagccaggcatggtggtccacacctgtagtcccagctacttggaggctgaggtgggaggatcacttgagtccaggaggtcaagactgcagtgagccatgcgagtgctccagcctggatgacagaacaaaatcttgtctctataaaaagaaactggaaaaaaaaaaaagtagttctagaggtcataagttccaaatgggtcttattctgctaaaatcgaggcatctacagggtggtggtatttgctgaaggctcgagggttaagtttctggttttttgttttgttttgtgttttttgtttttgtttttgttttttttttgctttctcagtttctagaggctgcccatattccttagctcatggccccttcctccatctttaaagccagcactgcttgttcgagtctttttcacattgcatttcccctttcacattgaaagcactcttctgatgaaccacttctgttaaaaccactcttatgatccaagataatttacttttttaaaagatgaactgattagcagcctgaattccacctgtagccttcattcctccctgccatgcaacttaagttgttcatggtttctgggaatcaggatgtggacaccttgggtggggatggaccttaactctggctgccaccaatggcgcctggtcaaagtatcctgtaggatttattcttggaaacggcgttaaccccaacgccctactttgctggctgtgtaagaaacacgaggtcagtcaggcagtaagaggagcatggacttgttttctgaaacagcgacacaatccattacatattttcgaatgacgagatgagatcagacttctgctttaggaagagtcacagggttttgtggatttgcaggggaaacaggcggtcagagggagttctgtgtcaccgtccagaggctggggtgccaaggagggcagtggcagtgggcttgaagagatgcaatggggctgctttggggctgaggcgactggactggcgtctgattgatggaataccaggagagggatgggagagggaaagagatgagtccaggatgacagttggaaagtcctggacttcggagtaaagggtagcgattgaggagttaaagggtagaatcaggctggggagagcaaatttacttttgaaatagtgacctttggatgctggacagggagatatgaagcaggcagaggaaatatgggcatgaaatagagcttcagcattttctacaaagaagccaccacattcggtgacatgacaagggagtgatgccagagggaagagaggtacaagggcagaatgctggggaaatgcctgtgtttaatgggcgtggagaacccgcttaataaataatgagaatatattgctggactgaaacaaaagtcctcattagctcattaaatgtttcctggaattcccagtcaaatctgtgaaacaattttaatgctagatgttttgtaagtatttctccggaaatctggaaatttgtccacagacccccagacattgtttataaactgaagtcagttgactcaagtattttgcaaatgtctatggaccctagtgtgattaatagaaacacaaattattttaaaggtgtcactcaatttacagtcattctgtatttttgccatttggtattttttcctgaaacattacataataagaatgcagcatgctttctttatgtaggtgatctgtgaaactttttgacaattaaaaattggtttttggccaggcacagtggctcacacctgtaatcccagcacttcgggaggccgaggagggcagatcacccaaggtcaggagttagagactagcctggccaacatggcgaaaccctgcctctactaaaaatacaaaattagccgggcgtagtggtgcacacctgtaatcccagctacttgggaaggtgaggcaggagaattgcttgaacctgggaggtgcaggctgcagtgagccgagatcttgccgttgcactccagcctgggcaacaagagcgaaactccatctcaaaaaaaaaaggaaggaaaaaaaaatatatatatatatgtatataaaaattggtttttgctgtttgttgcggcatcacttgcagttacaaagaagtgaacatagtggttacagattgggttgtaaggctggacctggccgtatgatgggttactaggcacctgttaaaaatagtactgtggaagtggtatatttattggcatgtccatgtgtttacaatatattacaatggtgttactgtaatccccaggagaccagcagcccagctgggactctgagagctctaagatacgtccttggagtaaaccaagctgcaaggaggtctgttcacttctgtattgtttatccactcataaatttgatttacatagctggactttggtgttgtacagttatctcataatgagggttattttaagaagtgtctcaaggaaatgtgtcgtgtgtttactgaggatagcgttgtatgtagtccacaatttcctctttctgggagaaattttgcacatgtatcagaagtctaggagctgtgtttctgatatttgcatcttctttattgtttagatactgtgaatccagcatctaactatagttccttctttgaggtctaggaaacttggaattggattgacaattcccttccaagtgatttcaggttgtatccgactgcgaactttggataccgccttcctgtctcagcttcgtctcctttgtcctaccatgatcttctcttggccccagtttacccagtgaattactttatttttgctattttgtatgtgtttttggaagccacccccagttttttctcttcttttcctgggtggggagttagaagtgttgcagtggatgatggtgctgtggctttttggaggttggtttgcagtagcttttgagttctggtgtgttagtgtcatcttattctaatctagctgcttcctgttgaagtacatcaagacgaagtatatttctaaatttattacgatgaatactctatcaaaagcagctggtgcttaggccctaggtagagctttaagataaagttctttaatatcaatttagaaaaagaaagattcataatgattaatggagctcctgcatcactgaattttactggaataaaaaaaattagtgggcttaaagttacattgaatgtagtggaaattctttttcttatctccattactgttggggaacaatttcatctaaaccccattgaaaactgggccttatagccttcagtatacttcataacatttgttggaaagcaggaaatgaaaacgaagtatttgaagtaaaagttcttaaatgtgtcccaagaaatgaggattactgcagaaagaatggatcagttatttctcgaattataagaaggaaatatctgcagccttttttgtcatcagtgcagcagccccggtttttctgttaatcatagctggtaataatgccctccggtttatagttttgatgagccgggagctaggctgcgtgttttacatataatatctctgttccatcagctgcataacctagatatccttcaccccatttttatgagactcatgggttcttgtctgggaccatgcacctagtaactgacaagattgcaaactagttatgtcacctgtggagttccacgacaaaggcaattctaggcgatgtttatgtagtgttccttgcatgccagggggattctgtgctctttccatgtgtgaatgatagcatccacctgctaactttgttgggagggttcagttatcctctctgtacaggtgagaacaggaggtactgaggacatctggcccaaggatactaccgctggcacggggtggatggtgattcgccctcagtccctctggcgcagcatctgtgctgtttgctgccaggccagctgcatcccagatagagtgacaggatctgttcgcgtcacatccagaaaaggctctgaggccaagctccctgcgttgcttctcactttcactctggaatcagaggtgcgtgcctggaggacttagctctgcatggacagctggtaaggtgtcacagagggtgaggtgggccattgtagcagagagttgttaagagttggttacgtgggttttctcacagggtacaaggctgaggaatgggaaaccagttaggagaccttgctaatagcgtggaccaaagatggggagtaggtccagacagattccgcagtgttcatgcagtgttcatgaagcaggtgtagacagattgcggggccattcatgaaggtgatttgccggggctttttacggatggaaaaccccttttctgtgttcatcccacctcctgttgtcgacagatgacacctgcacaatcaggtcctcccaactccttccaccacccaaagtgaaatacgcaagtcccagagaactgtgtcattcttaccgaagtggctgatgtaggatgttagaaacatctcccaccccaagttgtgacaacctgaaacatccccagacattgctaactgcctcttggagggggcacagtcacccgctgttgggaacacaggcctaaaagcttggagccagggctgactgtctgtgtaggctagaacagaattcccaatgacccatcaccatgacatctgacactcaaaccgcaccccaccccgaccccccacaaccaccaccttttaaaaatttccatttttggaaaaggctggggcttagaagtcattatgaaggcacccatttccagaagggtaagaatcagaaagttggctaattcgggtctctgctttacaggagttccgcagcgtctttcagtagagtgaagctccagtatttgtatgagtgttggggttgtttggtggtgtggggtaatgcaggaggagagaattggggaactgttaaccaccacccaaacaggctatagagaagaatgccaggggactttactgtgatggagacaggagcgttgaagtctgaagagtgacatctgggttctctgtacgttctgatttcttctgctaggatgagtatagaaacatgttctctggggtgaaagtgaagccttgtgaaattcatacaggtgaagctgctgatagcagctcttcccgatggcatgaatatggaggtggcggttgaagcaagtttggtttgtgaatagaaatatacgtgttcatatgtatgtgtgcacgtatgtgtttgtgcatgtgtatgctttaggacccagttcttggattagctgattatttttttccctctctatagacattggtgacctaggttttcagatacttatgtaagtgaatagttgaatttgtttgagcatatttaattgctttcctgaagggatttgctggctgttttgttaaatgaaattgaagacagtactgttgacctttccaggtgaggagggagtcagaagtgttttgcaaatgatggaaactgaaacgtgagtaccaggaccatatgatgttcagaaacttttatcataactacagtgaataaataaagtgcttgacaattagatttaaaattaagcttcatcctcattgcaaaatgtggagacagtgctttgggacatgaggaagagattaattaggattcttttctacctcaagatgcgctatgtcatctctgaacaaaaaactgattggtattacgtgaggattatcttcataaagttcagagttgtatctacggggacagatttgaattgctgttaattgacaatttgctgaattggaaagatcatattaccttaatactttaatgtatcatctttaaatgtgattctttttctttctctcactaaagattagtttcatgccactaaataaaatttaatcttttgctgtaatttaaataataataagtgcttacaaacatattatgcagctgatagcttgttaaaatttcctgtgggcttgttttttgtttagaagtactgattttgccagttgtacaagcatgaaatattgtttatcaagcctcataagacattaaagaggaaatcaagtttgtgtgactttaatgtctctttttctccttatttcagtggctcatacttttaccctgaacttgtaaaatctacaagcttaataagattccatattttataggaactaatggatattcaatgacttgcctgaagagtagactaagaaaatgtatttctccatgaatctttacatagaaaaatgaaagatttttcctgaatatttatttctcaatatatacagcattaatatgtctgtttttcttcaaagcagaaaaaaaaaaaatcagtgattgcctttgggttttgatcttgctctgtatttgttttaagtacacacctattacatgcccactgtattctaggcactaagctctaatgaaaagtggtttccagtcattcgaatggaacaggaggctcatgtactttgaagtgggtatacagaacttttgcactttggttttattctactttctgtctatgtccttggcactagaatgcttggacgacagtttgctatatctgtggtatttatggaatgagtgaaacatgcaaggagaatgccctggctgccgttctggcttctgccctacccagagcatccagtatacagaagcagcgtttcttaccacagcttgcggaaagacacggggagtagtcggcttgccatataaggaagttgccttcagtggccttgttcattttaggtgttttttaatacttgcttctcttataatacatgttactgttccgtgaggaacctcagcagctcccctaaggggaaaaaaggaggagtacttgaaggagtactgtttatacttcaggggcaataaaatccatgtttatgcacaaagggacctttccacttgtgtgataaccattctacaaggcccttgagttcctgtgaggaaggaaggacgccataaggaatgaaatcacagaaccttattatgaaaatagtaatggtgggatttggaaattatactcaattttttcttctgaaaacaaattgaataccacctgagagttggtgctaaaggccctgattttcgtattttaaaaaatttttggcatagtctttggatttgtgctgtcctaatatggtagccaccagctgtacatgagtatttaagcttaactaagattaagtaaaatgtaaaattcagtttgtctcacactagccacattttgagtgctcagtagccacatgtggccagtggataccttattagacaaggaagatgtagtgcagaaagttttattggacagaagaacaatggttattcagatatttccctattgggaattccagggaagaaagggaaaacttaaatctgaagaagaaaaattttataccaagggactagggggcaatgcagaaaaattaaccacatcaaaacaatttactacatcaaagttcattgtcatgacatattagaacattagcataaaggaagtatctatgcacttcccggatttaaaaaagagtcacacgaaggatcttggaatcagaatgacattgtatttcttaacagcaacacgtgaagttagaaaacagactgaacatagacttctttgaaaataattttccctcagaattttgaaggtgttcctccactaattattaattaaggatagaataaagatgtttgggccgggcgtggtggctcatgcctgtaatcccagcactttgggagtctaaggcaggtggatcacttgaggtcaggagttcaagaccagcctggccaacacggtgaaacctcgtctctactgaaaatactttcacatgtcacttctaggaaacttatggagaatatgtcccaccaaagtgagggagtaaaccaagaaagggggaggtttgggatcttggaaacagaaagaggcagaaggaattctcaaacaaaggtgttttcagggcagtggctcttgtagtacagactagagcaggagacaaattttaggaggaggccaggcgagatggctcactcctgtaatcccagcactttgggggggcccaggtggacagatcacaaggtcaagagattgagaccatcctggccaacatggtgaaacctcgtctctactaaaaatacaaaaattagctgggcgtggtggcgcgtgcctgttgtcccagctacttgggaggctgaggcaggagaatcgcttgaacccaggaggtggagcttgccgtgagccaagatcgcgccactgcactccagcctggtgacagagcaagactctgtctcaaaaaaaaaaaaagaaattttaggagaaagtttggtgttagtgtattggtcgaaggtgggagggatgtgggtgggtgttgcgggaggaagggcatggaactgacaaattatccaagagttttgatcatgtaaaaaatgtaatagattgttggagagtgtgggaaggattatcaaagagtacaaagaaaactgaaatgaaaacagaggcaaataataattctaggagaacacaaaaagtatactaaaaaaaaatcataggctgggtgcggtggctcacgcctgtaatcccagcactttgggaggccgaggcgggcgggtcacgaggtcaggagatcgagaccatcctggctaacacggtgaaaccccgtctctactaaaaatacaaaaaaaattagccgggcgtggtgttgggcacctgtagtcccagctactcgggaggctgaagcaggagaatggcgtgaacccgggaggtggagcttgcagtgagccaagatggcgccactgcactccagcctgggtggcagagcgagactccgtctcaaaaaaaaaaaaaaaaaaaaaatcataatcatactatattgcccactcagcagtgcccattccattgtcaaagtaatatatgtgaaatattgatttagctgaaaaaaaaagttatatgagctatcgaaaacgtggaagggtcagtgtaagattggtggtgggaatgtaaaaaaccaacaatccttacctatgtgtgtgaaaatcagtaagtgatatctaaacttgatgtattgattagagtatcacaaacagactatttagaaacatggaagtctggccaggcatggtggcttatgcctgtaattacaacacttcgggaggccgaagcgggaacgtcactagagccccggtgtttgagaccagcctgggcagcatagcgtgaccctttctctaccaaaaaatttaaagcattagccaggcatggtggtgtgctcctgtggtcccagccactggagaggctgagacaggaggatcacttgagtcctggaggtcaaggctgcagtgagtcgtgatggtgccactgcactccagcctgggtgacagtgagaccctgtcccaaaaacaaaaaacaaaaacaacaacaaaaaaacaaacttggaagtcactatgcagggaacagcaccaataacagaaacagctccaagaaagtggttgctttgggaagtggaattggtgatagatggtgctaaaaggcatgtaattaataaaaggagccttttgcctcacctgcattttaaaaaaaattttgtacatgtattactttgtaaagactaaaagtggtttggaaagtgaaagtataggatatactatctgtataattacagacattttggcatagttaaaagcagggtttcacaaccttggcattgattgacgtttgtgtcaaataattctctttgttaagaggacctgtcctgtgtgttgtgggatgttccgcagcatctctggcctccacccactggatgccagtggcattcctccgccagtcctgacaaataacagtatctctagacattgcccaatgtttcctgggggtcaaaattacctgtaagaaccacttgttttgaaggatttttaaatatgtcattgaataaacctcaatatataaccctgctgtttgatattggtaatacaggaaacaccagcttccttacacagaccttgaaccctggagcaaatgaagcggtttggaatcctctggcactggaacacccgcaatgctcatgctggtgcatgtattagtcagcgtctggctcttggcccggttaattcagagctcactaaaaacagaaaagggatcaggaggaaactgcagcttctctgtcatgcttagtggcttctgaaaacatattttagatttttcatgttgctttcatgatggtacaacttgaatttctctggagttgaaatgttaatcattatggcaaaaatattgcaccctttggatgcattccagtgctcaggtggctgcggacagatcctctctgtctctctgcttccctccacaattcttttgcaagttcttagttaagttattgtcaagtgtttttccctagaattgacacaggaagtcaacaggaaaatggtatctcagattttttgatgtggatgaaacctcataaatagtttaaaaccctcatttcacagctgaggaaactctggtgcagagagggttttttacaattaattgggagcacaatggggcctggaactctgttcttctgttttactctttccttttaaaatacaacatgtgtgcccagtaatgctggaggaggatgatagaacgggctggggaagggctagggcatctggcgggtcatgggagtttgtcaggattttcgcactgttagaagttctcagcatcctctgccaggggcgtgtacccttagtaagcttagagaaaatggcacagagaggcaggaagtgtagtttccatgatctttccaggaggtgctcctgtacctcagttcctgatggcccagaactgggtggagagtgtaggctggtgcattggcgtgtctgacagggaagaccctggcctccttatcttgcagctcttgctaccagggcactcatggagccagcgtgcaccgccactgcagctgttcttgaagaagtggccagaagagtgaaattggcccgttgaggaagggtgtggagctgcttctctgtgggtccctgcatgacttccctgttccttcccctgggatcaaccttcctcaccccacatggttcagcagatgagggttaagtctgccccagcttgggggacgctggtgtcccactcaaaccggttgtccagtattttggtgctgcaccaggagagtgccatctgcagtctgcagggctgtcttgcccaggtggccccttcttccctcggatggatggggcatactgttctgaccaccatgtctccttccaggccacatcctctttcgtgagcactgtgagggcatcaccccacatttttagaaacctcagcgccccatcttgcccccatcccttgcctttggcaccacttaaactacagcctcattctcttcctcctcgcctgagttctccagccaactcaagtgccacctcctccatgaagcccctgtaggtttcctccactgggacaaggacgcgcagagatgaaaggcagagaagtccagccctgggacttccaggccgtcagttcaatcctttgagcctctgtctcctcctctgtgcagtggggcagttcagtgctcccccttagtgctgtggcacgctgcgttgattggcctgggtgctgttgcggatgcccagcgagttctctgtctccctcctggttcttgtcccactccctgctccctgttacagcctggaagtggttggacggtttcccctgggagtcttgagaacccccaaagacgccatgcatcttcttgtcctcttttcgtggcatgttctgtgttgtgtgtgtgtgtctgtgcaacgtgctgtggcattatgtgtgtctgtgtttgtggcgtgttgtgttgcatgtgtctgtctgtactgtgtgtgttgtgtgtgttgtgtgtctctggcgggctgtgtatgttgtgtgtgtctgtgcacgtgctgtgcggcatgctgtgtatgttgtatatgtctctggtgggctgtgtatgttgtgtgtggctgtgtattttgtgtgtctgtgtggctatatgcggcgtgctgtgcatgtcgtgtctatctgcaccgtggtttgtgtgttgtgtctatctgcgtggtgtactgtgtgtgttgtgtctatctgtgcagtgtgtctgtgtggtgtgctctgtgtatgttgtgtctatctgtgcagtgtgctgtgtgtgtgtgtgtgtggtgtgctgtatgtctgtctgtgcaaggtgctatgtgtatgtcgtgtctgtgcagtgtgctgtgtgtgtgtctgatgtgctgtgtgtgttgtgtctatctgcagtgtgctgtgtgtgtgtctgtgttgtgtgctgtttgtgttgtctctatctgtgcagtgtgctgtgtgtatgtctgtctggtgtgctctctgtatgttgtgtctatctgtgcagtgtgctgtgcgtggctgtgtggtgtgctatgtgtgttgtgtccgtctgtgcaccttgctgtgcatgttgtctatctgtgcaccttgctgtttgtgttgtgtctctctgcacggtgcactgtgtgtgttgtgtctatctgtgcagtgtgctctgtgcggtgtgctgtgtgtgtgtctgtgcagtgtgctctttgtgtgtgtgtggtgtgctgtatgtgtgtgtctatctgtgctgtgtgtgtctggtgtgctgtgtgtgtgtctctgcagtgtactgtgtgtgtgtggagtgctgtgtgcgttgtgtctatctgcagtgtgctgtgtgtgtggtatgctatgtgtgttgtgtctatctgtgcagtgtactgtgtgtgtgtgatgtgctgtctttgtggtgtctgcagtgtgctgtgtgtgtgtggtgtgctgtgtgtgtgtctatctgtgcagtatctgtgcaatgtgttgtgtgtgtgtggtgtgctgtgtgtgttgtgtctatctgtgcagtgtgctgtgtgtgtgtgtgtggtgtgctgtgtgtgcacgtgtgtggtgtgctgtgtgtctgtgtggtgtactgtgtgtgtgtctatttgtgtaccgtgctgtgtgtgtgttacatgtcctgagctcacgccttctgttttcacatttgactgtgattactgtcctttttgagatctgagtaacagggacagggctgggcccgatgacttaggcctgtagtcccagcacttgaggatcatttgagcccaggagttggaggctgcagtgagctgtgatcgcgccactgcactccagcctaggtgacagagtgagaccctggctcaagaaacaagaccaaacgaaacaggaatgggtggccagttctgccacttcctttttatttgtgaaatctaagcacatacataatccaggtagttgtcacggaaaggggccataactcaagagaagtggtgccctggagcctaaaggctttcccattaggataaattagaactggaaattgtcataaagacaatgcagggtttgtggatttcagctggatgagtaaagaccagcctgggcgtgaaggattttcatagtcagttgctaaaggtggtgccccaggaaggctatttggcaggcgtggggcgcagtcctggcatggggtgggatggggctggaggtgctgctaatctatcttattaaaacccaggaagtttcacaggcgccttccaaaccacagctcgttgatttaaagatgtgaattccacgtgtgtaagccaacagaacaattgcgttttgtggtctctggctgatgaaaagtccctgatgaagtgctgtttggtaaaacgattcctctccattttcctcccttccaatctgtggttcacatttattcaacgttcttttctttcaaacagcatttgtgtgtagccaacacacatgcatatggagtgctgcgaagtctctgtgcattatctggaaacctgctttctccagaaaagctgactatccacttcccgtgctctcaagcccaagagacaggaatgggacgtggggagcgcgtaccctcttctcaacaagcaggttgaaaatccagtgaatttctttatgatggaatttgaatcacgtggacattcattagaatatttgggcaggattaagcccttaaaactggctctagattatggttataaaatggcctcaaaggaccctgaaactaatgaaagaattcttccatttctgacatgcttcactccctctggctctggctcttatcccaaatcaaagaatgttggtttttttagtgtttcctttataaacaaggatggtttccagattttttttttctttttgtttttttttttttttttgagatggagtcttgctctgtcacccaggctggagtgcagtggcgccatctcggctcactgcaagctctgccttctgggttcacaccattctcctgcctcagcctcccaagtagctgggactacaggcccccgccaccatgcccagctaattttttgtagttttagtagagacggggtttcaccatgtcagccaggatggtctagatctcctgacctcgtgatctgcccgcctcggcctcccaaagtgctcggattacaggcgtgagccaccgcgcccggcccaaagtgactcttatactccattataattatgaatttggaaaacaataaggatattatatgagtctgctcaggctgctgtaaccaaagaccacaggctgtgtggcttaaacaatagaaatttcttttctcacaattctggaggctggaagtccaagatcaaggtgccaggaaactcagtttctggggaggcctctcctcctggcttgcagatggccgccttcttgctgtgtcctcacacggcctttcctcggagcgtctgtgtatgggtggggtggaggggcaagcagagagcttgcacacttcgacaatatgaccatctatcataggcatcaatttagtttaacttcatttcatttacagggtgttaaaaaggaaaatcatctgcataatttgagctttttcatagtgagttctgaatctaatttattttgagttattacagaagtctgcggatatcccaccttaagatagccatatgcacaattagtcatttcttaagggatcccccaatgtgaaaagaattccccgagaaaagacgacctgaaagatcttggcctttacataagtgtacacagaattatttttattgtgataaaatatacataacataaaacttactatcttacacagtttaactgtacagtttagtggcattaagtacactcacgttactgtgcaggcatcatcaccatccttctctaggactttcccagctttccaagctgaaactctgtcctcattaaacatgagctttccattccttctctccccaccaaccacctggcacccactgttctactttctgtctctgtgaacttgatgactctggatacctcccgtaagtggaatcctacaggatttgtcccttttgtaactggcttatttcacttggtagaatgtcctcaagattcatctgtattgtagcatgtgacataatttccttcctttttaaagctgaataatattcccttgtgtgtatagaccacattttgtttatccattcatgcatcgatggacagttgggttgtttacaaggaattattttaaagccgaatccagggtggctggcttgtgactactatttagatgcagacagtgattccaggtggtgcgtggtgaaatcatgtcacacccccgcggaaaactccacagctttcctcatgtgccctttccatcacttctctgctgctttaggaactacttttcttctgaggtgacctctttctgttcctttcagtttttaaaggaaagaatagtagaagtattaaaagcagcagcagaagtccacatgttaaccctgtgccagcccacatccccttgtgatctctggcagtggggtctcttctgctagcttctcccgagcttcctgccaaaaccctgtagccggccttcgccatgtccctgaatttgcttttctttttccaccctctacaaccttcctttcctgcagaagtataaactttcaatccgtgtgtataaactttggggacacttcgcaatcagcatgatgaagttttatttttatgtgaaaactcttgatgattctgaaattgtggtgtctgtaacttaaacatcatctacaaaatcactgctctatctttggatgtgagtttgttctagcatgttatcacagtaccgaattccaaagaaactgctgtttacttaccaagggtaggctttcaactcagatgagtttatgactttatttacatggaatagtcaaaatggacttctgacatttgctgcaaagtaggacaacttaattgatattgatggatctactcatttattcagcagataacaaagcccttccgattgcaggtgttgtggagagagcaggatattcatttgctagggttgccataacaaagtttgatttgatttttggttggggatggaaactgtgtaggaggcaagcgtggagcttgatgtgagctccttgaaataatgaaaaaccagttacaaaatctgtattacctgtagcagtacacattctcccaaagcattctgttggcattttaaagtcctttaaaacacacagctgctttctgttgcttcaaactaaataaggcattatcttcacttttccttttgttaacctaaagaaaaaccttcatttgtaaagcaaatcatcacagcaggaggattttctggtttatgcactagggtgcatttaatctttattttacactgctgattaactttatgattcaaattttaacttatagtttctttttaaattaattacattattgggtgctttcatgtttttgctaaaagccttcctattagaagcactacaattgacagtgatggactgacctttaatatttttttgttatgtgaccagtgtttggtttataaaaatttttctctaaaacaccaacttttggctgcaaataccaccttttcacttgggttcttttcatagtgtttatttacatgggatattgtcactttgcacgctgtagctatttgtctttgtcagcaaatgtaggtaaaatattaatcttgtatgaaattcagataagcagggaacagatggatttatggtgcttgaaacctctgaactctgcagctgtggcaagttgttgaactgtaaataaattctggacggtggctagcaggggctggcgtgacctcatttgccccacaatacctcaccgtgccagggatgcatttcctgccctgtgccacctgtggtttggtcctagtgctttggggccgcagagtggagctgggctccctttgaggaagtcatcagtgctgagagccctcctcacgggtgagagtccagtgggatgtgtctgagcagcctacgctgggcatgggccggggcacgctgtgtcccaagcatgctttaggggtcccagtggcaaaagcacatttgtggttgtttaatctctggaggtggaggatagccccagctcctgggtcagtcagctggcggaacagggtaggccaggggagacagcactccaccctgctgggcatcttattaaatgcagcccagtatattcaatgccggcatcactacttcatgggaaaggatgcagcgcttacagcaggtagtggggtagagtggctgtgtggggattttcaaaatggaggctaaagtgatgcactttggactcgctggaaagtgcctggacctctggtgagttcagcctgggaggtcagagcaccacaaaatttgcttgctgtggctgggtgcagtggctcacatctgtagtcctagcaggagctcagtagtccaagctcaggagtccgagaccagcctgggcaacatcctgtctccaccaaaacaaaaccaaaaacaaaaccaaactggcttggtgtggtagtgtgtgcctgtagtcccagctactcaggaggctgaggcaggaggattgcttgagcctaagagttcgaggctacaagtgagccatgatcataccactgcacttgagcctgggtgacagagtgagaccctgtctcaaatgaaaaaaaaaaaaaaaaaaaaaaaaagtacttgttgcctggccacaggaaggtctgtgtgttggtttgtttaccttcccgaacctttgctggggagactttttatgcccccatatgccccagattcactaacaagaaggaagtgttctgttctgtgtaggatgtgcagaaacagccttgaaaatgttaccaatcaccgaccttctgaaacgagcttctgtggatactgggaaagcactgggacaccattcccctcactcctgcctctgcttccccagggtggaactggcctgtgcttgatggtgccagctgtcataaagaagtcattgagcatccctgcatttgcactgtgtacccagcaccatggagggatagccactttagccaaagcagtttttcagctttactgagatgtaatttacataccttcagactccctccgagggtgtttttttgtgtattcgcagagttgtgcaatcatcactatctgagtttagaacatgttcagtaccccatgcccactgtattagtctgttttcacgctgctataaggaactacctgagactgggtaatttataaagaaaagaggttgaattgactcccagttctgcatggctggggaggcctcaggaaacttgcagtcatggcagaaggcgaagaggaggcaagacacatcttaccacagcaaggcaggagagagagtgagaggggaagcgccatacttctaaaccattagatctcgtgagaactcactcgccatcacaagaacagcatgggggaaacccgcccccatgacccaatcacctccaccaggtccctcccctgacgtgtggggattacagttcgacatgagatttgggtggggattcagagccaaaccatatcacccatcagcagtcacttcccattcttccctccctgtcccaaccggtgcaaccagcaatttactttctgcccctatgcatttccctattctgacatttcaggtaaatactcacaacatagggacttttgtgttctcatttcactgagcattgtgttttcagggttcactcatgttgtcccctgtgtcggtgcttcgttccttttcatagccagattatactatctgttcatcagttggcgggcgtttgggctgcctccactgtttggcgattgtgaatagtgttgttgtgaacatttaagcacacgtttttgtgtggatgtatgcaaagtcattttttttgaaagccacttactacacgattggctaacttccatcagagaaatgttgtttggtggagttaaaaacagattatctgtgtactatattaagttgggtgaggaatgatgaagtgtaaattatacttacataaatattataatgctgtgcagaaactcttaagctatcattcttttagaaaatgaattttatgagcttgggacctttttgttaaccaatctgagaaaagtctgttgtcagtgtggacatattttacctttaaatggaggaggggagagaatctttcaaaaacattaatatcagtgagattaatactaatctgtcaagatgacccagtgaacagttggctatcaaagtattataagaaggtttttaaaaggaaagtgtctattttgtaaagatcttgagtaaattatgcttttaagtatgttttgatattcccccccctcctcccaaagtgtagcatgcctgagcgctgtcatgtttaggaggtgatgggttggggttagagggtgattgactgttagcgaagtgggttgggatgaacaagtgcacttgagtacgcgctgcacagtgtaggcatcaggccacgtcagtgtgtctctgcatttgggcagatgccaggcctattgcaggcagcataacatctaggaacgggtttatggatgaacctgggtaactctgggagcacaaacccagaccacacccatcgggagagattgacctgagtgatgcgctaacgcatatcattgagatggggccagatatcttgcttagatgaataattggagttcatgtcaaccatctgtcctttcccataatttaaagccaacttctatattttccaggttcatactttttttttcattaattgcatgtaaagttgcggtgaacaccttctttcttgacttcctgtttaaaaaaattacagttcttaaaattataagcttattcaggatggagtggtcagtttgtagaaaaactagctctttagatcttttaaaagcactacattaaaaaaaaaaaaaaaaaaaaacatcggacgtggtgggtcacacctgtaatcccagcactttgggagtccaaggtgggaggatcgcttgagcccaggagtttgagaccagcctgggcaacatggtgaggccccatttctacataaaattttaaaaattagccgggagtggtggagtgcacctgtagtcttagctacttgggaggctgaggtgggagggttgcttgagcctgggagttcaaggttgcagtaagccgtaattgcaccattgcactccatcctggatgacagagcgagactctgcctcaaaaaacaaacaaacaaaaacaaacccagagaaactcaaaaaccaaaaaagaggtatccttattttcccaggcctcaatgatgaaatgtgcccagtgttcatttgaatctgcccatcaattagtcttttcctgatgtctcagagaagcatgcatgatgtacggaatgtcttgggtgacctagagcggcatccccaataggactgccctgtgaacatggccccacattcggctcttgggcacttaaaagatgtggccattgtgactgagaaactgaattgtgaatgttatttaattttcacgtgtttaagatgtggccagagcagacagatgaacagtctggcttgatggataactgcagggagtttcacgatgctggtaggaggcacagtgagcttctggaagagccggccccacctaggcctgattttggtggctgctcaaaaccgctggtactgaattcctttagaatagtgcttctcaaagcgggtgactttgtatcctccccaccctccaggggccatctcacaatgtctggagacatttttggtggtgacagtgggtgcttctggcatctggtgagtagaggccagggacactgctcaacatcccacagtgcacaggacggcctcataacaaggaatcatctagccccatatgcgccacgatggaggagccctgctttctattccgaagaccagcagtcctaagatacgatgtggacagcacagacccagttttctaagtgaagagataaggcttgagcaggcagcagcctggtaatgccaaggccaggacagttagccaagtgtctgagtccatggagcttctcgggcagtgttctcttttctcttcagctattccagtttgtattaagtgtaagaatatgaagttgatgtttgtcgtgagtcaagacggtgacacagaagcagtctttcgtgctttggtctaatagctttattgttaaaggagagaaacagaaaactcctctttgcctctgcagttttctctgaaattgaatttagggaaagctgaccctagaccatgcgtgccctttccaccagcatcgctgtgggttccactcgtgggagatcgataaggaagtggggatgaccacgctgcacagaagtgttctcatcacttttgcgcttgcttatttaacccatgattgttagaaagcgtttagaaagttggtctttgcaaaccagccctgttaagtgctgagatgaaattcttaactttttttttccttcttagagataaggcctcactctgtctcccacgctggagtgcagtggcgcaatcaaagctgactgcagcctccacctcctggactcaagcagtccccccacctcagcctcccaaattcttaaaaatgctaacagtaaccctcacacacaaaaagtgctgccgttagagatggcactggtattgagaagcacgtgctgtcagtgttgcaattggtaatgcacaccacacttgggcatagaaattggaaatccaactgcgccaagctggagcctgcagaaaggagcacgaggagacgggacagcaatagagctctgtcgacggcgctaagtagaaccagacgctgcaataagacaagcgtccccctgtgctcagtacaaatgggttgcctgtggcagatgcaggggtggctttggcagagagacggctcctggcatcgtggaattgaattggctgtttcttttaaagatactgcaaattgcggcagcatttatcatcctaaggaagcccgcacagcttgccaaacagataatattgatgatgataacaacaatgataaaaggaaaccatgatgcctctactcaatgaaaatcacttttatcttatttgcaaaagtcagaggtaggacagatgtgtcagcgtcttaataagacagttattcaaggagttaaattgaaattattcacatacccaaaataagctatttggcaaacctggagacccaggggcctttggatctatcttagtgtaaaatttcttgaagcagagacctagtaggtactctgttgcttatggttccaggcaatgtattgttttttcttccccctaaatatctgtgaatgtgtgaagtaccctgtgtgccagagatggaaagtaaaaccacagaagcggggtgcggggagatggcagctaaattccttttcagcagagttgaagcatcttgttgtaagagtctagctccacaacagtgggatgcaggaaactgtaacagctgaaatacccaacagatgtattcaccatcagtgcattgggaaaccctctcaaaagtgtcatcacaaatgatgatcttaacttttgtatgacaggatctttaggtcacccaacagtaggtgcacagtttctatgatttcaatttttaccacttctggagacttgtcttcccatttcttgtatcagtgccttactgatagagttggaaattggaaccaaagtaattagattggctctccagatctcttacatgagccaagaaaggattcaaaagcatgccctgtttccttcttgacaggctgggagaggaagtgaccgggaagtgaattgctaagatgtggtcgtcattttcctttacaccacagagcctctgcgtttgggaactgcaggttcatccgagtcaatgtcagaagtgccttgtgtctactgtagtgaacatcctttgtttccatcgggtcctgtgggaagcagcactgcttattgggtggtttgagggtgaatgctattttacaacttgtgacccccttgacacactaccttttcattttagcatggagcacagagccatttctcccctgtgctggattttgaatgttctttcaaccaccgtgatagaatgtccaagaaaggaacaaaggaagaggcaactaagggaatctttcagtgggttcataagccatgctgctcctggctttgacaggagttaaaatcatgggtatccctaaaccactatcattattggagttgctgttactgtcgacgtaaagagtcaaactctgtaaaatatttgaagagatttattctgagccaactctgagtggccatggcctgtgacacagccctcaggagatcctgagtacatgtgcccaaggtggtgggggcacaacttggttttatacattttagggagaacacagcttggttttatatgtgaacccccaaaatctgagacgggtctcaatcaatttaggaagtttattttgccaaagttaaggatgcgcacccatgacacaacctcaggaggtcctgacgatgtgcccaaggtggtccaagcacagcttggttttatacattttagggagacatgaaacatcaatcagtatatgtaggatgaacattggtttggtctggaaaggcgggacaactcaaagtggggagggggctcccaggtcataggtagacaagggacaaatagttgtattcttacgagtttctgattagcgtctccaaaggaggccatcagatatgcatctatatcagtgagcagaggcctgtcgttgaatagaaggggaggcaggtttgctctgagcagttcccagctggattttccctttaacttagtgatttgggagccccaagatttattttcctttcacatacacatttgagggagacatgaggcattgatcagacacatttaaggtagacattggttcagtccagaaaggtgggacaacttgaagcaagggtgcagggggaagggggggtgctttcaggttataggtagatttaaaatttttttgataggccattggttgaaagagtcattaccaatagaaaggaatgtctgggctaccttaagaggttgtggtgaccagtgttttatcctgcagatgtagcctccaggtagcaggcttcagagggaacagattgtaaatgtttcttatcagacttgaggtctgtgatgatgttcgtgctggaggggcttaatgaggcatgcttgacccccacttcccggcagtcatggcctggtccgtctttcaggataaatttagttggccttggcccagaggaggaagtccattcaggtgcttggggggctttcgaatgttattgttggtttacattatgattgtcattgttattaaaaaactaagggctgtagagaaatggttgcagcatccatcatgtgtccctaggaattgcacatagctaagtgagaacctcacagaaccctttcacgtgcagcccgatgctgtcactgttcataaacaattgtattttgccttcctgaaaggccatctgagttcattaaacttgcatgcttccatatctatacattcttttctcatggcctctttgtggatggtttgttttaccatttgttgtccatcagcttgaatggtagggggaagagttcacaccgtgccccctgtgtagcagaatagcccacagttcaggcatggctctccagcaaggagctttctagggctctgatgctcaccagtggggggattgggcacccctccgcaactgccaggggacattgacaatgtctggagacattttgggttgtctcagtagctgtgtgggggatgctgttggctagtgggtggagccctgggatgctgctaacatcccaccatgcacagtacagccccaacagccaagagtgatggctcacaaatgccaacataagaaacccattctagggtacctttcatttgcttagtgctgcgagaaggtttatctgccaaagatcatcatcttggagagggccaagatcctgtatcctgtactggacagatatgcaggcattcaaattctgaaacgccgttggaaacatgaggctcggatcacagaagcctcctgtacatagagcaaatgagagctggaggcctgctgcccagcccagctgagtcctgtttcttatttcggttttcctttagattccaccgaagtttctctgaagaatgctgactcaggctgccccttttattccatttctttgcagggcagtttaggtgaagctggaacacagtgttccctgaggaagcattaggacaattagaccctgcctttgctaaatgaatgtatcaagaaccttcaacgtctttacaagaagcaggataaccattttgcagagtactgtgcttagtagcagagcatggcttctgttacacagtttcagtattgcaaaggtccccagccagtacagtcccacccttaattactgcttcagagctgcaagttaacgtttaaagtgttttcacagtagcttgaagtgtgatctcccatattacggtcatatccttggacttagcccatgttacataaattagatctttataagcagcacacttctttgcaagcaatttgcttccctttgggaatctgattccatagaaaacagtagtattttaaacatgttgattctagtacttacagttctattcacgtgctcctggtatagtacatctaataagaaagaatcccttatttttacttttatccaaatgcatgtatgttctttcagcatgagatataatttgtctgatcaagtatatagggagatgagattaagaattaagatttgtttcaagatatgagattaagaattaagatttatttcaagaaactcaattgcatggttgctcgcataagccactatgcagtggcagctttaatgaatggggttccaatgttttccttactgttttcaagaaggtagtgaataaaattagatgttaaagcgaattgcattgtgtgaagattgggacagatgccacatatatagttcagatgcttgcctgccagtccctgagatatactcttagcttgttaatatggaaattgtcaaacatattcagaagtatacagaatatcttggtatattcctgtgtattcttcactcatctccagccactgttagcgtgtcacgagcttgtctcatcgtcccctcactgttttctctttagagtaatttaaagcagatctcagacatcatgtgatttttacctataaacatttcaagttgtatccctaatatagaaggatttttttatgatactattattctgtaattgtttcctgtttgccttaacgaaaagaccacagactaggtggcttaaaatagcagagatgtattgtgtcattgttgaggaggtcagcagggtggtcaggcggcagcagggtggcttccttttggaggctccaagggagagccccttctgtgtctgtcctccaggttctggtgcctgcaggtgccccttggcctgtggctgcataacgccaatctctgtctgttaggaggacactgtgtttagagcccatgcaataacccagaatacctcatctcaggattcttaatttaattacatctgcagtgacccttttttcccaaatgaggtcacattcagtcttttactatataaggtcatattcacagagtccagggatcaggttgtgtacttaatcctgtttctttcgtgctcatgggaatgtatgagttaggggaatacagattatctttgtgttgtagggttttcttaagattatgatttattgaaaaagaaggtcaatggcatataaaggaaaatgtcattgataaatataaaaagaaatgcaagttttttaggccaagcagaatgcttataggagccagtgtcttggattaaaattatatgtgaacctcaagtgttatcatctataaagtgaaggtagccgtgaattacctcttagattgttgtgaagataaaaatgaatacagcattaacacagtatataaatgctaagcatttagtaattatagttcgcctctttttttctggaggctcaaagttgattgtaaatgtcaaaccaagaaataatactaggtactagcaacacataatgcaaaggaatgattcctgtgatacatgaagaactcctataaagtactaaggaggatgaccagcagcaggccatgagaaaaatgaaaaaagacatgaacagttttcttaaagggaaataatgaatagctctaaaatgtatggaatgaagctcaatctccctcatgacatggggaatgcagatgaaaagtgtaaggtaccatttcacctttcccattagtagaggtcagaggtgtgactgtgttccgctggcaggagctcaaataaaagcgggtgttgttgctggcaggcattgcaagaggtccagcctctttggggagcagattggcaaaagatatctgacctagaattgtcacttcttgggatttagctcatggacatagtgtaaatatatgcaaagaagtactcacatgatattcaccaaaggcattgtaaaagcagaaggatgaaagcaaccacccacagtgaacgtgttagattataataaaggcatagaatctatcaaacaataggaaaaaaagcataattctgtatatggaatgaactccacatgacgctcttgcatgtaaaaagcaagacagatacctgattgtgagtagagtttaatacaagttctatgtcaaagtgggaggagctatatgggctggtctaggtagaatatttctggaaggaaataccaaaaattggacttccctgttggggagaggtggattttagagatggggtagtagcagcttctcaaaaaccaagagaaagcttcgcatttacaatgggattattggaagcaataggaaacacccatttttgtaaaatctgtgagaatgtgtatacttggtaaaagtatagatattcagccattaaaaggaatgaagtattcatatatgctacattgtgagaattgaggatatgctacattgaaagaaaccagccacaaaagactgtataaggttccatttgtggaaaatactcagaaaaccttgggggaggaggggacaggaagtgtctgtttagtgggtattagatctcctttggaggagaggaaaatgttttggaattagatacagaggtggcggtgattgtataacattgtgaatgcccccaaatgccactaaattgtacacttgaaaatggttaattttatgtcgtgaatgttacttcaatttttaaaaaaatccaactgcaaggagagaagattctctagggaatggcttgtcaaagcatccatgtcaaagggaccatttaaaaatttccagtctgaggtgggtgcctttgtgaaaagcaattaaaatgtataactagaagagcaatcatgtctcagacaccaacgcaagcacaacttgccctaagttttctaagcacttcttacctcattcattcatcaccagagacagacagttcccaggccagaatccgcacctggatgcaacttttaatacatggatctagagttgtgttcttccagctctagaagagctccatgccacccccctcccctcccccccccgccacagcttgtcagaaatgcagatcacaggccgtctctaggtctgctgaatgagaatttgcattttagtaagctgcctaggcagctcagaagcacattaaagtttgagagggtaatttggggacagtaaagtgcagtcggaggaggatggttttgtggccctttggactggtcacttaatgactgtgaccctgggcaagggactgggttcgttccctaggctcctgtaacagagtgccacagactggtggcttaccgtatagaaacaaatgctctgcagctccagaggccacaggtctgaaactgtggtgttgtggggttggcacctgttccaggcctctcttcttggcttgtagaaggctgtcttcatgttcacatgaccttctgcctatgtgcagttctgtatccaaattccccaccttaatgacatcatcttcactaattacatgtacggcgaccttatgtccaagtcaggtcacattctgaggtactgggcgctaggactttaacatgtgaattttaggggaacacagttgaacccgtagcagtacttaacctttctaatcctcaatttcgtcatcttaaaaatgagtaaactacacattaatgtgggtaccatcaaaaaaacaaaaaaaccaacccaaaaaatagtaagtgttggcagggatgtggagaaattggaactcttatgcactattggaaggatcataaacaggtaaacactatagactatagttcagcagtttcttaaaactagaattatcagatgatccagcaaatccacttttgggtatacatccaaaagaattgaaatcagaatctcaaagagacacttacacactcaggtttagagcagcgttatttatattaaccaagaggtggaaacagcccacatgtccctcagcagatgactggataaacaaaatgtggcctgtccacacaatggaatagtattcggccttgaaaaggaaggaaatcctatcacatgccgcaattttgtatgaaacttgtggacattatgttaagtgaaataagccagtcacagaagagaaatactgtataatcccactttcatgaggtatctaaagtacacaaattcgtagagacagaaagtagaatggcagttgccaggggctgggggaggtgaaatggggaattgttgaatgggcatagagttggagttttgcaagataaagagagttctggagattggttgcacagcattgtgaatttaacactgttgaactgtgtacttaaaaatggttaagaggctggatgttttgggtcacacctgtagttccagggctatgggaggctcaggtgggaggatggcttgaggccaggaattcaagaccagcctgggcaacatagtgagaccccatcttttacaaaaaattaaaattagccaggcatggtactgcatgcctttagtcccagctacttgagaggctaaggcaggaggatcgtttgagcccaggaggtcaaggctgcagtgagctatgatcacacagttgcactccagcctgggtgacagagcaagattctatctcaaaaaaataaataaataaaagatggagaggagcgttacttttttgtgtgcaggaacgattgctgactgcagagcctggctggctaaaattagatttgccttgtcagtataataattgtaggtatttttggagggaaggatgcctggagcccggctgggttatttccgcccttggagtgagccagggcagcttagagggctacccgcgtgcagccctggaaggtaccgaaggagccctggaggcaccgagcgctggaggcctcatccctgagcaggttgccctccttctggtcggatggcagggcggaaacccatctgtgtcgggagtgagagctgtctgctgtccgcggcttgcgcttggagcttttcctgcagtccagggagagcagaggaggccagtgacttccatgaaaacacccccagtggtggggagggaggcggcatcccttggaggtagggatggggcccctgctgtgacccattagaggcaaagaagggcttggaagtttcattttgtcttacatgagtgtgtgtgccgagttcacattatttgcacatctgtgtttgtttttatataatgataaggacatcagtttccattgataaactataaggaagatgtgccatgtttaccagggccagagtgaagagactgaggtgcttgctttgggagaaaaatttgagggggtgacaaacaccacagacatcaagataaattatctgtgtgtattttaatagctttattgagatgctgtgcacagccatacaattcacgcatttgcagtgcacagttcagaggtttttactatatccacagaggcgtgcacccgtcaccacagcccagtttagaacattttcatcacctggggaagaaacacccacccagtggcagtcacttcccaccccacccccacccctgccaccgtgcattctgctttctgtagatgaatgcgtttgtctactctaggaacctcatacaagcagagtcatacagtgtctgtccttctgtgtctgacttctttcactctgcgtgtgttcctggttcattcatgtggtagcacgtgccagacattcctttctgttacacagtactgtatgtattatatatgtacacagccggctgttcatatccacgagttctgcttctatgaattcaaccaaccgtggattgaaagtatttgggaaaaataataatgcaacaataaaaaaatacaagtttaaaaacaaatagagcataacagatatttacatgacattgacattgtattgggtatgatacataatccagaggtgatttaaagtgtaagggaggatgagcggttatatgcagatgctactcccttttatctaagggactggaggatactcggattttggtatctgcaggggtcctggacccatcccctgtggatgctcaggggcggctgcaccacatttgatctatgtgttcatctgtcagtagatgtttgggttgtttccattcattttttggctaagtgaataatattttaatgtgatatttaaaaaattaaaatgaatgcaagaaattccatgaggaacaaaatattaattttaagtaaagaccacaggatcagtatttctgaagtttccttttgcctcaggatccagtatggctccatacattactgatcctgtctctctctctaacattttgatattttgtcatgtactttttgcattcattttgattttttttttttctttttgagacagagtctctgttgcccaggctggagtgcagtgatgcgatctcggctcactgcaaccaccgctttccaggttcaagcattctcctgcctcagtctcctgagtagctgggattacaggcacacaccaccacgcccggctaatttttgtatttttagtagagactgggttttaccatgttggccaggctggtcccaaactcctgacttcaggtgatccacctgcctcgacctcccaaagtgctgggattacaggtgtgagccactgcgcccgtcctcattttgatttttaaagataatgtattacactattgtttcttttgatggttgaattttctggcatccccttcaattttgcaccagaggtaagtgatcctaatccctgccctgacattttacactgtgctgtgaataccccagggcatcatgaggaataaaatttgaaagtgtatttcagtgagctaacttggctggacagaatacccatgggttatccttaccagtggtgccatatttatgcctttcagcagtgttgtgattaaactcaggtccagtaaaattatcattatactatattagttttgtagaacttctgtaacaaatttccacaaactgaatggcttggcttaaaacaccagaagtatatcctctcacggttctggagtccagaagtccaaagtcaagatgggggcagggttgtttgcgtctggagcctctacaggaggatccttcctgcctcctccagctcttggtggcgccaggctccagttcccttgtagatgctacaagggaactcttgtttatagtcgggatagaaattacacaaaacccggtcttgattggggataccttttggagtactggcaagttgccgcatggactgagccttccgatcggagtttgctgtcttgctggtgatctgcctggatgccggtgcacacactaatccctgaacacactaagcattgcgcttgctgttgtttaacttttcatccatgattgaattcaggagttctttttttaaaatggccatttttaaagatttctaattgggagtttttcttctgaaaagaatacccgtaaagcaaactatttaaattatacactgagagacgtatgttcattcttgtatccataacagttaagaatcattacctattactagcataggcacaaagcgtctcctctaagacatttgttaattacaaaagggacaaaagtagtgacatgtggggaagaaacccagcagataccacctaggtggtcaaggtcatcatcatcatcacgatgagggcatgttgacaccctgtgataatctgagaaggactcagcatcactcctgtggtgttcctgccaaaaatgcgtaagagtctaatcacgagaaaaattagacaaacccaaactgagaggcattctgcaaaacacctctcctgctcctccaaagcattaagagtgacaagggaagaacggggaaccatcacaggtcaaaggggatgtgctgactataggaatgtgggctcctgggagagagaaagggcggaaggagaaaccggtgaaattgggtaagtctgtagttcacttacttgtgctgtgccgggtcttaactttcttatattttgctaattgctatgtttgtgtaagatgtcaacataagtggaagctgggtggcagttatatgcaactctgtgctatttctgcagcttattgtaagtctaaaaattatttcaagattaaaagtttttttttttaaaaaagtcagatgaaaacacgaataagtaaaaaaaacataaaaagagagaaaaaaggagccatttatatgattaactttttggttggtgtcgccataagttttttcagttcggattcttagtaaaggatgtggatcaaaacaaatcttcatactaaaacatcagcagagaccttatttcatttgaacaaaatatcatgaagtcaggattcgttttgcatttgaatcttgaacatttaagttttttaggaaatttgtggtgctcctgtccttgaaaggaagcccacatatgttcaaaatgcagtatcttttaaatgcatttgaattttttaaagttttggtgtttgttgtttttggttgtttattgctttgatttttcatgagcagtgctgttcaggggtactattattgtcagttttaaatcactgctgcagcatacttcatttgatcttgagacttgccatgagtcttactgtgggggtggggaggatggggaaagaaaccattgagtatgagttggcatgtcccacagaacagcgggcggacacttcagggggctgtgcctttctcagagactcgagggctatgcccaaatcgttatgcagtgtgtatgtgtgggggggatagttggggggacgggtatggggaaaggagtaatctaccagggacgacccaggacagatcccagagccaggaatgagggttggatcttgggcaaggccatctctgccatgactgcttgtgggaactcctgcttactccccgtgaccctgagcaaaacttccaagtttgaagcctcaattttatgctctgtcaaagaaactagtttttcaccctccaccagaggatgaagtatcattctccacgtgaagcactcagcacagtgcctgtcccctctgcagacatgatgccaatctgtgatgatgttctcttctgtcagcattttacaaagcagatgagagcgttcacttgcacagcctcctgttgacctttcttctctcagacgccttgctgtagatcccaatcgactgcttttccttggccagccgattcatgcagtctcttgcttacttaatactgttgatatatttaaattattgtttaataaatacttgttattctggagtatatttgttcatccaaggatggtttactactgcttgctttgtgcaggttataacaggtaagggggtggaggtgtgtgcagagcatcagctggtcatcagccatcttgcgggagtgcccagaggggggaagagcaaagcctaccccttctacggagtgtgagggaggcaggcttgggtggaggcaggactgcaccagccttccagagctcagagaggtgacacctgagccaagtgacacacacatgataaagaggaggtttctggagtccagaggaggaaggcatccttggctaagaggacagcatgaactcatagggtacctccaggaatttttcccctgggcagtaggggcagagaaaggtacccaggggggcaggggataaggactggcatggagcatgggctcgatatcagcctgctgattttaatgaaagccgtttggtcacctgaagaacagctttgattttacttctgtaatctaaactcttttgagttggaatataaaactcagtgttccatgtgacaaaggggtttttaaattggtcattcccttaaacatctttacattttcgtatctgttgatgtcatttttttccccattgctgactcctgttcctgtcttctatttctgctcttgacttaataattcttggcttcttgacgtttatcattgccgactgctctgaatcctcatcttcccttcatttatttccatttgtccgctctgtttactgcctgagatgttgaccttttttccaagcatgcactaagcggcattttaaagaagcagcatcatgtcatagctcctggtagtggggctgggcctattcatcttggggcttctttatctaccttggttgtaggtagttaagaaaatcttaacccttgggtcattatttctatagtgggtcaaagagatgaccacgttactaaaactttcatgtctagttgcatattctgttttttttattgtggtaagatatacattacgtaatacatttgtaagtgtacaattcagtggtatgaaaacattcacaatgttgtgtagccatcaccctcttacacctaaacatttttccattatccttctccaaaactctctgctcattatacaataactggcccttccacactcccctccccacactcagtccctggtgacttctcttttttctctttatttgcctattctaggtaccccatagaagaggaatcatataacatttatccttctgcgtctggcttatttccctaagcataatgttttcaaagtccatccgtgttatagcatatatcaaaatgtcatcgtatttttgtggccgaatactaatccgttgtagggtcactcacacgcacacacgtagagtagctgtgagtacagtgcccagattggtacagaaaggccacagtgcccatgggtctgtccattttacatgctgtaccgtgtgcttcatgggaaatatatttcttctgtgagttttcttgtacattgcttgtttccagacttctaaaggggtggttgtggggatgtggtgctgtgtctcaggtatactctgcttatgaaatagcgggtgtgatggaagggtggagaaagggagttgagtaataatgttcacctggggtcgggcgcggtggctcaggcctgtaatcccagcactttgggaggccgaggcaggcggatcacctgaggtcaggagttcaagaccagcctggccaatgtgttgaaactccgtctctactaaaaatacaaaaattagccaggtgtgacggtgggcgcctataatcccagccactcaggaggctgaggcaggagaatcgcttgaacccgggaggcagaggttgcagtgagctgatatcgcaccactgcactccagcctgtgcaacaagagcgagactccatcttaaaaataataataataataataataaggttcacctgattgaaatagcctctgtattgaagaacaccagcaggtgaagttcgcttagcagatctgagcttcctgttaccctaaacactgccaaccttgacctacctctgaaagccagtgggatgaggtctagggccaggtgggaaccttgggaaaggcatgccctactgtttgaccaaggggatgaggaggctgggtactccagtgatggagaccctttccccaccttttctctcacctctcctccacccagtgccctttcacctttcctttccaaccccacacccatccttccgccccacttccccatttatttctctctgctctttcatttccgtggccagccgcctcccaagccctgccctcaagcttcccctcccttttctttcatgcccatagcctacctggatctcctctccctcgtcgggcccacctccctccacccttgggatcctggtcaccccctccactgcaagggggagaagggctgcactgtgtggagggttctccctaccttggctgtgttctggggatttcccaccagcccttgcgctgcactggtgatgcccgatgtagctgaaactctgccccgctcggggttactggcctgggatcagcataggagatgggtttaaaacaggatgcagggaggctgctggcagacagttatttgaggaaatgcatttcttaggatatagctttcaagaaggtgctgttattgtgcgtcacacatagagtggctgtaatgcgccagggcaaatgaaaattatgtttataaaatagggcaccttgtcaagattaacttgtgtgaaattcccaagaatatacctcaaacagttttttatgtcagtgcatgatattgtagtaactctcccagttctagatatctttattttaaaaggaatgcttgtgtgcagacacatttttaggtggaggttagtatgttttagttctcaggatttctaggagaataaatagccataacttgataggattggtatgaatagtacttggtcttgggaagttttctccatgaaaatgtttcatgttgacgttttgctccctcccgtcttggttttacactcattcttcacagaactgtcatttataggaacttatcccctggccatctctataggtgtctttcttgcccagataaggtgagaatcattttggaaaccaacttcttgagaatccacaagaaatgggttttagccacaagggatcattgcattgcattctataagatgagagcttctacaagaaaaaattctggagccagatattttagggaagacagggggctgataagtgaattgttattttaaatggttttcatttcccctcatcctgatttagaagaggagagaaaactctccttagaatcagtgggtagtcctgacttgaatgggtttattttctttttctctcttgaattgtcggtgtatacccgtgtctttcttggtttatccttcatccccattcctccggatacccctatttgcatttaatctgtttggtcacataacctctcaagtagcgatcttggaggtttcaaaacttaacatttcattttccccgctgggtcaactaccagtctggaagcaccagggtttccaaggttaggttacagtgaaggcacaggggacatcttcctgtctcctctgcagagccagcgccactgtgcagtggggtgtggaccccggctcctccccaggctcccaggcctgcagctggcacaggggtccccagaacctgtgagggggtccttccctctgcctccctgagggacttggtgattcttagccctctctaacagagggagaagacgctgtcaaaaatgtggtttgcccaaacccacatagagctgggaaaggggccagggactcaaatagcagagatttcctggccatccatcagtcaggttacatcagtatactccatgtggattccactgggtgccggcctggtggctgaccctgcctttagagggaactcattattgtgtatttgaagtgtaaatacctcttttcccagatgttaatcttgtttcagatattcgatggagagggttcacataataaataattccctcctgagtcggcttgcgtggctcctgagagcagctggtcagggcccttcttgtcggtgtctcactggcttttagcaaaatggagacgaagatgaaagggaaaccttaactatagcttgaatccttagggtggactaagcactcaaagccttccatgcaaagcagtgtggcttataaattggaggcatttttcttattattaggacaaaccagcacccgaattggtttgtcaccagtaaaagaatttaaaacagtgcccgatttgcacagctgagattttggcaacagtatcttacacatctgaatgggtggagtaagatggagcatcattctgtgatatgtttaaaataatataccatgaaatgatgcagtaagtgttggagatatcttccagaagtcttaggtcatttgttttcatgtttaaattgtttccgcaaaggcattctcttcaacataaggagagctaaaaatcaaatacacagaaattttgtaagtgtgttgtttttttcttttcctgtttagactttataacattacactatttacctgggctaaacaaaataaattattttgtacataaaaccacaaggagatggtttagcctacttatgggaccaaactgttgtattagccagtgtgggagaatattgcagagatgtgtggcttcatcaatgaagattagatgtaaagtctttttaaaatatatgagaatgttgaactaaagatggttcagatgggactttgctcgagttgcttgagtctagaaggcaaaataaatgtttgtaattgttacataggccagccttccaaaatcccagctatccatagaaaacaaggggtcagcaaaattggccatctgcctagactggtaggttgtatgggtctgaactagaggcagtctttccccaggggacatttggcaatatctagagacatttttggtgtcaccttgggggaggggtagtactggcatctggtgggtggagaccagggatgccgctcaacatcctacaatgcagcggtcaccgatagcccaccctgccccaccacagccaagaatgatgcacccagtagaagcaccatccctcttccactggtgacatccgaacatgtctacagacactgcctaatgcctcttggggggcataatcacccctagttgaaaaccactgccctaaactgagactctgaaatcaaccacttaatctcctttcctctgagctcaggggagggacgtgactcctgcgagctgccttggctttttgtaggggcacagatagaagccatcccccaacacggtgccctgggttctgtggtggtctctgagaacccatgaataaggatcccagggaagcctttctaggtcgtgctgctttaatattattctagatgccgatttaaagtcataaaggaagaagagctaggactgtgctggaggaccctaaagcccatggcccatggtttcctataatgctaaccatgcccggagtatctagttataaataattgtgctgaggtcatgaatatttgactttggttctcaaatattcctaagaaaaaagtcatgaaagcccctgatggtaaaaggaggagagctgagacctaagtggataggagactcaggaaaaagcaagttagaaataaagttcaacaaccacaggagaggagaaaatgggtccaaaagacttgggctttaggcacatcttacctaaggacaaaaaagtagagaaaagatcaaatgttgagaaaagattgagccatgcggagaacgggcagggtgttgaagtacctgctgctctccttaaacccagcatgctgttcactgctttattttagagagtgggtgtagtggtctgtttcagaagactcaagtctacactgcctctgccactgaggttccttttgactctgcagaagtctttacctttcatctcctttctgaaatgctgtgagcatttttcctcccagagacattaattgggaacagcagtgaatgcctagttccttgcagtcctttggcccacacgcatttccagctgcccactggccagactggattctaaatgccaaaagctacaggcgctgacagagtgcttttgaaaagaaagaaatgcatgaaatgccccgaatttatgggaaatatttatacccagcagtccttgagccatgcgtgtcctttaggaacggtgctaccagacagccgtcggcatggccttgctcctggtggtgcaggctctgatgttccactgatgtgagcccaagagaggaatgaccagtcagcctgtaaccccagctccagtgttgttaatgagtgtcaccgatcaggtttcagacgttagtcagtgtcccggctccagtgttgttaatgatggccacggattgggcttcatgcgttagtcagtgtctctgttaggagctgaattgtgtccctgcaaaagggatgtatttaagttccaaccccttgcatctcagaatgtgagcttatttggaggtgggatcttaaccgagtgtgactggcttccttagaaaaagaggaaatttggacacactcgtacagggaaaaggccatgtgaacagccacctccaagccaaggagacaggctcagaacagattctccctcacagccctcagaagaaaccaaccctactgacgccttgatgtctctgaattctgcactccagaaccgtgagagagtcagtttctgtgaagccaatcagcttgtggtactttgttatgttgggcctatgaaattcatctactgttactagcctttcccaaatatttcagtccatgaaatgcacccagcatggcaactcttcaacttacagaaatggaaaagagaaagaatactgtgcttcagctagttttctcattacccagaaatgaaaaggcctgacctctgaaaccttgaggaatctctttttaagatgccagagcctgtacttctgcctgatccaagcagagtttgctcgctaccccgggcatcacttctcactgcccaggtggcactggatgatgtccaagactggccagatctggatggattccataaatagctcgtgctgtttctggtcagtgaagaaagaggaaggcaaagccacgtgcataagtttgttgtggatgccataacaaagcgctgctggagtggctaaaacgacagacgtttattgtatcccagttctggaggccagaagtccaaaatcaagatgtcagcagggctcttcctcctgagggcttgaggcaggatctgtcctgtgcccatcttccagcttctggtggctgctggcagtctttggtgtcccttggcttgtagctacatcacccagatctctgccttcatttgcacatggccttttccctgtgtccaaatttccatccccctaccttttttttttgttttgttttgttttgttttgttttgttttttgtttttttttttagacggagtctccctctgtcgcccaggctggagtgcagtggcgcgatcccggctcactgcaacccccgcctcctgggttcaagcgattcttctgcctcagcctcccgagtagctgggattacaagcatgagccgccacacccggctaatttttgtatttttagtagagacggggtttcaccgtgttggccaggctggtctcgaactcctgacctcaggtgatccgcccacctcagactcccaaagtgttaggattacaagcatgagccactgcaactggccaaatttcccctttttataaggactccagtcacattggcttagagctctctcctaatgagtttacatctgcaaagaccctatttcccaataagaagttactcccaggtactaggtgttagggcttcaacatacgccttgggatgggcagtcttgaatccataacaccgtcaattaaaaggttctgctttcattgccgccaggttgggaaaagttgccagggtgggcttggtggaggagggtctctcagcagggcagggtcattgcagggaaaaggagagagaaacagagacacacaaaagcagatagattgccttggcagaggtggccagactagagtctttgagttttgtagagagatcaattgattacttctagaaatgtcctcttcaaagtctctagttttctctcccatttccttatacaaggctctggccatattactacttctggcacagttgattcagtgacttttgcatataggtttccccaaagctaaagctaaaaacgaacaaacaaaaaaagattattcatgaatatgccacaaactttgcccatagataagactttgtgattacaagcaaaatctgattggaaaataaaatacattatatgttagaataccaggaaacttctttttggggagcgtctttatgaaatgaagccatgctaacctccctgggactgctgatcagaatgtgctccaccccaaagcctcggagagggcaggacagccagtgactctctcctgtcagtagacacactaaacctgaatccaggatgggaaatcaatgtttgacacagctgtatctctttcagttggatcagtaacactcgctcactcactaggacttccatttgcttttagctgcctgcaatgaaaacctggcaagacgtcttagtctgatccggctgctgtaacaaaataccgtagactgagtggcttataaaaaatagaaatgtattgctcatagctctggagactgggaagtccaggatcaaggcactggcagttttggtgtctggtgagggctgctttctcacagacagcatctttttgctgtgttctcacatggtggaaggggtgagagcgctctctggggtccctttgataaggcactaatcccattcatgaggccccaccctcatgaccgcattacctcccagaggctttacctcccaacaccatcatattgtaggttaggtttcaacataggaatttggtgggcgggggggggggtacacaaatgtccggaccatagaataggacattacagcttgaaaaagcactagagagaatgacgttgttcctttgtaacacagaaaagcattcacctctcaatttagatgagccattttgaccccagttggttctgaaaatccttgttgacaaacaaaattggagaggaccatagcctgcctgcttttcccgaggcccggggaaagctttttcatatgatgttattataatgttaggtgtaacaataaatgaaagttttgtatggtctgattgggtaggacaggcctgaacacaggcaaacccatctgcacagcatgctcaattcagtcagtgtacaaaccctgtgtcatgggagcagagagaagggtctgcttccattccggaggatgacagaggcttaaggacggtgctggcgtttcagctgagcctttaagaagtggaattttatccagaggtgatcttcttggaatagagagaacaaacaggtcagggcatgcagacttgattacaggtgctctggggaccactggaatttttgttgaacagaggatgatgaaataaatcagtgttctagtgtgttacctttgggcagtggcgagatccgagtctccatagtgaacaaatcagtgcacagaccagggcagaagtgcaggggaacatggaacattcagggcctggagggtggtacccaggccaacactgccccctttttccagctcccatctctgtccacatagttgggccagtgtagacatctgggtcatatagggaggcattccagtggccccatgtggtttccatggagatcttcaggaaggggttttggggtgagagttggtatctcgtggcaaggacacactccctgggctaggtacatatgggtggttttcttgtcctacagattgcaaagatacaggggtagctgttctgctctgggcagcttctgtagagacaggatgtgtatttgcttgcctgctcctggaagccagtcactgaggcagacctctttactcgtccagaagcatgacttggggatgattatagttcaaggacataaggcctagtggtgtctttcatcagcgccccccattttacatttctgggatccccctttctcttttactctgatctggcctcccttcccacccctctggccactcaggtgaggagatgccagatcccaggtgggcaggaaggaatcccactgaatgagatccttggaattgcagcgtagcctggagctgtatgttcattttagatagaaatattgacactattgacactatttggccgggcgcagtggctcacacctgtagtcccagcactttgggaggcaaatcactttgaggccaggagttcaagaccagcctggccaacatggcgaaaccctgtatctactaaaaatacaaaaaaattagctgggcatggtggcacacatctggaatcccagctactcgggaggctgaggcacaagaatcctttgaaaccgggaggcggaggttgcagtgagccgagattgcgccactgcactccagcctgggcaacaggtcgagactgtgtcttgagaaaacaaaaagaaagaaatattgacactatctgtccgcaaaaggtcaaaggcataattacaatatgattttgtttccatttttctttttcttcttatttcatgcaaatgctgtctttttgagagaagtggttataagcacagcgatattctatgctatgtacagctctcatatatagaactctctagaatggctcaagttaccattaagcctcaggtgatatcaaggttataaaatgtaaaatgaatgatcatgatcattaagtagaaatcctggctgtgtcttccaagttctttttctttctttcttcctttttttttttggagataggtactatctgcatttcagcttagcttgccgccagtgttctggtttcttgaccatgctgagtaattttcagccacaccttgtatcccttagaagcccttcttgattctgaggtacggggctcagaaagctttgtcgtgggaggttgtaaattaggaaacatgaaaatcagatcaacaacagtggctggtcctggctgcagggctcatctgcctggagtagcttgaagttgaatgttaatatatacttttaaattgcagttgtttaattaggtaaagtgcacaggtgactttctcacactaaatggatgatgagtattgggaagagttgactaaaatttctctatcttttgcccatatccaactctcattgaattttaactcttatgagatatgtgctatttaataaataatgagtctgagttttctcccttttggaaatgtcaggaaagtctcaatgattttaagtatcttttattttataatagcaatagaatctagaatttctaaaatcaaactgagttcttgattaaatgttgaaatgcttgtcttcatccacctgggagcagtcgttgtgaacgagaagccccagtgcataaatcattgaatgatacattggagaagtctcagagtaaaggaagatttgtttacttttcagacatcctggaaggtgagcatcaaagcaggtgagtggctggctcttggattcaagcttccctgatcctttccagaagtgtatccttctcctttaagagaa[450 bp omitted]cagaggttgacacccaggactagagctcagtagaggggccgtttcctacctgcagttcccttggaagagaaggggtgaagcttaccatgttggtggtggtttgtttcctggggctgctgtagcaacgtgccaccaactggctggcttaaaacatgtatggtctcccagttctggaggccagaagtgcagaatcaaggggtccgcagggcccagctacctctgaggcctccaggggaggatgcttcctgcatccccttgctgcttttggtgttgctggcggtccttggcttgtgggcacagcactttcctctctgcctcggtgactacatggcctccctgggtgtctctgtcttcttgcaaggacaccagtcatgttagattatggctccaccctgctgcgatttgacctcattttactttaactaactatctgcaatgaccctttttccaaatgaggttctgaggtgctgcacgttaggactttagcatgtgatttctgcggactcaggtcaccccataacagtagtcatgccccaccccatcccactccacccttctcccaattcccctggtatactccagggtggctctgtggccacacatgacccaggcccactggccattagacactttggcagggtggccaaagaaattctttgtgctgaataaaattaatgtgtaaatgcggcggtgctccaagggcagtgttgcgtgaaagggcaatagaaccatggctcctgataaacagaagcctgttaagcagcaaggtcaaaagccagatgcagaagtcagaattagccgggtagactttttatttcactttcccccccttttttttttgccagtggactgccaactgttctcttaacagaagggcagtttttgagtaaatgaagcaggacttgatctgggttgtcataaattgtctctccctcaagaggtaacttctcgtgtttgccagttcagaggtgtagggagacatctctgatgtgtagatgtcctagtttggggtgcagggtggctttgggtctgagagcctgctgttggccactgggtgcgcgtgggcttctccacatgacaagacgggaatgctgtgaaggaggccgctgttccgcttgggatgttggccgagcgccgctggcctgtgtccctggaatcctctctgattcaaccattgaacattaactctgtgaggtcacagccaccagcggggcttctgagcccggccctgttctggccatagagggtcaggaggagaagacgtttcacccttggattttctgtgtttggaatccaaggcctttcccgtggagtcttgtgaggttttctcgggaagaaatgatcctctgggagaggcttgggcgcgaactgaaacatctttcaagacactgtggctcttttcagggaaatgctaagccaagcaaacatccactcagaaatgttctgtatttggaagcctcagagtgttaggggaagccttgaccctggaatgtcatctcctggtggtggcggcttcacgtggtaaacaggaggtaacctgggtgtcatgtcacccaggtgacatgacacagggccacacaggatcatcttccagtggcagtggtgaagataggggatatgatttcacatcctcattagagcccacacatgagatccagctttataattggaatcccagataatgagcatgtgaacgtccgtaagttccgcctattctgggtatgatgtcacactcataaacaagctaagcacacaaactggaatttcactttggaggaaaaaaatttcaattctgttacatgagataatacaagtagtttaaagccacagagggtctctttcgatcaggtagatctattcttctgtgctcatgcaatatgatagaagagcttcttgcatctttatgtcaagaatttgctaaaataaatcagacaagtttaggatttacctcatagtaaatcaagaactttaagcaggggcttttcttctaattaaaaatgtcatgtataccacttagacatggaaatgcttaggtaagtggagcaaattattctctggggatttagaaaaaagaaaatcagtctggtttctatggctgcatgaatctggaaggtaaattattaacccagtagactaagattttactaaaaacagactaatttgttgtggcaagacagttccagtctgtgtgctagggcttttgtttgcatgcttgcttgaaggcagacaagtcaaattaaacaataattattggcttggagggggagcagatgtattggattagtttctgtgccacatttctctcatttccaccaatgcactccagtttcagcccttgtatcagttatctgttgattgctgtgtaacaaatgaccccaaaactcagcaggtgaaaactacaaacgttaatgatctcacacaggttctgagtgtcatgaatccaggtgcagcataaccaggtggttctggctcagggtctctcgtgaggttgcagcctgcgctgcagcctttgagacctcgtgtggggctggggggtcagttccaagctcccttagggtgtggctgcagcagaagtgatgcaccatgtgcaacaattctcttggtcctgtggatcaacctggtgaatgtgggacaggccggtactggagtgtgaatgccagggctcacggggaccgaccgtctgagaagctgcctgtcacgtctctctttgtcttttacacccataaatgggcaccttggtcagagaataactccttttgagtccataatcgtctatcagaaaattctgggaaaattacttgttgatttagccacgttcatggcctatctttggagccatcagagcccacaaatggagactgtcaacagcttagcagtcagttcattagaaagtagtgttactgcagcctgggtgacacagtgagactctgtctgtacaaaaacattaaaaaattagccaggtgtggtggcgcatggctgtagttgctggaactcgggaggctgaggtggaggatcacttgagcccaggaggtagaggctgcagtgagccatgatggcatcactgcactccagcctaggtgacagagcaagaccgtgtcccaaaaataaataataaaaaaagaatgaatcacataccaatttttttgctcttaattgcatttttgaacagaaaaacagttttccctgcaatcaaatgcaaacagttcctgagcccctaatggacgagcgtcctcagctcccacctgcactataaatttgcgttaatcttccagttaacttcagaactgctgctgtctctctatgttccttctgcctcaagacatataggaaatgttggcctttccctttcaaaagaacaaaacagttgaataacctactacagtcttctgtgcaaagttagcttcaaaaattatcaagaatgttttctccaaacattcacaaagtttacagagttttcccttttactcaggatttcagcccctttgttgctcttggctctcacagcaccaagatcgtctgtccactcgttcattgggcagatgtttattgaatacctgtgtgtgccaggccctgggccctgaagtcagggccataaacacagagcacagtcctaagggcaaacgattttctcaacagggatttgaggcctgtgaggtttgaacaaatgagcctcgtgagtgccagttctggacactcggcctgacttatcggacatttcgcagattcctaagattttagaattgggagagaatctttgagatttgcttgtagcccttacattttctagacaaggcagaaagaagtccagtgggatgaggcagtgctggtgctggcaccgcctcaccctggcacttgcatcgcctggaaacaaggcagagcccactggggcccccagggtccaaagcctccaggtacgtgtctgagttctagcattggagttgccgctctcacccttgccagttgctttggcatgaagcttgatggtaccagtgtgtttctgtcttcacagcttgtggccctggccctgagacctgaggcttggatggcactcccacttcttgctttaattcttccctggagagttctcaccttccctgctttccaagtccagctgagatgggcaaccaaaatttcccaagggagaaaatagctgaaaatagaagtagaacatgaaagaggatggcttttcttttttctttttttttctttgttccttttatttttttaagttgatttatttatttatttatttgagatgaagtcttcactctgtcacccaggctggagtgcagtggtgtgatcatagctcactacagcctcaacctcctgggcttaagcaatcctcccacctcagcctcccacaggtgcatatcaccatgcctggaattttttttttttttttttccaatttttgtagagacagggtgtcactgtgtttcccaagctgttctcaaactaactgatcctcccgccttgggctcccaaagtgctaggattacaggcatgagccatgtgcctggccgagaatgtttttcaatttgggcttgttcagtggttttcacatgattggactggggtggtaggttttgaggaacgagaccccagaggtgaagcgcccttctcaccacatcatatcaagggtaggtactgtcaacctgactcaccactgttgctgttgaccttgaccactgggtttaggtcatgggtgttgggttgcgattaatgtttttccctttccatgtagtattctttcaaaatccccactcgggtggaggaggggtgttaagcatctcttcctggaggttgtttatttcggttttatgttaaaatatatcagtgcagatccattcacccatctcttgatagaaggagtaggatttttcttgggacagggatcctttattcctagtttggagtcagcttcccccattccggatggtgcagcctctacaatgtttgtctctttgaagcggagtgggaattgaaagagatttatgaaaccatctcggtatagaatctatctaggattttattttcttttcccaaatcccttgaggcaatctgtcttggttaagtctctaaaaaagcagtcaaagtggtttttgtcgaaaaaataatttgggggtactcctagttcaccattttatataatattcaattacttttcgtaaatgcaataacaaggccaactgacataagcgagtttgaagcagtcagcagtttgggtgtttcagacccaggtaggcagctgaggtgggagatcccaggggaagctcagggagcagctgcccgccttggtcagttcagccaggttaagtggaggccttgggaagagagtttctcctcttgagtatttttagaagcagcagatatcagccataaatatttaatgttgtgtttctaaactttagcgtcataaaaatacaaaaaggtgactgggcgggggttggtcagtatatacctaggggagaaaagaacttcctcaacacatcacactgcataaggaaaaccgtcttaaacgttcttagaagaaaagtcagtaggtaaacagctatcgtgtaatctgatgaatacccaccggaggaagtattagtaattattctttgcttgccagggttttcataattcttttccaattataaaaattaatatgctgtaagcagtttttaaaaataaaagtaagcatgaaaagaaaaacatctataaacccacccctagaagttttgccccagcattttggtggtgtgttttcttccaggtgtgtgtgtgtgtgtgtgtgtgtgtgtgtgtgtgtgttgccccagcattttggtgtgttttcttccaggtaggggtgtgtgtgtgtgtgtgtgtgtcctgctgtattctgagctttgtagtatgccccttccacttgaccttctccaggaagcatttgatcatccagcaacatcgattgaaaatgtttgtatgcatctctttcatgaagtacatgttccatcatttatatcacatgtgttgctggagatttcaattgcttccattttcctttaggataaattgctggaaatagaactggagggctcttgagaccgattaccatattgctttcctgagaggctgtgcgggttgcgtggcagtgaggagggacgggggtaagtggaggggctggggcacaggcctctccaacacttcatgtgaacatggtcagctgagccaggaatgcgtgacatctttatttttccccttgcatttctttaattcctaacgaggtggaatatttgatcacatttgtcagctatttgcatttctttttccatgtattagacctaagcctctttgaaaggtgttatctcaggttctttccaatattgcactttctgagtttctcttgaatcccagttattttaaggattgcagtgttggagtttcagctgaaggggccatgtctgatgtttgctggtccattagcctcctggcctgagccaaaccatgcatcttcatgtcagagctgcatatgaaacaagagctaagtccagaaagcaagaagaagctagcagattgattttcctaggtggggcctaccagggcacttctgttgttgactgtaccactctctcctgaagggccctggttgtgtactgcagttgggactgctgacgtgttggggtgttacaagagcatgcggaggctgctcctctcctgtttcctggtgtgctgatcaaaagactttttatagaatgacagttgtaggaaaagcacagattcttatgttagccaataacggattattttttaatgttattataaattggcaagcttactaatttgtttctacttgtcattagccaaagttcagtgtttcccaaggatatatgtgaatgtgtgtctgtgtgtgacatctgttgtatttttcacatgaattaattgagtatctattatgtggcaagctctgtgctgtctttgaagcactgaactgtcttatgatacacacaggatgaggacaggatcattttctatatttctgtgaagtcctttttcaaattcccattcttttgctgcttctgcatctcctttgactgctttagggcatcccaggtagaaagcttacctaatgtcaactccagttctttcttttgtagtcttcattttaagcatgatttctgtttttctttttccctttaaagaaagcttctcaaactttgaaatgaaaacaaatgaaaggagagggaaaagattcagaaattattgatagattgctaaaaacaaatgctatgataattttgggtcggagcatctgtcgttttacagcacaacagatttagcttcttaatgatgtttgtatgtttttcctcaaaagtgtattgactaggtaggagttgagccaagccttgaatgaatcatttcctgccaaattcaatagactgagcaaatcctcggagaaatggccatatttctctaacactgggttcctttcagggctcaagattccattttctctcaatactttgctcctacagactaggagtcctcttcatgctacagtatgcagtgtgtatggaaactgtgaatggagaagcagccgttcatgctgccaagtttctttcagaaggtggctccaggtggatgactttcagtctgaactcagtgtcaccaggcatgtgtgtgcccacacactgccactttaagctgtggacaaacagaacggatattctcccaccaaaataaacatacaagcaaaacactctgtcttcattcagcatcatttgcatcctataaaataatggtttctccttgatgcccacctttcttatgggtggttcttaattagttccaaacagaacttaacgtggccatgatattccacttgctaaaacaagggcagtcgagtgttcgatttgccatcattgattagacgcatgcagtcacccagtgctgtttgcccaagcatctgtaggcggggattccccagtgctgattccccaatgcttgtaaggggcaggacttaattaaatcttaaagtgacagctgaaaatgtaagggtcaggaagtcatgtctaaaaggggatttagtataacaataataacagcagtgactaagactaatcctggctcaggcattttgtttggggtcacctggtcttaattagcagcactctgggatttgagtggcgctgtgctgttgcccacaaagcccatcagtggcaccattgcctgtgtctttcggggcagtctgttagggagggggtggcacaggtgttggcacggccatccccattttatatgtgagggaacctcagccaggcaggatccttgcctggatgctctgtggggagccctgtgagtttgtaaccctccgtgcagcctgccaggtcagcggccccaaaatggagagatacagagggcaccaaattgtaaggcagagcgttggctagtgacacaagctgcctttcgatcgcctgggcgttctgaagcccgcaaacattcgcctggaccttggtcaggtgtctcacagaacctacagtaattcactgttaagaataacttcaaacacagaaaatcgctttttgtttcctagagaaggctagtcttcagcgagaacaacttgtgatttttaatctgtttcacactggtcggggaggggggaagaaaagatgttatgggcatataattaaaaatttgtcggcagatacaattacaggaagaatcatgtggcctaaaaaactgaaagcctccatatgcctcttcatcttgccagctacagtccacaaattgtagagcctgcgggcactgtggaagccagctagatttgctctatccagtagcagcagattgagagccatacatggaatttatacttttctagcagccacaggaaaagagtacaaagaagcaggtaaaatttatattacaacatcttttttactgtgtattaaattattattgtaatacctattttaatatataataatgccataatatattttatttaacccaacgtatccaaaatggcatcatttctacaagcgattcctattttaaaaattatccgcaagatattttatgttctttcttttttgtacaaagtctgcaaaatccagtgtgttctttggtcagtgatgtctgagatcccaagttccaatgtctgtctgaaattatgaaaatcaagtcatgggagatggataccctattccctacgatccacttatttcacattgcatgcctgtatcaaaacatctcatgtactccataaatatatacacttactatgtaaccgcaaaaattttaagaatatacaaaaaattttaaaaactgaattaaagagcattgtagataattgtatttttcaaaaaataagtaaaatatctggtatataacagttaaaaaaaaaactgtattatcaactctgtgaccttagaactacctttttacattttcaaagattaactctccttaaaaaaataaatgtacaaattattaccaaaaaaaaaaaagaaaatcaagtcataatgtgaaaaataatttttaagctgaaagttacactgtttctaggagttttaaactaggatagtttgtggttattaatctgtttggaagtagtccagaaaaaaatgctatgggtcaataacttgaaaatgtgcatgtggactacttaaagaggaatcgtgtggcctaaaaagtccctgttatccctccaccctgcagactccaataggagaatttccgctgctgcagactctccttggtggccaagctgcccagcactctcccgtcccaccaatggtgtgactcctatcactgagaaacagaccccttaccatttcatttccttttaattaatttaaatttaaaaatcaacacttccttggttactggaatgttgggaaccatgtgggtgtgtgcatctatattttccagggtctattttgttacctataataccagtcatgtatttccaatgaaaatttaacttgtgaattgagatatagtacaaatgtaaaatacatacactgtgatgatttaggaaatttagtaggaaaaaggaacgtaaaagatctcagtaattttttaaatagaatacaagttgaaatgatactattttggatacactgagtaaatcaaaatctatcatgaaaattaatttaaggctgggcgcggtggctcacacctgtaatcccagcactttggcaggccttggcgggcggatcacctgaggtcagcagttcaagaccagcctggccaacgtggtgaaaccctgtctctactaaaaatacaaaaattagccgggcatggtggggcatgcttgtagtcccagctacttgggaggctgaggcaggagaatagcttgaaaccgggaggcggaggttgcagtgagctgagattgcgccactgcactccagcctgggcgacagagtgagactccatctcaaaaaaaaaaaaaaaaaagaaaagaaaaagaaaactaatttaaaattatacataaggcttgccttagatttctgttgggttgtgcagatctagaccacagttgtcatgtaacaaaggaaggagagtttgaaattacaggctcacagttaatgataaaattccaacctaaacccaagaccagacattccaaacactcaagtgagtcaatctgatgatttgtaaggcttaatgttgaaccgtcttcaaatgtgatgacctcatcctaactctttccaagctcccactttgggtatatcaagaggctgaatgtggtggctcacatctgtaatctcagcactttgggaggctgagtcaggaggattgcttgaggccaggcatttgagaccagcctgggcaacacagcaagaccccatctctacaaaaaaaattagccggatgtgttgatgcacacctgtagtcctggctactcatgatgcttgggttggaggatcattgagtccaggaatttgaggctgcagcgagccaggatcatgccactgcactctagcctgggagacagagcaagaccttgtctcaagaaaacaaaacaaaaaatgaattggccaagagaagtcaaggctcatctgacttggaagggagccaggttctcagtctatactgcttttctcatcctggcagcatccccatgagataaaaatgattattcccattgtacacttaaggtaaaaggtctcaaacagatgaaataattgcaccatgactatagaaactagtaagagtcagcgcctgaaattaagcccagggctgtctcctttgacactggccaaaaagcagtaacctcttttgatgaaggggcttacttcaagctttgtttatgtgatgaaaacaccccagggctccagaaacttaacatttggttccacatccagaaaagtaaatttacaaaatggtactgcaagtgataattctcgttgacctgggattgctagggtataagcattctgggaatacctgggtttctgatcaggaagtcattcgcagctataatggtgatcctcagtcaccgggactctgggattgctagggtacaagcactctggggttacctgggttcctgaccaggacatcactcgcagctatagatggaatgctttaccccttttctcctgtgttatatgacatcggttagcaccttttaacctttttagaagataggttggaagttgagttagataaatcaacaggtagctgatggcctagaatataactttctgtagctttcaaagtgaggatgaggggcatcttgttccctaaactgcttcctcatgatggggaacctcagcattgtcttgccttgtgtctgagtacccatgtaaaattcagtatttcattcttaaaagataaaggggaagaaggaataacaatagacaaagagattccaccctagtccccatcctcattctggtgaaaagttgtcattactaagacaatcacacactcgatggagaattgtaggctgtggacaacagagccatagatggtgtactaatagctgctacaaaggacgcctctgtcctacctttcatgcccagctttgagtatatcctgtctcttgctcattaccgatgctgagttttagccctgtaaccagagtcctctttctttttccacagatgggactatgaactgtgttttaatgattagagggagtagtgaagattttcactgtgaacattttcaccccctttcccatccttggccagagatgatctcacatggtcttggcaggtatctttttacaggagtgcatgttgtttatcttgggagctttttgcacagggaaggcctttgtcttccagctctgtgaatccttcttcactgcgtagcaccttgcagaacatttgcacatattaggctcttggtgaacacttagaatcctcagtcatttgcattcacgtcatgtttccataacacattgaatgaaccagcaagtatttattgaacatttactatgtgaaacacagggaagacagccatgaacagaccagacacaaatcttacgtgctactggataaaaatgtaccccacggatgacactttgggtattatgatgccaacaatgagaacatattaaatcactttggtatttgcattagattgtgtcctgtaagtttcagattggtgtatttgccaaagaacaattgtgtgtaccccccacccaccagaaaagaatacagtaaaagtgctaaactattgaatatttttaaatggtattatatttgaaacgtgtgtttgtaattttgagccatgtaattagaaatctagggtttatttaaattcttgtttgttttagagaaatatgtaaagccacatttccctttatataaagtacttggttgaaaaaacaatttttttctaaagaaaaaaaacactctttagtgtacttttgccaattaaaagacagtacagagaaattgattcctcctggagtttgtgtagaaattagaaaacataatgcttttccctaggcatgaactcgcttaaaactactgagaagcttatactcacgcaggttgaatggagtgaatagtggtttagagaattgagctgattaataagaagtccctgattttcttttaataacacgttctgacccaataaggaaaatttgcactatgttttcctacagcgatggtgctgttaaaacttatgcaaatgggacaactttattattactaagccttttacagtatgttgctttccagggagctttgtaaatcattataattgtgtttcctcagtgtatgggttctgaatgctcctgttgtcctgtgaggtgaatttccatttggtgaagatgatactgttaaatggaggtttctaccccatagaaattaagaagagataaatgcagacagacccagcccttggaaattctgctttgtgatgaattatttccttatacttatggtgaacttttttacccgtgatgtgcacaggggcccagaatcatatatgacaagtccttccatgtggactacatccatatgacaccatgttcactagttggagccttggaaatccagtgggaatggtgagatagtgtgaacagctccaaggcaccgtgtttttaatgtaacccattcgtttctggctgaataggctagttgttgatgtggtgggcattatgagatagtgttaatggttgggccacggcatttcaaagagatgccttataagtcctgagcccattgtgcgtctctgatcattttggtcttcatttgctccccttgcccaccgtccttccacagagcattctctggaagcgctcagggagcagaacagggcaggcccacgtagaaaatggtctcttgagagtagaaggtcaggttcgctgagatctctgactcagaccacccgtacccatgctttttgttgtgatggagaaggtgctctcatatatacacatttgtgtagtaattactgcatattgatagcaatgttactgcacctgttaattaatataaccaaatggcatagctacagtgttttattctagttcaatttaggagagtatatttgttctcaatgggaattgatctggggagacccagagagtggggacatgagggttatttgtggaggggatgacacagcagcttcagaaaacagaaacattaatgcattagactgctgacctgtggggtcacacttccttcagtgatgcccataagagtcttggagtgccggaaagtataagcaacgctgagttcctgccagtatcacaaaggtgtgttttggataagagaggagccagaaagattacacttgtgtagaaagtgaaaactgagtttgagggaacagtcacattctcatggcaataaggtgggtagaatgggccgctcagcctctgcactgtggtcagctggagctggaagatggttgtggtggggctgccgtgtgcacggtgggaggtttagcagcatcccaggacccaggagataccagtagcaccgcctcccccagttgtggcaactgaaaatgtctccagatattgccagatgtcccaggatgccatagggggagcatgcagtatcattgcctgttgagaacctctggaataaataggtaaatgcatacaaatataaggatcttagtcttgcattgggaggcggcgtctgacatgtaaagacaccactagagcacactgaagtaggttctttcagagcattgcatgcatgataccctggagcccaaggagaaaatgatcaggccatgcctcctggaatcaagaaggcttgacttcacggcctggaggagataagttttaaactgatccttgaaggtagaggtaggtgaggaactagatgaaaggatcagtattaggtgggcttttaaaatattttctggccgggcgcggtggctcacgcctgtaatcccagcactttgggaggccgagacgggtggatcacatgaggtcaggagttcaagaccagcctggccaacatggcaaaaccccgtctctactaaaaatgcaaaaaaaattagccgggcatggtggcgcgcccctgtaatcccagctacttgggaggctgaggcagaagaatcgcttgaacctgggaggcggaggttgcagtgagccaagatcgtgccactgcactccagcccggacgacagagtgagactgtctcaaaaaataataataaataaataaaatagaatttttctgagtattttgtatgctgttgaaaaatttatcacttcgtagatgtatctcactttgtctatatctaagaaaaaaactatgtgcataaatgaatttttattagctagttaatctagtcagtggaatggagtattatttccagagttccacttcatattccttggtaatattgagacgctggttgtagtgaaaatactcttaattaaggcatgttgtaggttcagagtttagatggctgaatttcatgaagggtcttcaaagcattgggggtgtttggtgtacggtagtgattttcttgtgttcatttgacattttaaagtgatagacgtttaaccttgggctttctcaggactctagaatatgaatgatcactgttaactgtttagaaactcatgatgtaagcccatatgacttatggatttatgcacattctaaacagataagcatcatacaaatataacttgagttttctatgaaaggacagtgagacaccaccccccgcaagtctggcctgaacattggtggactgggaatcataaaaactgatacatacatgtcttactttgtgtttgtttgttctaagcgaaagcatgtgaatatgcagtcatctgccaatactttgtgggccagcccaggcctctgctctgaggatggcccacagcctggagtgccccagtgatcccagcactgtccacacccgcggtgcatccctcctggcttctagtttccagttaacttaagcaaagctgcacagacatctcactgtacatctctctagatttatacctcccctctctaccttcccggtcttgctgcccacacctgtcctcaagtaaaaactgattcacacttaccctgtctctcaaacattcaatgttattttcattttgaaaaaaggctgtgaccctgtgtgtactcgtacttcatccgtctgtgtaatatttaaagtttgtagttaaaatagtgaggacactgagtgaaatggggctgggagcagacttggatcggctttgggagatggtgtaggcagcgatggggacaggtggaggtgcggaccggagtgccgccctctagctgcgagcttacatcctcatgcttgggtgtctgtccttcagtttcttctccagtgccacgtcacctacctgagctgcctcaggtttgctccctgctgctgtgcacacgtaaatcagtgtctggcgggaaacaggcagacgcctttacaagaactagttgccatttatctttttattgttagacctcccagtaatgtgtgaagtctagtaattgcctgtgtgtcagactaactcagttgtaagctctacattatggtgctattaatctcttcaatgtaggcaaaatggggacagtggctcccacagcaagcccatctgctctacccatgtaagttgggagggatgtggtaccgtgtggcttctacttctccatccactttacggttgatgttcatgcttattgtaaaagccctgcaagacctagagatgctgtgagtcctcacgaaggaaaatgcagtgttccgtggggttgtgctgtccactacaggctcttgacttctgaactttctgaagtttgtatatttatccgggaactcatacttaccaagctgtattttaagtttctttcctgagtcaggcaccctccaagctaagtgctgtggctgcagaggcccctgccctgatggagcttgcctgttacttgggagacttgtagcaaacagaggaacaaagaaacaaaataatctgatgacagtaacacatcctgtgacagagacgaacaaggtgacatgggttggaggggtttgcacattagaggtaagaagactcctgtgaggaagagatggatgaaccgaagtgtgtaagatgcagccggaagagccaggagaagagagtttcaggtggagaggccagcacatgcgaaggccaggcacccaggaaactgagggaaaacacaggccaggccagcatggtggagcgagtgaccaacagagcagaggtgtgcacggtgaacaaagcctacagtgctttgccggccataatactaagaggatgagtgtggacctgaaaccccccagcagcttcctaccacactaaccagtggctggctgctggctgagggacggactgtgatgactcccactgggtcccaggcagggagataacctcaccttccactagcatagctcagcggagccaagaaggggagaggacagattcaggacactccagtgcagaatgtcagcggacgtgcatgtgtcctgccaggggagtgaaggtgtggcatgtgagcacggagtgggagggaggtgtgacttatggagactacaggctagaagagagacgagatgccatggttgggtgggtggaggtctctgctgtgggcgtgttgcgtttgagatgctgcttggaccttcaagtggccaagtcatgcagtccctgcagggataggtgaggagctatggaggttgggggctggagacatctgggatgtagacctggagactagattcgttcactggagagacccatggcggtgtagtcagcgaggggcactcaaaggtcgggaagatgcctttcagaaactcagggtgcccaaagcatttccaaaatcatttaacacctccttgcattttcacagggacttggaacctcttaggagataagaatatagggaaccagccatctggagacttctgcagagaatatacattaatatcactgtcttattctcactgactccccacctttttaaaataagggagatggcctagactaggaattttgcttaacttctatcctcctgtcctttttttctgactctgcagttttcatctgaggtagagagaaatgatgcactctgctaaattagacctgaatatctgttgtttttcttagacttgtgaagtttttactaacaaccacaagcacagtcctgaacatcgtataacagcatcatttgttaattttttgaatgaattttgtgattaaccttgatttaacaagaacacccagcccatttcccaacgacacaaattaatacaaatttaatgaaccgaagtgtgcccttctgctgccacgtagctcagttctccagggatggaagctggcctgagaatttctaagtttgacgaacattcagatgttccagaaactatcaagattctgagactgtttctaggaaaggccacaactctactggaaagtatatcagaatgacatttttgaatctgaaaagaaaaaagtcctgtacatttttaattttagttaagagtttgaatctggcttaatatattcttaacttgctagtttgaaaacaaactggtcgatgctcattttcactctcataactgtttcgatatttctgattttttttttttctttaaccaacagaggggtctttggaagacatatgtgcttttaagtttcaattttcattgcaattttgtttgtggtaaaatgcacataacattacatttaccattgtaagcatacagttcagtggcattaagtacagtcaccatctacctccagaactttttcatcttcctgcactgattctccatcccccatctccacacccccggaaaaccaccatcccactttctagctcttgttttgactactctggtgacttcatatagtggaatcatacattaattgtcctttcatatcgggcatatttcacttagtgtagcgtcttcaaggttcacacacctgtgtcagaatttcattctttttttttgtttttgaaactaagtctcactctatcacccaggctggagtgcagtggtacaatttcagctcagtgcaacctccgcctctcaggttcaagcaattctcctgcctcagcctcctgagtagctaggattacaggtgcgcgccaccacaccctgctaatttttttgtgttttttgtttgcttgtttgtttgtttctttgtttgttttttgtatttttagtagagatggggttttgccatgttggccaggctggtctcgaactcctggtctcaagtgatctgctcaccttggcctcccaaagtgctgggattacaggcgtgtgccactgtgcctgaacagaatttcattccatttaaaggccaaatatgtcattgttcgtataaacagcatgttgtttatccactcatccgttcatagacatttgggttgctattccaaaatagcttttggctattgtgaatgatgctgctgtgaacattgaggaacaagtgtctgtttgagtctctgcttccagttcctttgcatatacctagaagtggacttgctggatcacatggtaattctgtttactcttttgagggcctgccatactgtttttctgaaggtttaagtttttgtgagatgtgataaaggtagggtccaaccgtgactcctatgatttgatgcaaaggttaacccactgtatcctgcaagccaaatttagcccttgctaattttgtacaggcaacatgctaaggatatttttaatattttcagatggctaaaaaaattgaaggataatatgtcattatccatggaaattcaatgaaattcagatttcactttacatagttgaagtttcattggaacacggttatacccattgtctgttgtctatggagcagactttgtatggcccatggagtgggatttgctatggcccttcgagaacaaatttgcaggcctggcatggtggctcatgcctgtaatcccagcactttgggagggtgaagtgggaggatcatttgagcccaggagttcgagaccggcctaggcatcatggagaaaccctgtctctacaaaaagtacaaaaattagcggggcatagtggtgcatgcttgtagtcccagctacttgggaggttgaggtggcaggatcacttgagcttgggagatggaggctgcagtgagccgtgattgcaccactgcactccagcctaggcaacagagtgagaccctgtctcaaacaaacaaacaaacaaaacacatttgcaaacctggttaaaatgataaggagttcgacaaagcttacttacgtctgttgactgctctgcccaactccgtgggcttttccaagggtctgagtaggtgcatcaagctgtccacctaattactcacaccatcctacacattatttgtcacttttttgcatgtaagcaccaatcccagttgcttaagcctgcagggggcatttccttcagtaggagatgcagagtgtaaaaactccaacccatttgcatcttgcttatttcaggtacatttcctttcctgtttataattccaaagtgtggcttcctatcatgccttttaaggaactatctattcccattgactaggagataaatctctgtatagtggaggaaccaaactgaggaagacttctcaaaattgttctttttatcatacacttttttggaacgaagtttatagccaactaagaggcagtcttctatttttaatctgtgatatttctgtaaagtcatgtaaatgtcataactgcagtgttttcaagttgttgttgtttttgcaaagagctgttctctgcagtgagggctgagtgtgacttgttaaaaatgaaattcacatagcatccgtttcctccgttagcttctttcacttaaaggacatcttcaacatatcatttaagggcaacacttggttcatagtgtttaatttgttgtcaggaatgtcagcctcagaacttcttaatatacacacccaactctactgtaggtgcctatataatttacatttaacctattattttattttattttattcatgagggtgatcttaggacctgagataaatttgaacaggatcaatacaaatcaggctatgtttaaaccaggaagcagaattaaattctatttttcttgtatttgggttttgcaggaaatggggcatcgtgttttctcttttgaaattgtgtttgaagtgatatttgcatgaagaagcagcctgttttctattagactggtaaagtgggaatagtagaaaagagaaaggcgggatttgggaaatgtgacatgaagacgttgttaaataaggtatgcgtataactaaatgtggcaagaacaatgctacttagatacggaagctgctaaagtattttaatgttctctttacaaaaaaaaatttaagaattttaacatctgctagagctcaatctagtctgaattttttttctcatctgacctttttcatttttcctttctcaaacacacttgctcatttaaaaaattcagttggagaaccaagtaatatgtttccatttaagaaagccacagataaatattgttccatttgaaactacagcttcactcacttgatacttgtatgactattttaagttccttttaaaaaaatggctcaaatttatccttttgggagggactggtgaaaacgtctgcaggttcatcttggtttttaaatttttatgtgtttaattgtggtaaaaacacataaaagtttcatcttgctttcatgtttgcttttaaggtctgagaatattaatagaacaaaaggaacacaacagcattccaatgaccagtgagtgtagctgttcccactgtgtggttatattgtttttttacaagcctacatatgtggctttacctatattttaatatgtgaattcatacagtgtaactataaagcattgtgctcacttagtggcacagagaggttaagttactgactgggggacatgcagccctcagcacgaaattctgggatttagccgagaacagcctcactccaggatcatgctgcttctcagagtttgctagcttgcattgttagagtgtaatttctggaaaacaaggccatactggaatccggaggagagaaagatggcttacactgggtatgagtacagtgtagttgagatgtgcaaacaagatgtaggtaagataaaagaaaatgcaaactaggccgagtgcggtggctcacgcctgtaatcccagcactttgggagactgaggcaggtggatcacgaggtcaggagttcaagaccagcctggccaaggtggtgaaacccccgtctctactaaaaatacaaaaaattagctgggcacggtggcaggcgcctgtaatcccagctactcgggaggccgaggcaggagaatcgcttgaacccggcgggggggcggaggttacagtgagccgagatcatgccactgcactccagcctgggcggttacccttttttggttgtttttattttttattttaagataggtcatgtggtgtaacgggaagctgatgggacttagggtcagacgacctgggatcattcctggattccaatctccctggcaatgtagtaaaaggtctccttgtctttgagatgtcgggacggtgatgcagtgaggggcagggtgttagggaagactaaactcatgtaacacgaagcatgacacgtgtcgcgtgtgtctctttgtaccacaatatccttggacatacatattcctgacctggtaagatgagattctgtatgttttttgagacctcagcatcccatgcccagacactaaagtcacaggggaccatcagagtcccctagtagtttggaaattctgatcaccagtcagcaaagatatttgactgttggaaattttttaaatggtgagctctctttttctgtttcaagattcggtcatcctttctaatagtagacacggaagtctttttgacaaaggtaatgctaggccctgcactggctgacactccatgcagtgtactgtccttccatagcctgtgccgttagtttacagaggtcagtagtacctgcccgccccacagggtttgtgtccaagtgcttcatcgtggtagaagtggtttttaatgaaacaatagatttcttggtcttgcttcaagtgaaatccctgaagtgtttgctttcccgatgatttcatgctgtaaactgcctatttgtggccatggcccatgagcataaagcagcatcattgctattcaggcacataaaagccagatagaagaaaacctcactatttagccatcgtgtcagagagagccaaactacatgtctttctgggccctggtttttaggggattgaatgtcacccagaccttgagtcttagttatcagtgtcgcatatcaagaaaggacactgaggaatcagaattcttacaagggtggcaacttttattttatgaattgaaaaatattcctattcagcggctgtagtcacacaaaactaggcctgatgtaaggttccacacttttaaaaagcattgtatatatttaactaggattctgtagtcatttatattaggaatattgttgctagttgttttgcaagtttccagtagctgtaatgcaactagggaagcatttacatattgaaggcaggagccaccaataatgtacggattttaacagtaattagggtatctgggaattgcacaggtttcattctcgaaaagttaactgaattgcacagatcaaaagtgaaattgattcactcatctaaacatgcactctgttgctttcttggtgagaggaatgacccacctacttggtcttcatggagctcggtctcctcatctataaataatatattaagtgttgatctaagaatctatgaatctgaattttacataatgagagagatgtacatgtgagtgaaaagcaaaaccctgtgataactcatttttgttccagctacaatattgtggactctgtggactaactatagccaagacttatctgagtcaggaaaaaagtatcatagaaaatccaaaaattaattgaaggcagttgtttgtaggtacagcccaagtgactgcataaatttcacaccaactaaaagtgttaaagagtaacaagatgaaggggttagaatgatttgtgatggatacattgtgcattggaaattgtttgtaagacttccccaataattgtgtttcagttgcccaattcctgtttattctcattgtgcagaagtaagttactactcccttcaatataaattagtgtaaattgtgaattgctttcgtctaaaacaatgagagcacccaacatgaagccaggacttggggttcaaatcctactacttgttacctgtgaagccagcctagattgttcacttacactcttcagaaagcagcctctttatctacaaaatgagaataaacagggctgatgtgatggttcagttatataatggacataatattaaatagactctttctttctgaatgggaaagtgaggagttactgtatttagaagatgcataaccagccttgctgttcaagaatgttaggaatgaaaacagttgatatgtggttctcatgactcaattaaaagatgctatgtttgtgtaaaaattaagaatacatttctgctgaacttgtggaagaagcttagagcagaggctgcctgtgcattaagactgagaggacttggaaagagaagatttttaatgttttccttttacattagggtttcctaactgtggcactgttgacatgtagggctggagaactatctgtgggaggtccttcctgtgcactgtaggaggttcagcagcatccctgggcgtcccccactggatgccagcagcaccctctccgtatggtgaccaccataagtgtctccagacattgtccaatgtcccctggggggcaaaatcacgcctgcttgagaaccactgaaaatttccccaatataaacatgcattacttctgtaattttaatagcaacttaaaaaaaaagatgtcatttccaaactgacaaggctagtctgtacagcttcacatattgaagactcagaagagttggactttttttttctttttcttttcttttttttttgagacggagtcttgctctgttgcccaggctggagtgcaatggcgtgatctcagctcactggcaacctctgcctcctggattcaaataattatcctgcctcagcctcccaagtagctgggattacaggtgtgtgccaccatgcccagctaatttttgtatttttagtagagacagggtttctccgtgttggccaggctggtctcaaactcctgacctcaggtgatcctcccaccttggcctcccaaagtgctgggattacaggcatgaggcactgcgcctggcagacttggatgtttttacgaggcgttttgggcttgtgttctgtaagcatcagcttaacagaaagtgatgttgcatgactgccccaaagactcctggtggcagctgtgaaagcatccagggaccaaaacctgtgctgaggttgccctcaggcacctgtgggcctgtcagtggggccattctaagtaaccaagacaaacctgctctacttgtggaatacggatcttcttcttctgcatgttagttgtctagggtcaccttgatgatattagtaggttatctgttctactttagtaatgtgttaggagtgcacagcttaatcaatctaatatgatactgctctaaggtagggctcagcaaactactgcacacaggccaactggcttgcagcctgcttttgtaggtagttttattggaacacatacacatctgtttgcataaacacacccatttgtttacagattgccagtggcttccaggtacacgtgactacgatggctgcaaagtccaagatccttgctatttggccctttagagaaaatgtgtacctaccactgctccatggttctggaactttctccccttctgttgccatatctaggtatatctcccatctgttaatctcagtttcagaaagggggaggatagtaaacagcatagccaaacaagacaaattatgatagagagcactgtgaatatttcaactttattcagtgcttttagtgagtatgcgtgtgtttctctgcatatcagatgcatgtaacgtgtaccagagtgtatttattaaaatgcctggctcatgtacttgttcatgaaagaagcaaaacaccatcgttttccttgatttaaaaaaacggtagcagcatttgtgctggagaactttgatagaacatggcagttgcgtgtaggatattggaccagacaggctgttggggccagagttttaagagggtttctctagaaacagaccgtactaggattacatgggaagtgagtgtggaatacttcgggatcgctgatcgccggttgtatgggagtgaggagcaggacggggctcagtggggagctttctggaatgccagtcccgctctttcctgcatgtctactacccccgtccaagcacttccttggctctagtatgtcctcatgagcagggcccatgacttcccggtgttatcttctggataatttaatacagggttcaggatatttgttaagtcccataaaggtgttttaagtgaacagctgaatggcaacctcagtttgatgatgctctgtctcctggaggggcctaatgtctggctgtctccagtctccttctaacagaccggcatcatcgtgtcgtgttaagttcgcttattaattctctaccaaaggcatctgcatttagtgtccaggaatcactcgatgtttcgtttctttttatgttttctttgcctccgaaatatcttccacagattccctaaggacgtgaggaatggaggaagttgtgaaggaggagaactgtaagctgaatagaatacagtcatccctcggtatctgtggggtattggttccaggacccctgtatataccaaaatccagggaggcgcaagtctctgatataaaatagtgtcctatttgcatataaactatgcacatcttcctgtaaactttaaatcgtagattacttggaatacctaatacattgtaaatactatgtaaataattgttatattgtttttaaaattgtttttattgtattgtttttattttttaaaaatattttttttctttctttttttgacacagggtcttgctaagctcactgcagccccttcctcccgggctcaggtgatcctcccacctcagcctcccaagtagctgggactacaggcgtgagctaccacgcccagctaatttttgtattttttgtagagactgggtttcacaatgttgtccagactggtctcgaactcctggcctcaatcagtcctctcgccttggcctcccaaagtgccgggattagaggcgtgagccaccacacctggccttaaaaatattttcaatccgtagatgcagaacttgtggatacagagggctggctgttcatattttcaaagactatatatcaacaacatataatcaatatataacatatatgagatatatggataatatatatatatatattcagtaacgatatacatgtattcaaagtagtaggtttgttatagacagcatagagaagactctggctttttaaatccagtttcacaatctcggcctcttatttattttgctttgatttttattttatttttgaactttttaggttcaggggtacatgtgcaggtttgttacacaggtaaactcgtgtcatggggggtttgttgtacagattattttgtcacccccagtattcagcctggtacccaatagttatcgtctctgttcctctccttcctcgcactcttcacccggcagtagcccacagtgtctgctgttcgtgtctcagccttttcgctggagtggttataccatttaccacttgctctttgttttctctttgtaccacttactctgtgtttcctttttcctcggttcctgtgtgcttttgcataaattgcggcttttttgtgactatacttcacagtaagcttattagcaataactcattgctttattttttagggtgttgctctagtgttgacaattttcatgtttaaccttatcacaatctatgtttgaaagatattttacttcacatataagagccttacaacaacaatgtgctttcattctccttccattcttagtgctttgtgctacatttgccgtatgttttacttttatacatgttacaaacaccataatacgttgttattaattttgtactaagaagtcaattatatggaaaaggattcttttaaagagaagaaaatatttttatgtttatatttactatttctgccacttatcatttctttgtgggaatccacattttccatccgaagtttttcttccccttcatggactcccttcagtctgtcttgtaatgcaggtctacaagaagtgaattctctctgcttttgtttctttggtaaagtctttattttgccatcattctttgaaagatatttcatctgagtgtagagttttgcattgatacatcctctcagttctttaaagatttcattgtcttctgccttgcatagcttttgacaagaaatttgcagtttttactatcatttttcccctggatataacttttgggttgttttctggctgcttttaagagtttgtcactgattttcaagaaattgattgtgtcttgttggggttttctatgctgtttatcctgcttggagtttgtttagggttttgaatctgttttactttccttaactgagagttttacaacttgatttgatcttggaatccttaaaatgcgtttttggtttttgtggtttttttgagacagtctggctctgtcacccaggctggagtgcagtggccgcgatcttagcttaccgcaacctccgcctcccgagttcaagcgattctcgtgcctcagcctcctgagtagctgggactgcgggcgcatgccacaacacccagctaacttttttgtatttttagtagagatgggatttcgctatgttcgccaggctggtctcggactcctggcctcaagtaatctctccacctcggcctcccaaagtgctgggattacaggtgtgagccactgcgcccagccaaaatgtgttttaagtaacatattttatcatctcagtactagtgttttattaatgaacactaaaaccagttagagaaacactgatgaaaaccagtgtttattatttttacatatttttataactccatattggctccttggaccttttagagttgggttacgagaaagcaattgggcatttgcctggtattatgtagagggtatgcaaacacggttagcttgtggaaaagatatcagtaacaattgcctgtgtaaccgccagctttatgggagtgctccagtagtaacatttttgcttgtttcagctataaaagctattaccacaatctgtctctctcattttgtacagtaatgatccatgaacatactaaagggaaattgatggcatacccagggttaccatttacagatggcagtactgaaatgttaatttcaaaaacattcaaactgtagttttcttctgtagacatgggacaagcaatttttatcatttaatcatgcagacttggttttaaaagaaaactcttttaagatgttctttgcttttaatttatagccttctagtttgcttataacatatatgcttatttttaaagaacattaaaggttaggcctaaggaatttgtgtgcaaaattggtcattgattattaagaaaataatatagaacctttttttatgtcataaatacaactttaaaaggaaggggactcttcagagttgcctctgaggagcacatatgaaaaagaagggcagaggtttactgcagtggtaaaaaataatccacctagatcaagactattccaaaagtgaatttaaaaagaaaaaaagatgagatggtaagatatgaggaaataatgaatgcattgtgactttccacctccccatacccattttcatagtttggtgagtagaaagagaaatgaggatgctggcccaattttgattcccagtggatgaggctcacacagaactgccctgcttcttgacactattatgatattaaaagtaacttgtatttttataagttattaccatcttggcacacttgcattcattttagtcaagtactgtcacctttagatttcaagcttgcagagtcttaaaaaaatacacattggagaacacatagtcttttaacagtaaaatctcagcttattagaatgtttagtgactgaggtattcagagtcagtcagaaaagtatctttaggatttcagcatgtggagatgtctttcatagagaaaccggggagagtcaggcaaaccctagcacgttgagcatggcgtatcctcatctgcacgggcacttagacacctggacaagtccattagcagtaaggcaggatagaggggttcacaggatacgtgctgcccaggatacgtacgtgcagcccagagctgggaggaaatcatgaggaccgactagacatttattgtacagatgcatgactggctggtatggcctgggatatgtcagtgaagatacaccgtgaggttgtgggaggtaggattcacagtaaatcctaaattcttcatctttgcactcacgacgcacaatagctgatcaaagcttttagcaaactgcagcaaatgaaaaggcggcagaacctcatggtgacaaatgcaaaccctggagtcggactgcaagcattcacaccccagctccaccagtccccagccctaggacctagacatggagctgcatgtcagtgtgtccgttccctctgtgtgagaacgggatagtaacagcgctccctcacacgctcctgtacacatggaaaccaccactgccgtcggacacagtgtatgctgtagaagcacttatggtactaagcacattaaatatttaaaattattaattagattatttaatccaagctcaaagctctcagaacagagccaggcatgtaacaggtacaatatacatgttagctattattattattatttaatagagatggggtcttgctatgttgcccagactggtcctgaactcctggcctcaagtgatcttcccacctcggcctcccaaagtgctgcaattacaggcatgagccactgcgcccagcctattattttttaataactttatgtaacccggtgttgccaattgttttgaagtgtggagccgtttttcagatgacacatactaaacatctactaaacagcctgagaaacggcactctgaagagcatgccttggcaaacactcccctacttactctaaaactccagtcgattggcttccaagttcacttggttctcatttttcctggcaacaactctgcaaattattacccccatttgatgaggtgctggctgagaaggccccttgcccaggtatgtttccgacctgcctgtgacaaagtgttagattctgaaagccgggagtgctggcctcggttagctgagtgataccagcgtggggtctttcgaggctgcaggcaagatgtccgcccacctaaaggcaggatgggggctggaggggccgtgtcccggcgcctccttcctgtggctgctgagttggtatggctgtaggcagggggcctcagtcagtgttgtaccgtgctggcctcgccacgagcacccgaaggaattttatcatacaaatttgattctgttttatcaagagatgccagtagcacctccacttccagttgggacaccccaaaatatctccagacattgcctaatatcccctgggagatggcggggggtgtggggagggggcggcagcgggcactgtctcccctgctccagaacactgtattgaaatacagaaacgtgatgccaatcccatgcttttatttgggattaaatgtgtaatccatatgcttctgagtgggaaaaaaaaaaacttggctccaagcagaaaatggtgcatcctttgttgtcattgggcaaatgcttggtagggatttgatctgtgtagaggaatgctcagtctgcagtggcagccaggtagtgagcatgtgcggccctgcacacagcatgagcttgtcagacagacagtgcttgccaagcagggctctggcatgcgcttgttgttggctatggctcttccatgggcaggctcccggctcctccttgtgcatccatcccctttgttggccaccctgcctgctggccttaggccttctgctcctttccccaggtcctggctctctccagcttggcctccctccgcccatcctgtgcacctttcattcctgggtaggaggagactcaggtaaagaaggataaaggcagaacgatgccaggcaattccactgctagccattgccccaaggacatgaatgttcatagcagcatggttgacccaagccaggttcctgtcagctgctgcctggaaaaacacaacgtggttcagccacgcagtagcatagtattcagccataaaaggagtgaagccctggaacgtgctacaacatggatgctctgggaaaacatgctcagtgaaagaagccagatgcaagaggtcacatattgtatgatctcatttagtgccccaaatagggaaattcatagagccagaaagcattctgtggtcaccaggcctgggggaggagggaatgggagtgactgcttagtgggcaccagaactcctttccaagtgattgaaaatggtttggaacttgacataggtggtggttgcataacatctgaacgtaccactaaattgtacactttaatttggccaggctcagtggctcacacctgtaatcccagcactttggaaggctgaggcaggagcatcacttgaagccaggagttcaagaccagcctgggcaacatatcaagacctccatctctatatttaaaaaaaataagaatttttttaaaagaaaaataataaaatggttaattttatgttgttacttttattccaactgaaaacaaagcaaaacaacaacaacaacaacaacaacaacaacaacaacaacaaccatgtatggtccaggggaatgtctatgttgggcctgaggtgtgctgttctggtttttcttaggtgaatgggttctgaaggctgcatcaaaagaggagtctttaaagttgctaattctttcctgataggaaaagaatataatttctcaaaatgactgctttcgaggaatgcccctttctgaatttgaaaacatagtattaaaaagaagagtctctcagtgctttagattattatttcttgtattcgatgtaaaaatcccttacagtggttttacaagtctgcagaggaattcacaaagcacgattgaaaagtgatgtacaggatttatagttgaatgggaacaaaccagctgatctgcatataggatgaaatttagctgagggtgctattgagtttggacaacatttggctggacctttgtaactcttcagctctatgaaacaatagttgtgtgaagaattaaaaggtggaaaatgaactgtaggtggctggctcacatatgcctaggtctatttccagacacagcgaacagtgaaatgacagtgtcggtgaggcaccagttcaaggaaatacacaaagactgcctactcataaatacagacacaatggggtgataactggtgcttgcacttggagatctagaattctaaaacatcggaaaacaatagcagaccattctgtgtccttttctttaaaactatctcttgaaattttcgtgcttcccccaagaacatcctcaaagatgccagtaaaaataactccacaggaatctttctgaattccaatatccatgtgaaaaggctgcattttattctgatttttcacaatagaattaaggcagacatgatgaagaaatgaatgtgtagaggacttccgaaatctgtattaacgtgtgtgatcagcaactgtaatgttttgattgattatatatggtacatctttcattcattaagctaactttaatcaagtatgtgttatgtgtcaagcctggactgtagaaatgaacttgaagaagaaaggactcttcctcctgttcgggtagaaaaggtataatgcgtgttatggatggtgtgaccgaaggaaacaccggataccatgaggaaaattgagatcatcacccagggattctgtattctacttagggaataggctaaacatcaaaatacagcaatttgagacaaaggcaggcggtagtcccagaagggtaggtgtcaaatccccaagagcatcggcggatccaggttcctgttgtgttactatcctgccttcctaagggtcagacaggctctcaagcaacccccatgaccacaagttgtgcacatcctttcccagctcctctcacctaccattggcaagaactcagtagtggaacacctggggtctcttaatgaggtgtgcttgtgtgactaaaagaaaaagaaattttgggggaggagcaggctggtggatgtgcagtttctaaattatcttgtattttatttgattacagtgtttgaattcagtgttttgaagagatgtatgtagcactgcaagctctattctaacctactttctttggagaagcaggtacatgctgtgttgtgtcagcttagagagccccttcaaaacctctccatgttcaatgtggagggactgtcactatacatgcatggcacaccacaccaagaacagagggctaccagaaaattagaatcccttttatatttgtcacatatcagcatttatttagctgtaaaaataaacagcatatggcatttgttaaaatcgtttgtatttcacacaaatatttggcaatatgtaaactttcttgccagggctgtttattgtggttctatttgcatactaataatggggaaatcagtaatgaccaggtgttggaaggtctgatttctcatttaaatgtattgtttctagcaataaactaattatttttgacatgtttcataaccagaagaatgttattaaccaaagtcataattcctatttttgtgttgatcacacacagatgataagttaattatacttattgaatttaacaacatatataagagataatctcaaatttcaagactctcatttgtgggttaccatctgttttggaccaaagaataggaatttgattgcaagctttcttctgaacagcttgtaataagagctgtttgtatattaattacttattgaattattgtggattttaatgttttaatttacaagcaatttggaacttattgtggtgacagctgctcatattttgatactttatggtatttagcaatttcatcataaggctattttttcccctggtaatttataacccaatcctgaaaacagtaatttggtctctccagctcactataaggagtattgtcctgtttcatccccactgcagatttttttcatagttaaaagtatattttataagcaaaatcaagattcctttgtgcctgcttccctggtgccctttcatttctattcagagttacagatgaatttagtttcactctcattattttacttcagtggtagattttttacaaattgccctggttattactttcatcttgaatatccttatggtttttgttttcaatgtactgtaatgcactttaggggcctgtgaacctgcttgtaggtttttttttaatctccttcctttaaacaacataactataaacatgactcagtgggaataatttgcttgaatttccttaaaacacttgagtttctatataaactccctaataagaaacaccttcactcatagcttcacttgtggacttcaattatattaaacctggtacctttttattatcactgaagactattaaataagaatttagagaaaatggtggacatttaatttccttagttcttgaattcgtagatgatagaggataattgatactctctaggaggcaggaatcattcacaaccaaagaaattttataaggtaaatatcattaggtaaatggtttactgattagtgtttatagtgactgagaaataaaaacaatttttgatataaaggattatcattttatgagccataaacctggcttcctcataaatcagtgcaaatggaacacttgtgaaacagaaatgtctgaagagtaaatgaaaagttgagacgttagtgggtgcctttggttttcttgattttagaggagccggaggagaaaggattctgacccgtttgtgtgtttttatgagcacagtacatgaggatgcatatatgcacacaaatgtgcctggtagagttattggaaagctagcccaagcgatggggaatgtttagctaaagcgtgttgtcttctcccgagggtgtgcacaggttcatgtatcagctgaataaggccctgttccaaaaactgatatttcaagggaaccttaatttatctttaaatttaatgtaatttaaaattaatttaaatctttaaattatctttaaataatagcagtagcaatagctgagctaacattaattttatctattttgagactcttttatttcagaacttctacatgcataatgcctgaccggccacttttaatttctcctttctttcactttgcaaacaaaaccttacaatctgtgctatggactaagacagaaattaagaaccaataaaatgtgttaagttttaattaggaagaagaaaaaacctaaaggaacgggatggttgagaggtaaacacaccccaatgatttttaagtcttttgtttcaaacctttccctttctccctaggctggtccctgcagacggcttcccatttttatgaccggatgctgggaagcctgctggtccacaggtccatacatgaagtcaccataaggtaagcagcccagcatgccattggatccttgcccttgtacctgaaatccgtttgaggagcagaactgcattttcccaaaatggaaccccttctgttttaaatgatgttgtcaggggaagtgcccggtctttctccttactgaaggttgaaggtagtagacagacaatcattaaatcattgcgagctgcatagtcaattccaaatgagaaatttgcctttttactgacttctgagaattttgggttgtgtttttgttttgttttgttttgtttttgtttgtttgttttgagacagagtctttgctctgtcacccaggctggagtgcagtggtgcaatctcggctcactgcaacccccgcctcccaggttcaagcgattctcctgcctcagcctctcaagtagctgggattacaggcacctgccaccacacctggctaatttttaaaatagtttcagtagagacagggtttcaccatgttgtccaggctggtctcgaactgagctcaagtgatccgcccaccttggcttcccaaagtgctgggattacaagtgtgagccattgcatctggcctgccttctgagaattttggatcctgaaggagctataacaaatttttctgggtcttaccaggcgaggatgacaccttctaaaatcaacctctcttgtcaacattatcaattacaattatgcagacaagttaattataattgggtgcatgagtatagattttatttggctcctatatcttaattctatgctttatcagtttcttaatatgatttgtgtctgtctccaaattgatttgctagttaactttgaaacttattagaaaatcatggagattactatgtgtaaatctggtgagatgctaaggtttcctgactagcacaccaaacaattgtatgtgcacaggtgtcaagagttgagaagcccgtagcccaaactaaaactgagacccatgccccaaaagttctgtaaaagttatcttactacctttcggtacgtgtgattttaatttcactttacttaattgttatttaattttctgtttctttctctaatgcctttttagttaaaaaaacaaacaaacaaacctgtagaacttgggcagttttaaagtgtaaagatagaattttgaggaagctttttgatttactattttaagagaaccaactagaactaaaatgatagacttaaatttaattaaaataagcagcttactgtttgaggtacttttgtttaaagccagacatatgcatatgtaggttgttttaacaagttaaatatgtataagtattttaatgaaaggtgtagtctgtttataaaaacaaaatttgtaatgtattagtgaatttgaattttctgactggctttttcactcagtataatgttttcaaggttcgtgtgcattgtggcatgtgtcatttctttttatgtcagaatattccattgtgtggctagaccatggatagaacatatttgattcatgcatcagttgatggaaattggagttgtatttcccttttggttattattaaaaatgatgtcatgaacacacatatacaagtttttttgtgtggacatatgtttcatttctctgtggcatttacttaggagtgggtcatatggtacctctgttgaacattttgaggaactgaatttttccaaagtggctgttacaccagtcaatatttttcgaaatgccattgaaccatattttaaatgtcagagggaagcagggaggggatctttctcttatcaatgttttgagtgggtattagttcagtactttgggaacataagcttcaatttcattgaatccagcacacattggatttctcctctgcgtgaggtatctgtgtttggctttatacctcagtcatttatacatgactgagtgtttttgtagcctttgataacttgtatggtttatacatgcagatagtcatttggcattatcctcaaaaatggtactctattgctgtagttcattagtaaggttgggaataacctacataacatactctttctgcctatgctgcgtgctgcgtctcagaaagtgagggcttctaacggtttccttgaggtgtgtgtggtttcaacacatgtcctcctttcaaaggcatccatcgcagaccctggtgatagtgttttttgtatctcagtcttaaaggggttggtatggttatgaggaatgttcacattcaggggcgttcactgttgaagttctcaggcaggaagattccaagccgagaagggactaggcagtccgttctcggatgtagaggtgggaaaatctgtggtagagcaggaaggactgagagcaggctcagcaagcatgttctgtgatgggcccgatagttaggggcttaggcttcgcgggccaggcggtctgtgcggcagctgctgtactctgccattgcagtgtgaaagcagtgtaggccctacagaaatgtatgaacatggctgagtgccaagaaaaccctatttatagacactgatactgggttgcagtttgctgaccctaacctagaggaacacaactgttttctttccaccttttctaattgtggccttttgagttggaggccacctggaggtgaggctccgagaggcccacccaagggccatgatgtgatgaagacagactctaaattgtgattacgtagcgaaggcactgcagatatttgggggtcaggacttttacgtaaggaatttgagggcctttctgccacataagagggagtggctctgggcctgtgtaactgccctaacttgggttctcaccctgggggagtctccacccccaagataacctgggaatgtgtggagacatgtctggttgtcaccactgggggagtgggtgctactggcatctagtgggtagaggcccgggatgctgtcaaatgtcccgcagttcacaggacatcctccccaacccctaaatgtcaaacgtgaggagattgaggagtcctgctcaccgctgcttctgtcagccctttattttgtacttgttgtcagtcatatggctgtggaattataggctatggggcattaaattacaaaatttagtacctgtgtttgctgacataagtgtaaggatggttggactctgatctaatatttgggttcatgatgcttttagttttttccttttttaaaaacgtctttgtcattcatttaaatataagcctccaaaattgatataggccaggcacggtggctcacactttgtactccctgcactttagaaggccaaagcaggaggatcacttgaggccggaagtttgagaccatcctgggcaacatagtgacacccccatctttacaaaaaaagtaaaaacataataattagccagaggtggtaacacatacctgtagtcccaactgctcaagaggttgaggcaggagaatcacttgggcctgggaggttgagccttcagcaggctatgattgcaccactgcactccagcctgggcaacacagtgagaccctgtcactaaaacaaaacaaaatgctgatataacactaagatttatatgagatccaggccacattgggggatggggcaccgcctgcctttcgaactgtagggtacgcttcagagtttatttttcacaacttcacaggccacatcatatgtgtaggtgaacccactgctgactccatctactgccagaaagagactcatcatggtcaaattaaattcttcatatgtcagtgaaaaatcagtgtcttagagatatcatgaccagagtgcatgtattcctgaaatttgtttgaaggcccggtgcacattgtgtagaaactgtgttcagtctatctaaaagataattaaaatccataaattaatttctggctggaaaataggtcataatggatctggatatcagaagtgctaggttaaagaccacggtcatcaggaaaataggatgagctcctgctccgtggaagcagtagcatcagtgccttccaaggcagtctgctctgaaatcttgggcacgtgcatctgtgttgaactgtggccagaggaggagaggatgaaagggaggcagtgctctttttcttacatgcattgtccggctcatgtgatgtgggtttccctggtagtggcttgctcttgctaggtggagcattttcaagagggcttccttcctgtcaccatagcatctgccgttgacgtgcatgtgggctttggatgaaagccccagccagccactaattaacccagaagggtggcagggcacagaaaggaccttttctgaatgcctcatcatggggattttttcttttcttttctttttttttttttttagatggaggctcgctctgtcatcctggctgcagtgcagtggcacaatcttgggtcgctgcaacctccatttcccaggttcaagtgattctcctgcttcagcctcctgagtagctgggattacaggcgtgcgccacaacgcccagttaatttttttgtatttttagtagacatggggttttgctatgttggccagtctggtctcaaactcctggcctcaagtaatcagcccgcctcagcctcccaaagtgctgggattaacaggcgtgagccaccatgtcccgtcagggatgattttattctgtgaaaagcggcattccttttctaacacaaaacctctcctctgctctgccctcccaaccctgtagcctcatttcctatatagttgttttcatactgattatctctgaagacattgccaggtcgtttttgtttgttttgagacaaggtcttgctctgttacccaggctggagtacagtggcacgatgtcggctcactgcagcctccacctcccagggtcaagcgattgtcgtgcctcagactcccaaatagctgggaatacaggggcatgcctccacacctagctaatttttgtattttttgtagagatgggtttcactgtgttgcccaggctggtctcaaactcctggactcaagtgagcgaccacgcccagccgacattcccaggttttctttacgttttaataaatatgagtagtccatgttcagagtagaaactatacaacgtgtagaaagatacacatgcaattgggagccgtgcttttcccacacagtcccctgtcatggacattgcccctgcctgaaatgctgttttcctggccgcatcttatgccactagtttattccatatttaaatggaggcgtcactgctcggcattggaactctagtaacgaagaaataattctttgattatatttaccatttcagaccattgactccaagtaaataaatataaccgtaaaactaatgggaaattttttactttgcggggaatattttcgtactgaaagtattgtatatctgattgtgggtaaatggagagaagtgtatgaaagaaagcaagcaacataaaatatttttatgcatttctccccaaacttttcctctgtatgtgttttcctacaggtttgggtcaaactgtaaccttgttggccctcttttctgttttgttgtcgccccctgccacccaatttgggacatatcataaatatctttccattaacctagctttgaaatttttaacttgcactggaagaccacagcgtttaatgtcaaacaacgtaactttaaatcctagcttcgctgggatttaagttggttatcttccctaagcctttatttgttaaacctataaaatggtaataagagtaatggtcatatttatctcttggagttatgactggtgagatcgatcgtatcgtgcacatagcactcacacctgatagctagcatacaatccatgccgtgtattggtttctaaaatcatcttcatggcggcctgatagttcccatatgtgttcactgcaatttatttcatcgtgctgtcactggacaatgagattgtttcgagaaccacacattgtcttctttacaattacataggatgaaaagatgtgcaaagtggtaaaacaagcctgtgtcagcccccaaataagctgctccccaggcagatgttagaaaaggtgtattgggatttatatgtaaactttatacatacatttaaaattctgtcttaagctggttactgattgtgaaatgaaaataaactcagtttacatctgagcagagaaaagagccgctgcctccaaatgggcagagtttgctcgtttccatgaagcaacttggagaaagaggtgccctttagaggctgaggtcagttcaagcagatcttccagtgaccctggctcggtccagtctgcatggagacaagccccaaagacctgagccttgtccaggccatccctccaagcaatggattcttccagcacagacgccaacagcctgactaatagcagcctaactaatgacactcactttctcaggtgccttcagaaaccaagggctgctttagaagatctttaagatgtttacataacagggcaaatggctgaaagataaagcttcccctccagtgatgtcagaggagctctgtgcgctgcccttcctacaatacacgcccccttcatcagctcgtgcttccttcgctgtttcagaacacggctggcctcttggcaagaaacgaacttgccctttctgtccttaactaccagcaccagctctccagcaggccccatgtgattctactttttaagataattaaaacagcaattaagattttgtttggggccagtgttctcccacagaatgatggcatattgagtgctctaactacatactcaatgaaatgaaactcttaaacagccatttctcctgggaccgaatgctgaactgttttgtgaagggaactgcgaattaataggacttttggccaccttgaaaccaaggcttaaaaaaaaatactataaataatctccccttcagcttcttgacggctctaaaccccaaattatcacttatattgaattacttatctttagcagagaaacttcaaaaatgccatcagcccatgctcgtttgttcttctttgccttctttaagcagcacagtgagagaatgttgtggctttaacccaaagtggaaggtggttatttcgtttttgcgcaatcacaactccaaacacctcaaatcaacctaattgaaggtgtctttaatcaaagctgggtcaggcaagaaaataaacacagttgctctaattaagactcccctctcatccccctcctgtttggggccaaggaggagctgtgagtgctgccaaaactctcctttattttagaactggagaaattggaaaacatccacaggagttctcagaactcgaaggctggaagcggatgctgttcgggaaaccggttaggtgttagaatgcggcttgtgtctccagctgtacatactagaaaagaatgcccaaacacaggcctctggtggtagttctttttggttgggctttatgtgtgccaccttgcctgcttgacattgctgatgagccaggacgaggagtcgagccctgagtggtcatgggcgaggcaggtgtgtgtttccctgatcctctcctactgacctttcaggtctctcttggggaattgctggaggagctaaaataccagctcccacatactggatattttctgtgcatcgggctctgcataaaagcattgactcctcacactctcccctttacataggggctatttgatactcagtttagagataaggaaacagccatataactgaccctccaatcccagggctagatagtggtgcagctgcccctagaagtcagggtctctggcgcttggccaaaggctccctgaatcccacatctttacctgttctctgtggctctcaggacgtgagctaccttatctctagccaataagcctatacggatggggactctcaccctgatttaccctaactttattgtaataaagtcataactgtcataagaagtaatagttgcaataaaaagtagtaattgtaataaagcatgaacattccaaactccatgttatttgtccacaaaaatagttcttggcacagaagacaaaggcggactttttcccacagaatacatagctgtcgatggcactttgctttgaaccttggtgtagagggcagtcctcatgccctgggctgaggggtgcatgtgacacatcattaaaagtcaaaaatcattttcatagagcaggtcctccccacatgtacacccagagctcctgtgcttctctcctctttctctgacttcttccaaaatcgtgggtcttgtctccatcagtcaagaatttaacttttcttccaaaacatccccctcctcttctgtgaaggaaggtgcttgtggactggccttaggaaatgtcgcccagacaggaacggcacaccagtgtgccatcactcaagccagaaatgaggtttgcagtgaccttctctgtgcttgagagttctgctacactacgaataccactataataacagcacatttatttgtgggaaattaaacagcaaagccctgggtgggagatccataatttaccatcttcctgtgaaatttagttctggtcttagaaaaaagaggaggaggaggaatttttattcccagccttgtgtgtggtgaggtttgtctggaacagtggttcttgcagaggaatactggccaggagactcacttgagtcaaaaaactgaagaagatccatgaaaacaaccaccaccttcaagtgagccacttagagataagcgcagctaaacgccgggacacccagctgatggatggtttctcttgattttggtgtgatgaagcccacagagctgaagggcattaaatacagctgttagggttaggagtccattcagagaatattctcatgcttgtatctaataatctaagaatatatatgtagattctacaatttttggaattaggttttaaaagaaaaataatcatttaaaagctagcaaagtaagtgtttgttgggggagaaaagtttgatccaaatattaaatcagtcttaaaaaattaaaatatgtacttgagatggagcagtcagtcttaccaaacattacatcctggctcgattgcaggccatggatagtttttgttttgttttctcttctgcttagaaatcaaaaccctttagaaagttaacaatgtattggggaaagcattccaatccttggaccctaacttatacatttaaaaacaatgaatctgtgatcagaaagcagaaagccagagctgaagcagaagtttttctagttggaagaaagaaagatgtataatgcaaattagaggaacagataattaaaaatggcccgtaatccccatctcctcaggatcttatattctcattctccatagttctatataaacacatgcagagacacctgtatttatcacagatgctcctggggtggggaatattaaccaggctgtgtatacaggtgtttcatctccacgaatcagagtatctgctcttattttgaggcaagatctcactctgtcacccaagatctcactccactcactggagtgcagtggcataatcatggctcactgcagcctcagcctcctgggctcaagcaaacctcttgccttagcctcctgagtagctaagaccacaggcatgtgctaccatactttgctaatttttaaaatttttttgtagagagggcatctccctatgttgccaaggctggcctctaactcctaagctgaagcaatcctcccatctcagcctcttagagtgctgggattacaggcatgagccattgcgcccagctggtaccttttcagtggtcaggtcaccaagcagcgtctgagcctgcaccagttgccttactttataaatggagttcatttcaaacacaaaatgcttattttccctctaaagagcaatggttctcggccagctgcagttttgcaatgtgggacatttggcaatgtgtgcaggcatttttggttgtcaccactgcaaggaggttgggggagtccaaggatgctgcagaacatcgtgctgtgcctggaacaggcttgcttttttttttcccccagagtaaaagaggaaaggagctaggcatggcaaacaagaagggcagctgggaagctggggtgtttgccaggtcctgccagacatagtttcctctctgtgcctcagtttcctcatctgtaacatgcagagatgagatgccctccaagattggtcctttccagctgccctcactgggagggggcaccgtgccctgcctcccaggctgactcgtcctttgtaattctcttcctttccacgggactccagattcatgccggtcccactagccctgttgccctgttcctaagcctgtccagaaatccttgggactaagtgaggctgaagctatagcgctctgctcttcctacctttttaagaggtcttacattgtaaaacttcaatttttcaaacactcactggctcacagaagaaaataaaataaaaagctgcaattgtgaaaatgtaattgctcaactttagctcatgctccagatcagtgattttctcttttagccaaacttctttataattatttcctttatttttataatagattcttcaaaattaatttcaaaattccttatctaccgtctttcacaaatgtatgtatagcctagagaattttggtaataattttgtgatacatttatattgggatttgtagctgccagcctttttttttttttttttttttttttttttttttttgagaaagggtctcacttccgttgcccaggctggagtgcagtggtgatcgcggctcactgcagcctcgacttcccaggctcagatgattctcccacctcagtctcctgagtagctgggactacaggcgtgcaccaccacactcagctagttttttcgtttgtttgttttgttttgtttttgtagagacagagttttgctgtgttgcccaggcaggtctcaaactcctgggctcaagcgatccgcctgcctcggcctcccaaattgctgggatgataggtgtgtgccactgtgcccggcccaagccattttttcagtccattctttttgctcctcctagtaacccttcgtagcaaccagccttccattgttcagtcaccagaagttaatgatagaaaaccagagatttctagctgtgcaagatgtagagagaaacctaaactctatacatttgctattggcactgtgttgccatagtcactgcagcactcagcatcaccaaaagcctgcccagtgctgcaacattctttagatagatttttgttgttttattttgtctccttaaataatatttaatttttcattaggtcatgctatgatttcatagcttattttgtctctaatattttcttctgcatgctgtcttttgagagacctctccagagttcaagcacaaatcctaggacagacttgtattttgactgtcaaattttcattgcagtatgtgcaaaagtacagaaatgtcatcaaattaagcaaagaagataagaatttttgaatggcagtgttctggcaactataaaataaagtctattaagagtgcaaagtgagaggtggaatgtcgccagggcagctgcattcattatctcttgctggataacagacgaccacacgtttagcagcttgaaacaacacacattcattctctcaccgtggctgcgggtcacgggtccaggcacagcacagctggggccagtgctcagcgtcccacaaggcttggtccgggtgtcagccaggctgcgctctcctttaagctcaggggttttcttccaagcacaggttgttggtagaattcagttcctgtggctgcaggactgagaccctcagctccctgcaggctgcctgccattgcctggacagatcatgcaatgtggtgttaataatcacaggagagaaatgtggtcaaccttgccatgtaatgtaacctaacctagggagtggtgccccatctccttgacgcattctggaagcaagtgacagatcttgcccatactcaagggtcgggagtataccagggcaggactttgtgggggtaaggtatgtccctggcagtaaccattactttgaatcctcccattaaatgtaaaatatcttccaacttgaacatatactttgtacttttctccccctaaacaaacaaaaactcaatcctcattcaacaatgaaagttttgctgcctgtaaagatacttgcaaatgtgtgatatagacaccaaagacagttcccaaacagcctaaagatgtttagtgctggccgggcgtggcggctcacgcctgaaatcccaccactttggaagtctgaggcaggtggatcgcttgagttcagaagctgaacaccagcctgggtaaaaccttgtctctacaaaaagaaccaaaaaattagctgggcgtgctgatgcccacctttggtcacagctacccgggaggctgaggtgagaggattgcttgagcccgggaggtggaggttgcagtaagcccagatcatgccactgctctccagcctgggcaacactgcaagactctgtctcaaaaaaaaaaaaaaaagaaagaaagaaaaaaagaggccaggtgtggtggctcacgcccgtaatcccagcactttgggaggctgaggcgggtgggtcacgaggtcaggagatcgagaccatcctggccaacatggtgaaaccccgtctctacaaaaaatacaaaaattagccgggcgtattggcgggcgcctgtagtcccagctactcgggaggctgaggcaggagaatcccttgaacccaggaggcggaggatgcagtgagctgagatcgcaccactgcactccggcctggcaacagagcgagactccgtctcaaaagaaaaaagatgtttagtgttggtgacatcattgacgttagttgcagcctttctggggctgcccagctgtttggagtgagcagctcttactgatgtatgaattctggtttgttcatggacaacagagttctttccttgcttgttccctttgggctggtttgctcttgtgtctaaccgggtggtgtctaagaaaaccagactctgtcttggctgtctcacacagaagcccctgaacgttttcctgcccatcctccctccccagatttctgcctgccttctgggcaccagaagtcttagccagacggatgcagcggattctgtggtgaaacacaaatgacagaggtgctccctgccttctgtgttctggttttccaccaggagccctggcctccttgcagaaacatcgaggtgacatgtagcatgaccgagctcgctggcgcctcttcatcgtgctgccaccgccctgcaggaagaggggccatgcagtcagtcttgcaccactttcaacgtttgcgagggagaggtactgcggttcctcatgtggccaggaccgtgtggtcactctttgggggtgttgacatggccgcgggtgtactcggtcacctctccatgtgtccagaaaagtgctcagtgttgaatccctccacgtctgcctgagtgcactttgggattccattcctgccgcttatggggcgcgctgcggatccctgcatgcacagagctttattgaacgcaaagtcagttgtttgttgtcgtgctctgttgcccctgcttctggcttcattcatgtggtttttgctcaattcttccccggccttaggaaataggccaactcttgtttttttggaaaacatttcacctgggcatatttttctatctataattacggaatttttatgtaatcacataattataaaatataacacaatcagatattaattaccttcatgtgtataatagcatggatattattttctttagtcatctcaaaaaaaaaaaagagaaaaatacaagcagtgtttcaaaactctcttctctttttgaacagagggtggttcccacttcatcaacacctcatcgccgcgaggtgaggctaagatgagcataaccagtgacgaggtg
